United States Patent 8,781,750 (CELL-TYPE-SPECIFIC PATTERNS OF GENE EXPRESSION) - sequence listing, part 10

SEQ ID NO: 36148 - DNA, 504919 bp, Homo sapiens
gtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactagacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcagtgatgatgctctaagtggttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttagcatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagccaggcatggtggtgggtgcctggagtcccagctactcgggaggctgaggcaggagaatggcatgaacctgggaggcagagcttgcagtgagccgagattgcaccactgcactccagcctgggcgacagagcaagactccatctcaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagccataatttgttaaataggagaaaaatgggagtacagtctaggcaaacgcatggctacaggtatggttggaatttagtagaccaatgtggctacaaagaattaggtgagggagcaatgaagatacgattctgtaaaaccttgattatcagctacaggagtttgaaagttacacaatgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaggtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccggtgaccccgcataatttcttgatgaattgtgcaaactgggaagctgatagctctggaaatgagaaagcaggtgttattttctgtttctgaatatccccaacaagattgcaatgattcttttacttatcgtgttcattgttttcctacctattcaaggatataaactgtgtttcttcacagaaatttccaaggaaactatatttcttacattgatggaaatgtatggaaagcatacagttggaccgagaaactgtgagtatattctctccaaatatgacaaaaagctaactgcattgtaagatccttcttggtccagaattttgaggtcggtacctctgaggaaagatatttctcctccacgccccaaatcaaccactgttgattgcaattgtatggttattttaaaattaaatttggtaggctctctttaaaataagaggcaatttaaatttattttttatcatacaaatagtacatggttatattcctttttgttctctttttttttttttttttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtactgagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaactttttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattattccaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagggattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaacgatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccagtttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataacagaatttggtgggaagaaacccactcttcaaggggtgtgcttgagtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctagcactagctacctcctgtgcattttcagtttttaagttgtatagacaaaatacagacaaaaacatttcacatggtaagaaaatctgagcagtgactgacacccatatgaaccttgttttataagggttcacatatcattctttttctattcagtctacaaccaatagatccaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaatattatcatcaagaatattaagctaccaagagaatagactggtattaaggatttcatttcaggaattgttatattaaaacagatgtttaaaatgatggttaactggtagagctagaaatgtttacactaagaagcacatcagaaatgcccctaactcttcactaattacaaaataacgatcgccccagccctgttaccaagaaagggatccctgtatttctgtctgtttagagacaagaagatactatgttcattgctatgaatgcttgattcttaccctttgtccatagaggtgtgtatgtcattaatccttattaagctcattagtgatgctcttttgcaaacagattctctcaaatatagaaggcttaaggaaagtgggtgtaaagaccctcaggtggatgccaaagtgctacagagaccatgaaataataaaactacgtttcctttaaaatagttattttccttctactcactcccccctattcatttattttacaaatatttgagtttgctttatttccatgtgtcagttttaaacatggtgggcaatgcagatgagcaagacctagtccatgctttcagggacctgtttatgctcagaagaaatgggatacaaaataactacattaagaagaagaaatggatgtgggcactaggagggataaattgtttctcgaacatagaagaggaaaaaatgccttcaatttggacccaggaggatgttactagaacaatgccatttgaataggactttaaagggccattgtgtaacaccagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactagagatggagacatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcaatcttggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaacaggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctttttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagagatgctgctaaacatccttcaaggtataagacaaacccccatggcaaagagttatatagtccaaaatgttgatggcactgaagttgtgaaatcctgttctagagaaataaagatcacttaacacaggtatttactgagcattcactgttttgtatctaatgcaccacatgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttacgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaaaaatctgggcgtggtggtgcagttttttgctccctggaggactttgtgttaagcttccttccttgcagctaaatgttgcagacatttaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccaggagggggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcgctgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagacgttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttatacaactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattagctgggcatggtggcaggcaactgtaatcctaggtactcaggaggctgaggcaggagaatcacttgaaaccaggaggcggaggttgcagtgagccgagatggcaccattgcactccagcctgagggacagagtgagactctgtctcaaataataataataatataataataataatcatcatcatcatcatcatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggcccttttggagtcaaatcttcctggtaaacaaagctacactgcagtcatatttggcatatgtgacatataggcccactgcatttccttccaaaggcaagatgccaagggaaggtgccagtaattttatgaccaatatgacaccattttgtggtgtttgtaagttgaaacaatatatttccctgcattacacaagtttataaaaaacaaacaaaaaaagaggccccagctgtggttgatcgatgatgaatagagcctaaccttccaggcttctcacttgcacaggcccttccaaggtcgtgggagggcccctggaaatttttgtattcataatttttttaatgtttttactagataaggctcaggccccacaaaatcctgaaatcatccctgggttccaatagttacaacccagtaaatctcttgaatgaagcctctatgttattgacaaatactgactggccaagttagcagggtgatagggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatactagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcttcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacacggctaataagtggcagaaccacttacaagctttgcaaataattttcaatgcagctcttagttcccctgtaataggagctgaatgatgacaatttggctttgtgtgcattgtatcttactttctaacttgaacaggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatattgggtgagggtctaggtcatctgcttatttctttgactaccttcttccatggaaccagttttccctgacagccttgggattctagcatagatcattttggagtttgtcatttaaatttattttcacagcctgctttggacattttttcagctagagctgttaggatttcagtacatttaagacagtgatgacatgctccagtcctttcatctctctctcctcagttaatagaaaggaaacatagctcatctatctggacctgtacagaagaatttggagggaaaaaaaagaacaagcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcaaggctgggcgcgctggctcatgcctgtaatcccagcactttaagaggccaagacaggcagatcgcttgagcccctggagttcaagttcagcctgggcaacaaagtgagaccccaatctctacaaaaagacttttaaaaagtggaaacataaatataaataaataaaaacactcatatcatttggtttgtggaaaagagttgctgtagagtcctcaaacttgagccgttgagccagttcccactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctttccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaaagaggagggggatcacaaggcaggacaagctgtgtggctcccagcctcgccactgactcactctgatcttggtcaagggagaatgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatatatcttctttgaagaaatatttattcacatcctctgcccatttaaaaaattgatttgtctttttattgaattataggaatttctctatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattacactcaagcctgggcaacagagtgagactccaatggagacggggtttcagcacgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcataagaaatactggtctgtaattttttgtgtgtgatgtctttagtttggataccaggttaatatcaccctcatagaataagttaggaaatgttctttcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctttttatgtctctaagaacaatagtaatgtcccctctcatttctagttttaataatttggtcttctgtatttttgcagtgcagtggctcacacctgtcatcctagcactttgggaggctgcggtgggaggattgcttgaccccaggagttcgaggccagccagggcaacatactgagagcttatctctacaaaaaaaatgtaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgctttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatcttttccccacatttcccccttttctattcaacaaaaccaccatcgtcatcatggcccgttctcaatgagctgttgggtacacctcccagacggggtggcggccgggcagaggggctcctcacttcccagaaggggcagccgggcagaggcgcccccccacctcccggagggggcggctggccaggcgggggctggcccccacctccctcccagacagggcggctgccgggcagaggggctcctcacttctcagacggggcggctgctgggcggaggggctcctcacttctcagatggggcggctgccaggcgtaggggctcctcacttctcagacggggcggccaggcagagatgctcctcacctcccagacagggtcgcggccgggcagaggcgctcctcacatcccagacgggcatgcccagttattttcaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagagaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctagtttttgccaaggggctctgtgtacatgttggggcataccttcagcactcagctagacaatttacagccatgccttagctttcacttcttgcttgtgcagaacctcaaggtgtcagccaggggtgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaattttttttgaataaatgctccttgggttgctgcaagactttggttacatttctagagttctgaaaaagtttattgtggtcaatttttttttttttttttttttttttttttgctattttttttggtatttgttgcttttatgaagggatgaatttttggatgtctctttttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcactttgttagccaggatggtctcgatcccctgacctcgtgatccgcctgcctcagcctcccaaagtgctgggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgctctccagcctgggcaacacagtgagtgagaatgtgtctcttaaaaaaaaaaaaaaaagtctcattgaccatagactaataaactatttaatcatgggaaatgattaggggaaagacataaaaagagaaactgtaatccacttttttttgctctgtcgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcactgtaataattattatttttataatttctgcctaagtacaaagatgattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaacttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaactaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaagtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaatttttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagcagaattttttttgagattatgctaccatccatgttgttgcacctatcactacagctggccctccatatctgcaggttcctcatccatagattcaacgaaccatggatggggaatatttggaaaaaataaaatatataaaacaacaatacaacaataaaagcagtagaaaatttaaaatacagtataattatgtacataccatttacactgtattaggtacttagagtatacctgaggctgtatacaaacattatgtcatttcataaaaaagaactcagcatctgtggactttggtatctgcagggggtcctggagccaatcccctgcagacaccgagggacaactgttcactcctttttattgctgagtagtattccggttgtgtggaaatgccatctctactaaaaatgcacaaactaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagttaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatagatatatatataaatcagccaggtgtggtggcacacgcctgtagtcccagctactagggaacctgagtcaggaggatcacttgaacccaggaggtggaggttgcagtgagccaagatggcaccactgcactccagcttgggtgacagagcaagaccctgtctaaaatatatatatatttatatatatgtacgtgtatatatgtatatgtatgcctgcggggccctattgtgagtttgttacacaatttactgcaacttcaattgtgccaccagcccccacaatatggcaagctaaatagagactcagttatgctagggctggttgagggcattttgcaagattagcatggaaagggcccttcatttagcactctgctccgttcatttttgtcaggtcactttcttatcttgaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaaatgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagatttgtcagtatactttaaaacaatcctgggaacagttctagattgaaggagactaaagaatcatgtactaagtgtaatgtctgatgtttgattggattgtgaattttttaagccatgttatgattgggacaattgtgaaaatgtgtatacggaccgcatagtagacaatgataatatgaagttccattgagtgatgatagtcctctggttatgtcagagaatgccttggttcttaggggctgcacactgaagtcttcaatggtgaagggtcattatgtctgcaactgactctcaaatggttttgtccagaaaatgtatagacatacacacacggaaagctaatgtggcaaagtattagcaactactgattccagatgaaagttatacaggtgttcattataccatttgaaaatgtttcccagccatcctaaggcttaaaggaaaaaaagaaaatgtttaaaataaaaacttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggacccaaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatctttcatgacactggcattttttaagagtcaaagatagttgtcttgtaaattgtcccacaatccagatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactaagctatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaacaataatacaaaacacacaactgcaagaaatgcctttgaagaaaatgattttatggaaaacactaacatgccagaaggaaccatctctgaaaacacaaactacaatcatcctcatgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttactgcagtgtatatttcaggatttttaaaggatcctcgctttcagatctctgtgaattgaaaccatgtgaatcccactagactattttaagaagtcgaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcgtcctccagtgtgtaaggcattgtctaaataggtccagttaaagcactacagagtagccatcttttacaaaaatttttggccacatttttaagttcactggtgagggggaacgtctcatactctagccctcctgagcctagaccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgccaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctagtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtagatgagacttataatgaataaaaggaatcaatacagatttggagacggtggttgttgtcatagataatcttaattgcgttttcttctaaaacagatatgttgtcaccgaaggtcattacaagaagatgaagaaggattctcaaggtaaatattagtctggtgattttttttttcttctcttttgagacggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagagagggcacttgtctccttcaaggctgatggaaggtaggatatgtgagtccttcctcttaagtggcaggaaacagtattttctcttttatttcttttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaggaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaagaaaagtttaaaaaggaaaaaacacctaggagaaaagaaaaatgataaattaacaaaggacaatgctcttagcaccgccatcattcaggaatttccaagggttttaggagctttgtgttaggaactgggggcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaagatatccacagggaaattcaggagttttgtttgtttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaattttttttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagccttgaacacccttggatgctgctttaaatgactgatcctcgatgcctcccttctaactcacactcccctatatcaatctcccagaaaaagggacctcttttattcttttttttttttttttttttttttcagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggcccggcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatacagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaaattttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaactctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctctcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaagttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaagaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcactataataaagtaatcaaccaaatccagaatgtggaataagcagttaaaaaaaaaaaaaaaaagagggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatgtgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatctccaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaagccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaacagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctacagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcagtggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaattctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcacccaccgcctcctggagcttttgcaccaatgagctcgaagttttgtgagtgacgacatatctggccaacgcaaagaagagtaagggcctgggagggagggagcgccgtaggcgacgccatgaagctctggcaataccatgttcatcttcaaatcacagttaaacgaattctggcgagacacgcccacgtcccccacccccgatgccatgtgcgaccaatcagaaaagcaaaaggattgtctatttgcacggccaatcagctgggaaaatcgccgaggtttgagctaacctcggagcgttcacaccaaccgggaggggacatgtgggccgggccaagttaatagtgccatggaaggaaatttaccgcggttgagttaaacgtagacattagtttggggcggtgttccgcgtaggaaataccacacactgacactgaaattaggcataaggaagttttcctattccgcctgaggctagactgccctcccacctctacacagattttcaagttggggaaaatactggccacccgcacctcgttaagacgtcgcagaaccagtcctcgtttccgagaaatgctttctatagtcagttccctaaatgcccaacttgttagctaaaaaggttacaaacgcctgtaaatggtacataactgaaatcatcagaacaacaaacatctattaaacatatactatgtgccagaaactatatcaagaacttcagcaggcccggcgcggtagctcacgcctggaaggccaaggctttgagctaggagttcgagaccagcctgagcaacatggcaaaaccccatctctgcaaaaaaaaacaaatttaaaattagccgggcatggtagcggctgtagtcccagctactcgggaggctgaggcaggaggatcacttgagcccaggaggtagaggctgcagagagccgtgatcacgccactgcactccagcctgggtgacaaagcgagaccctgtctcaaaaaacacgaacaaaaaaagttagaagatactgctagaattgactaaataaataaataaataaataagaaaaacaatgttacctgcaggaccgtaacgcccagtgaattacaaactattatccctggccagacgtggtggctcacacctgtaattccagcacactgggaggccgaggcgagcagatcacctgaggttgggagttcgagaccagcctgaccaacatggagaaaccccatctctactaaaaatataaaattagccgggcgtggtggcacacgcctgtaatcccagctacttgggaggctgagacaggagaattgcctgaacctgagaggcagaggttgcagtgagccaacatcgtgccactgcactccagcctagacgataaagcaagaccctgtctcaaaaaaaaagaaagaaaagaaactattatccctgctgttttacagaaaaatattaagtagcctgggtctgtcccactcccacaccttaatctttttctttctttttccttttttttttttttttgagacagggtctcactgtcgcccaggctggagtgcagtggtgcgatctcggctcgctgcaacctttgcttcccaggttcaagtgatcctcctgcctcagcctcacaagtagctggcattacaggcatgtgccactgcgcctgcctaatttttgtatttttagtagagacagggtttcaccatgttggccaggctggtcttgaactcctggcttcaagtgatccacccacctcagcctcgcaaagtgctgggattacaggcatgagccaccgagcctggccaccttaatctttttaagcaaatacagaatggaaactgccctcacaggattaaggagagttacaagccaggctttaggcagcattatatatagttagctgttatccagggtgcacaagtgtactttgacccacttccctgcagctgctaactcactgaacatcactccacgtgctagaccacctcctacctgtttctccatggttcttaccatgagtaagaatttctgacgctagactcataagatcgttttgcccaagaacgggttgtttttcagatcctgaattctgacgtccccaaccaaggaacccactcagcacaagaatgaggtttcttggtctccctgtctcatgacttcgcccttcacttcttgaccaatcatcgatccccacactgcagcccctgtccagaggacttaaaaaccctgccccccaaacctctcagggaggtggatttgaggcttcttcccatctcctcattcagatgccctgtgattattaaactctttctttgctgcagccaggtgtctctgtatgctgactcactgtgcattgagcaaacaaaactattaaattacagtactacttactcttctaattacagtgcttatatgtatgagggttaatataaatacatatgactccttaaaaattaaagtatgttttttctgactataaaaattatacataaccgggtgcagtggctcacacctgtaatcccagcactttgggaggccgaggcgggcagatcatgaggttagatcaagaccatcatggccaacatgctgaaaccccgtctctactaaaaatacaaaaattagctgggcgtggtggtgcattcctgtaatcccagctacttgggaggctgaggcaggagaattgcttgaacccgggaggcggaggttgcagtgagccgagatagagccactgcactgggtgcagagcctgggtgacagagtgagactctgtctcaaacaacaacaacaacaacaaaaaactcatgctagtttaattttcatttatttgatgacttgctatttttccaaatgtttactagtatttttatttcatctattagaaatgatatattcatgtcctactgacttccaagggaaagatagaaagttgttttgccaggaactatgaaggttgtttgaatggagtcatcataacctaaaaaaaaggtgaaataacgaaggtgagatttttacttaccattgtttgttcctacagaaggaatgctggagctgataattatgagaatttatccttccatccctcatagcctaagaatattcattattttcccaatatctgcactgagcctgtaaaccaaaatgtatctgagacatgtctcaatcaatttacaagtttattttgccaaaattaaggatgcttacctgggagacaggcctgtgcctttttccaaaggtgattttgagggatttagtttggtttgtttgtttgtttttgagccagagtctcactctgttgcccagggtggagtgcagtggtacaatcttggctcgctgcaacctccacctcccaggttcaaatgattctcatgcctcagcctcccaagtagctgggattaacaggcgcgtgccaccacttctggctaatttttgtgtttttagtagagacggggtttcaccatgttagctaggttggtctccaactcctgacctcaggtgatccgcccacctcagcctcccaaagtgctgagattacaggtgtgagtcaccgcgcccggccagaaggatttaagattttatttatttatttatttatttatttttatttttgagacagagtcttgctctgtcacccaggctggagtgcggtggcacaacctcggctcactgcaacctccgcctcctgggttcaagccattctcctggctcagccgccccagtagctgggattacaggcgcacaccaccatgcccagctaatttttgttgtttttagtagagacggggtttcaccatgttggccaggctcgtctcgaactcctgaccttatgatccacctacctcggcctcccaaagtgctgggattacaggcgtgagccacggtgcccagcaaggatttaatatttaaaatggaaaagcaggctggaagggaaagaaggagagtatggtcacattactgaattcacatgttgcaagagacaaggagcaagtaggggaatagtcaattatgtattactctcgtgcttaccataagataaggtggacatagagtagttagctgcagtcagtcctgcttaggaatgaaaggaaaggcaacttcttgcatgactcagctttcagcttaaatttttttcttttggcagaatgaattgggttcccaagtttttattttcctttcacaagcctctgaataaacaaagttcctgcccacatggcattcaattgctaaacaattataatcacataaatacatacacatatacgtatatgttttatatatatatatatatataatatatatttaatacatacgtccgggtgcagtggctcacacctgtaatcctagcactttgggaggctgagttgggtagactgcttgagccaaggagttcaagcccagcctggtcaacatggtgagaccccatctctacaaaaaatacaaaatacaaaaattagctggtcatggtggtgtgcacctgtagccccagctactcagaagactgagatgagaggactgcttgagcctggaaggcagaggttgcagtgagccaagatagtgccactgcactccagcctaggagacaaagtgagactctgtctcaaaaaacaaacaaacaaaatacattcatatagagagagaaaaagagggagaattttataatgatatgcatgaggaatgtataggggaagaggctaaaaataggccgaacttactagtgaatatattcaggaggtaggactgtgattgtttttaagtgatcgagggaaaatagtgtactgattttaaaatggaaaactcaacttattttttaaaaattaaaactctgacaagagggaggtttaattgaaatcacagtggctgctcagggaagtttataaatctcgaactgcaacgactcaataagcatgaattgcttgtgatgatattgacttaatagagttattttttccttaatagaaaacacatcttatcaatataatgttatttgtaaagcatggaaaggacaaagtgctcttgggagaagtagaaagagaatttcactctgagaaacctatttggagaaagctcctcatctctggcttagactttaaaattagttaatagtgtaattagggatagttgtagtaatagtggtattggtatggtagttagagtttaaatgtcacacagaatacccagaccaccttcccccaagtgccactaaacttattcttctaatcaaacctctgctcaagggatgtcttcttcctctcttggaaagctgtgttccttacctcagaaacagccctccataaacctgcccttaagagaatccttggccaggcacagtgattcacgcttgtaatcccagcactttgggaggccaaggcgggtggatctcttgaggtcaggagttcgagagctgtctggccatcatggtgaaaccctgtctctaccaaaaaataaacattaaaaataaaaaaattagccaggtatggtggtgcgtgcgtgtaaatctcaactacttgagaggctgaagcaggagaattgcttgaacctgggaggcagaggttgcagtgagctgagatcgttccactgcactccagcctgggcaacagagcaagactccatctcgaaaaaaaaaaaaaaagagagagagagagaatccttaagacatgccttcttggatgccctctggagaaatgtcaagagtagccaatatagtcaccccagtcggctgtggtgtgtgggcctctagtgttttaaggttctaggcaacttagcccctcccaggagatgctgatttacttttctcaaggtgcataaagtctcatcacaccaatatctgaaaaatctcttttcaaagagatgcaggcagccttccagccccatgatgttaatacacagggttaggcagcctggcaagtgcactggggcccccactgaaggatcatctggtttccatagcaacagtccttcctttccacggaggattctatcatctctcctgctcactcaggctttccagaatgaattgttttttgtgactataggtgtttgtccttgatcctgcaaagagaaaagacatattcatttaaaacaaacaccccccaccccgccccgcaactgactgcagctagaatactgcattgcatcagctggtcttcctttcatttaaaaattccatgtcctttctccattttgctccgttctctagctttatccatcattttagaaaacaggtttctctgacagaaaacaaacagatggcaactccatcatcctaaaactggctgtgacggggctctaaaattaagtgttcatggggctcccagaaagcctaggcttgcatggtatgtgtggctgacctgtgagttacgattggaggggcaagagaaggctttctatacacagatggctccccatacagtgtcacagtctctgaagtgttgccttttgaggtttgttttcttaggtcaggcactgctgtcctgtcagtattttcctaaattgccaatactcctgggaagagtaatacgttaggttactaatactgaaagaacttgggaaagagaggagggggtgcagcgggaagggaataaaaggggctctgaagaccacctttgtgtgcttcacagtgacatcttctgcaagaggggaagtgcaggtcttcatctctctctttgtctctctctgtcacacacacacacacacacacacacacactgcaggacgccttctgacaattacaatacagtagtgaattcaccgaacaggactgttccctgaaacacctacatacaatcccgctggaagacctttgaaacagccctgcagtgactaaaaactctgtccccagtgccacttgtttaaccctacagtttccacagactaaaggtagttttcctttggttaatatgaaaacaccaaatagtcagattgctttgttaaataaagtggattacggtgaatctgttcacttctatgttttatattgccctcactccacaaatcacagaagatatttatttttcccccagttaaattctgttaccacaaccattacaaacaaatgtctatataaccaaaatgttagtcagccccattccaatggagcacattttaagtgatgtttaatgggacataatttgaacataaaattctatctgtgcactgttttcaagtctttgaatcaggcctccacctatagatgttggttacctatcagggagcaacaggtgatgctaaggatcactttgtaaaaaccaggaatcacatccctgtaactgacaggaaactgactatattcatcagggttctccagaaaaatagaactaacagaatgtgtatatacataggaggaaattttgtttaaggaattgactcgtgtgatcgtggagactttgggagcccaaaatctgatgggagaagctggcatgcaggaggcccagggaagagttacagttctagtccacaggtaacctgctagagaattccttcttgttctggatgagtttggccttttgtctattcaggctttcaagtgattggatgaggcccacctacattatggagggcaaccttctttactcaaagtctacagatttaaatgtaaatctcatccaaaaacaccctcacagaaacatccagaataatatttgatcaagtatctgggcaacatggccaagccaagttgacacagaattaaccgtcacactggatcacaagggctgtgttcagcaagaactgaccttggtcaaaccctgcccctgcccttatgccccactcttcttcattctgggtcctgctatttccattttatcatgtcttcatcttctttccccacctttcaggtacctttcctctctgaccctatccctagactcacctcctaccccccactcaaagcccttccttccttaaaaaatgatgttagtcattacactttaggatttaaattaatcattctgttagccgtcttactaactttctcactgtgaaaggaaagcatattaaaagaatttcagggatcgacgaagagctgagggaggtatttttctaggaagagaaagtgactaacagaaatcaagacaaagggggacaatcagatttttcagatgacagaaagcaggtaaactctagagatctagagaactagcaaatggtctcttcagggtgtcatcattgcagtaaatgagctctagctatttctgtctttattcttcagggtattcaagattgcagttacttaggagagacagagcatctgactgattgaacttgggttctgtattcactcctgggccagggggaggcagggtacctggtctgacagtccttccaaggctgcatgaaccagaggagctgttaccagaaaagggcagagtgaatttggggcagcaaaaacatttattgcttatcgactatcactgcaaggattactcagagggtgatgcagaatcagcacccctctatttctaagatgaccttgaatgtcagagcaaggcacaaacaggttgcagagacatgtggagtatctggagcactgtctcaggatccttcctctcctgctggatgctaaggaccttaaggacaagagctatctttgcttgcaatttatttggcaggccctgcagggctgtgcaaatgattctatttaatttttactacttgtgagaaggcacagagggctttgagagggcacagagggcctcttataatgggtagatatgcacattagctgatacactggaaactttccagcaggcatatccttccaagatgataaatattcttccttgttggagaaattgaagacatttgtacttgcaatctagcttatctagtaaaacaagacaaactaaccagtgatagggagaaacatgtttgcattattttccaaccttgaaaataatgtcagattattggactgagaaccaatgtcatcttctggatctggtaattatttggacaaaatctctttgattctaggttcaaagtcaaggtgtcaaaaaaaaaaaaaaggatacaactgttaagcttatttaattatacctctcactgtacaaataaggaaactaggccaggcgtggtggctcacttctgtaatcccagcactttgggaggacaaggccagtggatcacctgaggtcaagagttcgagaccagcctggacaacatggcaaaaccctgtctctactaaaaatacaaaaattagctgggtgtggtggcaggcgcctgtaataccagcgacttgggaggctgagacaggagaatagctagaacccgggaggcggaggttgcagtgagccgagatcatgccactgtgctccagcctgggtgacagagtaagactgcgtctcaaaaacaaacaaacaaaaacaaataaggaaactgggctcagagagatgaaggtacacaggtgatgggtagatagggacaaagaaaagaacctaaccctttggactccccaagccattctaatatttgtttttgtaagttagtagcttctgcacgttagtatgtcagaactcaactagtttcctatctttcctgataacctctccgacccacccatgatttagctaacatctgatttggtcaaccaagcaccctggtcctcaggttcagtgtgagacttaatgaaataggcgtgaatttttttttttttttttttttttttagacggagtctcgctctgttgcccagcctcgcaatctcaactcacttcaacctctgcctccggggttcaagcgattctcccacctcagcctcctgagtagctgagatcacaggcgcccgccaccacgcccggctaatttttgtatttttagtagagacggggtttcactatattggccaggccggtctggaactcctgaccttaggtgatccacccaaagtgcttggattacaggcatgagccaccgcgcctggctggcatgaattttttcttctgtccctagttcatcttcaggtcactgtctgattttattagttctcaaatttaaatcactatgcatgctcagctcttctagttatttcccttctttcctcatgttgggaaaaaaaccccgatttattctaattgtgagaaatgaaagcgaacaaatcctatcattccctattgtcttgtgcaaatatgaagagagatatgatagtggggtaaataaaagcatcagggaatccattcggcagaatctttctcctctcagcgtgcttgcagttagatattctgagattccagtggagaaatggtatggtggaaacattgaggttcaacaaggctcaatttagggcatattttattcagattctaccatatatattgtctaaaatgaaacaacactggggaatgaaaaggttggtcgaagatgcaagttgcctttattaaataaagacaaatatttaataaaaataatgtataaaaataatcacaattcactttcaaatctgaaaatactgagttttccaggctacacataaataaaactgccaacgatgacaattccagcaactaggaaaacaagtacgcctacaaagaaaagtgagaaaattcatggagaatttgaactcagaaccaactcctcggagctgatcttttttgggggaagccagggaacgcgccgggcgctctcatcagcaagaccatgtttaaagagagtgtggaagcacagaccaaaatggacattcgagggcgaacagcagctggcaaagggataagtgatccgaagcattaaagcccttgagacaaattccggcgcgaaccgccagtgggggatgagactcgcaggcgcagccctccaggccccggcggactgacacgcacgttggaaacggagtcacccaccacagccccgcagctccagccaaaatggcgccgccgctctgcccaccccgcgcaccccaggcggccgccgagcccgcgcgcgcgccctgtggagcgaggacgccggggacgcggccagggacgcgcgcgtcctcacggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacactcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggtgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatgtctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtaactgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggcctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccagtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactcttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagcacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcatggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctcctttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccatataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatatgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacctgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctgactatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctctgtcacacaggccggagtgcagtagtgtgaacatggctgactgcagcctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaatacaaaaaaaaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaataaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagtgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagctgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttttttttttttgagatagggtatcactttgtcacccagtctggaatgcagtggcgtgatcagggctccctgtagccttgacctcctgggctcaaacctctcacctcagccccctgaataacggggattactgatttgtgccaccaagccaggctaatttattttctttctttctctctttctttctttctttctttctctctctctctctctttctttctttctttctttctttcctttctttccttctttctttcttttctctctttctctctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacatcctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaagacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatactttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattacttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccaagtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgcctgtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaagtgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacattcatgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagccttttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatataagtttaacttatttctaccccatcacttctagtcacatgtgacttcagaattttaacagaaattattattataggaatatgtagcacagagggattccataggcctgaagattagtactgatggcctttcttgcattattctaggctagtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatgggggctggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcctggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtccttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctctttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagccgttaaaggcttttgtatcagatgctatcactgtaactttgttctggaatttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagccagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccatttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccagcctggctaacacggtgaaaccctgtctctgatgaaaatacaaaaaaattagccaggcgtggtggtgggtacctgtagtcccagctacttgggaggctgaggcaggagaatggcgtgaacccgggaggcggagcttgcagtaagccgatatcgcaccagggcagtccagcctgggtgacagagtgagactctgtctcaaacaaattaaaataaataaataaatagataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtaaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgttttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgattcatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaagatactgctgctgcataacaggatttgaagcttctatcttacacatagtactttttagttacctggtataggagattatcatgagaggactgtttttttttttatttacaggtaatttctgaacagggaattagcacaaaattttttaaaacagtaaatattgatatctacatgaaagctgatgtattttaggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttcttttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagggatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagatcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttatcagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttatgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactacctttacccagctttaccaattgtcatattttctttatcattctggctccctgtcttcctctctgggtctctgtctctctctgtacacacacacacacacacacacacacacacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagaagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctgatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactacagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacacctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccatctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccactgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggattttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcgcccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggctgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttacgagagctgctactgtatccttaaggggccattggtaaattttaggacaagtatcttcagggaacctaaagggaaaataaatgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttatgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacgtatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgacttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcagcctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttactttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgtttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaaagaagaagataatgtatgcctttctgcttttgtagttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagcaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagtagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcgagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccgttgcagcctcgcactcctgggctcaagtagtcctcccacctccacctgccaagtagctgggactacacccagctaatttgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgattttttgaagtgctttgattttaaattctatctagaatcccatcatgagggagaaatcttagcaagacttaagcaccttttcataatgactggttactgtaggataaacctataattagtatgttgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagaaccaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttatttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaagaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccaaaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacatcaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggctggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggtgtgagccaccgtgcctggccttttgtatttttagtagagacgaggtttcaccatgttgcccaggctggtctcgaactcctgaggtcaggtgatccacccgcctcagcctcccaaagtgttgggattacaggcatgagccaccgtgcctggccttttgtatttttagtagagatgaggtttcaccacgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctacagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctagtttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcctgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaactccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttgcctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagcggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagctcgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcaaagttcaagtgacaattctggtagataaagttttaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagacgatgtcaggtttgattttcttttttttttttttttaagaaatctttaccttgcaaaactaaaactaaaacaacccaatgacagcactgctctccagtttaaagaaaacaaatgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacctttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtctctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagtttctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagcctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccacaacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatggggtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttaccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacatacacgaacattctattggttctgtttgtctgttctgattaattatcctaatactaacatatttttttcattgacagtttaagaacaatgccatgagatttctggttctagcaatgcagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtgagatacgggctgcagcttttggtttcataatgtatgggtttgggttttagtacccactagggaacagaacatgagtccttgaatccatttacagtgtggactaggaactggtaccttcaaaggggttgtgtctatgaaaagagtggactagaaaatatctgctgccaccacagggaaattaacaaaaaatatttaactgcctgggttctggaatggaagctgggaaatctcctatgggaattcttcttcttttttttttttttttgagatggagttttgctcttgttgcccatggtggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccagcctcaggtgatctgcccgccttggcctcccaaagtgctgagattataggcgtgacccaccatgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactgaggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaagaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaaacacatactgtgtgattccatttatagagagcttacctaaagtatagtgtttaacaacacatgcttgggtggtaaaactataaaggaaaatgaattattaccataaaaatcagattgtggttacccatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaaagaagctaataatgttagttaacattaagtcaaatgtgcatgtgaaagttgtacattgtgcccaaacttttccaaagcatagggaggagctgggaaagaaacagtggaaattcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgcaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaagtggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagaggaaaaagaaacatcattactcttccttagtaggaaatggaatagcatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctatctcaaaaaaataaaatgaataatagatttacatagatcgacatgaataacactcagaaatataacatctcgtcttcaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaattctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtcgaatgattgtaatgggattgctgggtcaaatggtatttctggttctggatccttcaggaatcaccacactgttgaaacagcatggtactgttaccaaaacagatacatagaccaaaggaacagaacagaggcctcagaaataatgccacacatctacaaccatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaaccacatggctgcataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacataataaagaaaaacatcacttctgtaattttggacagtccacactgacggagatgaacacttgcatataggtcaaactagttaaatatagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccgtgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatactccttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcacgcctgtaatcctagcactttgggaagccaaggtgggaggatcacttaagtctaggagttcaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaatatcataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaagtgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaaaaaatatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtattttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaatttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaactcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcgggggtcctcagaggtgctttcagggtcagtgagggccagggagtgcgtttcagatcctacatcactattataacttcctcttttagctgttttatgtactgaggtgcttctgaagatgacttctgggggaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaagatggtgaaaccccttctctactaaaaatacaaaaaacttagccgagtgtggtggtgtgcacctgtaattccagctactcggaaggctgagataggagaatcgcctgaatccaggaggcagaggttgcagtgagctgagatcgtaccactgcactccagcctgggaaacagagcgagactctgtctcaaaataatagtaataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctggcactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccgactgcaaagaagtaaagtacctaccattaagctgccctcagtctaaccctccacgtgcagtaacagaaagtacatgcaaggcaagagagtgaactcgtgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccagatagatctaaataatgagcacatggtaggtgtccagtaaattatttttctttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatgggttttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccaggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcccgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcatgaacctgggaggtggagcttgcagcgtccgagatcgcgccactgcactccagcctgggggacagagtgagactccgtctcaaaaaaaaaaaaaaaaaaaaaaaacaaaaaacagaaaaccataaaatttaccgtgtaaccattttaaatgtacaattcagtggcattaaatacattattaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcatatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaactgaatatattcttaactattcttaaatcttggaagtccttacattttgtttttatctcttcttaggccagtactaaagtggaagtggacatggagaaagcagaaagcctgcaagtgacgagaggagacttccttgcttctttggagaatgatatcaaaccagtgagtatgcccattgagtgatatataggccaaaaagtaatgataataataactcaggcgaaaagtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcactcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcatgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagtattttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggattacaggcgtgagccactgcacccagcctcagatttaatttttgccattcagttaggtgtaaaatgagatctcatttcagtcttgatttgcattttagttattagagaacttaagcatttctccatatgttaattgaccatatgcatgtattgtgtgaaatagtgtccaagtcttttgcctgtttttctgttgtactgcttatttgattgatacaagttctttatatactctttttttctcaattttgtattgtgttaaaatacatataaagtttaccattgtaatcattttcaaatgtatagttcagtggtattaagtatattcataatgttgtataatcatcaccaccatccatctctaaaactcttttcttcttcttgaactgaaactctatacccattaaataataactcttttttccctcccctacaacacctggcagccaccattctactgtccatctttatgaatttcagtaatcttaagtacccatgtaagtggaatcatagtatttgtctttttgtaactagcttatttgacgtagcataatgtcctcaagggtcaaccatcttgcagcatgtcagaattttcttcctttttaaggctggataatactccattatatgggccaggcgtggtggctcttgcctgtaatcccagcacttttggagattgaggtgggtgggtcacctgaagtcaggagttcaaaactagcctggccaacatagtgaaaccccatctctactaaaaaatacaaaaattagccaggagtggtggcacacacctgtaatcccagctactcgggaggctgagacatgagaatcatttggatccgggaggtggaggttgcagtgagccgagattgtgccactgcacgccagcctggtgacagagcaagaccctgtctcaaaaaaaaaaaaaaaaaatccatgatatgtacataccacatgttgttatccattcctctgtcaatggcagccaggcttctgccacgttttggctattttgagtaatgctgtcattagcatggctgtacagatatctcttcaagaccctgtttttagttctttcgggtatatactcagaagtggaattgctggatcatatagtaattctatttttaattttttgagggaccaccataccgttttccacggtggctgcaccattttacattcccaccagtggtgcacaaaaattctgacttctccacatgctcaccaacaaattattttctgtttttttggtagtagccatcctaatgaatatgaagtgacatctcattctagttttgatttgtattttcgtaatgattagtggtgataagtatcttttcatatgcttatcaaccatttgttacatatccttttttttttttttttttttgagacagtcttgctctgtcacccaggctggagtgcagtggcacaatctcggctcactgcaacctctgcctcccaggtttaagtgattctcctgcctcagcctccccagtagctgggattgtaggcacccatcaccatgcccggctaatttttttgtatttttagtggagacagggtttcaccatgttggccaggctggtttcaaactcctgacctcaagcgatccacctacctcagcctcccagtgtgctaggattatgggcatgagccactgcacttggccaccatttattttatatatatatatatatatatatatatttttttttttttttgagactgagtcttgctctgttgccaggctggagtgcagtggcgcaattttggcttactgcaacctccgcctcctgggttcaagtgattctcctgcctcagcttcctgagtagctaggactgcaggcttgcgccaccatgcccgactaatttttgtatttttagtagagacgaggtttcactttgttggccaggatggtctcaatctcctgacctcgtgatccacccaccttggcctcccaaagtgctgggattacaggcatgagccactgcacctggcctgttatatattcttaacaataattatttgttccaagtatctcctttaaagacaaaagccaatttggttagccctgtctttttattactattgtgacttttaaatataaaataatcattttcaaaagtaactccaagatttttttaacaacaagtaatttggccatgaggaagtgacaactaaaaacttaattttatttattccaagggtctggaggataaaaaaaaaatgaaattatgggatatgtaaggaagatatacacgttatatatcttgggagagtcactgttttatggttcaggcatcttaaagcttctgctgtgaggcttggagtatataactggaaaaattaaagacaaaagccagcctataatttttttttttttttaaatgagatggagtcttgctgtgtctcccaggctggagtgcagtggcgtgatctcggctcactgcaacctccgcctcccgggttcaagcaattctcctacctcagcctcccaagtagctgggattacaggcacacaccaccacacccagctaatttttgtatttttagtatagatggggtttcaccacgttggccaggttggtctggaactccatacctcaggtgatccacccgcctcagcctcccaaagtgctgggattataggcttgagtcactgcgcccggccatgaaaatttcttagaacagccatttagccagtttggattagtttcatcattactttttacactgctactgaatttgccatatctaggccaaagaatgagaaccttcctctgtattcaggaatcaaaggaccagtatatgcaaagagactacgtaaaaagtggtctgaaaaattattttgtggcaaagtaatagagatatgagatcactggatactgtttcaaagacagtattacaaaaacagctttatgtgaggtgcatgttctaaagaactattaaaactattccatacatcaggtaatcaaaagttgaattttgagggatgtgatgatctttaaaaaattgaaattctcaagatacatgatctttacatgtacatgatctttacatgtagtaggttatgttttcctatttattctgttaacctcatgaaaatccagttcaattgtaaatactaaagttattgactacttttggcagctgttttgatgggaggtataacctttgagattaaaagttgacaatgaagaagggtgcaatttaagctccaatatgtagtgaacacaaatagaattattatctgaaataattgcttttatatccttcttattacagctcctcatttctatctcatcctaaatcttatatttacacatataaacttaacattggtgccatttaactatgtcccctaccacaaagttgatgtgaacatgatcttctcattaccatttcgtattctcatgttaatccatagcacctgcagtcagtgttaaggtagcatatttgtctattgcgctgtttctaagtccataatctcttttttcctttgttcttaacagaacagcctcaaactgcatactgttgataaaaataagcacattggaacatattctttctctcaggaattatgagggtttgagtctggtggaatctcagcctagaatccattgtttttattccattaagtcacccaaagcagctttttttttcctattgggaaaaaagttaaatgagaaattatacaagttgttttgctttccaggctttttatattaatatgggatagtgatcaatacctttagcatgtacgaattataactcgtcttttatactgttagtttttaacactaaggctcaaaatgctttagactcctttttcttaataggcctttggcacaaaccaagaagattatgcaagttacattatgaacggtatcatcaaatggggtgacccagttactcgagttctagatgatggggagctgctggtgcagcagactaagaacagtgaccgcacaccattggtcagcgtgcttctggaaggtgagaatgaatgaggagatggcattaaaagttaaaggaaaaaaagcagcattttttaaaagcccgtaagcacattctagaaaagtgaattctttttcgtttttaaccttgttcttgatctgaaaatagtaatccaatctatgtaccaatattgtgtacaaattaaaattttcttggggtagaatgttagtgaggaaagatagcaactagttttcttgtaggattatatctgtatttctgtggcacttaatacactgaatgatgccacttagcctcaattcaattaaataaatacttactgagtacttgtattttagtcattgaactagttgctggggatacaaagacattcaagtgttcattcagtctggtcatgaacaaagacagtgtaaagaaattcctgactacggtgtatgtgtgtaaaggtgtgtgtgaatacaagtcatttagcataggggtggtcagggaaaactagagatgctatttaatctaggccttgaaagaccagttaggattttattgagtagacagacaaaaggggaaggacattccattcacaaataattaatttacagttataattagtatgacggcagaaaagttcagtgaggccccatgacaagggaacctaactacctctaaaggtctgggggatgagagctccctgggagaaacatattaagccatgacttgaccaatgaggagactctggccagccaaagtcactggggaggatgtttgaggcagagcatgtgaaaaagtcctgggcaggaaggagcttgaaagagaaagggagattatcctgacatgagactgtagaagcagatagaagccagttcatataaaaccctgtaggccatattaaagatttaaactatcttaggggcaatgggaagccatttgtaggattttaagcagtgaagccacatcatcatcactgctttatgatggagaatggattggaggggcaaaaagatacagaagagactaatggttagaagcagttggattagtcttaatgagagtcgattgtggtttgaagtatgtggagtagtgtagatggagataagtagactaattagaaatatttagaagatagaataaaaatgacctcattattattgtcaatcataattatgctagcagtttttgagcccttgctatttgccagtcactctactagcactgtgcacatattatctatttaaaccccacttcagtcctccaagggtagatgctgctgttgtctctattttgtaggtggggaagctgaagcctagaaatatttgttagattggatgtgggcagaggtatcaaacatgaccccctgggttctggcatacatagcccgataaatggtgctgtttactaagattgggaacactaatggaaagcagatttctggaagaaagatgatgagttcagttttgaacatgttaaattcaagggtcatataggagaagtaaatcggaaatgttgagcagcctgttggatatgtgggtctggctagcagtagactcatgagttgccagtatatagactgtggttgaagccatgggagtgaacgaaatcacttacagtgagggtgtgggttgagacgaaaaggaggcctagaacttgtctctgaagcatgttaacacgtaaggactaaacagagcagaaaaattgacaaaagagactgagcaagagtaaccagagaggaaaggggaaagagagaatgtgtgttacagaagccaagaaaagaaacatattttaagaaagaggggaattatgaattgtatcaaatgctcctaagaggctgaaaaagataccaaaatgtttgttgggtttgatgacatggagatcatttgtgaccttgatgggagcctgttcagtgtaatggggatgggagccgtaagatttagtgaggatgggtgggaggtgaagaacaaaagcagccagtgtaaataattacataggcaagttccattttgaagggagaagaaggtgcagttttgaggggtatgatgttcagaaagagttttttgttgttatgtattaaactgtcagatagactagaacatgctaaaacacttttggaaaggcttcagggaagaggaagaagtcgaacatatgggagaaaggaacaatcagtaatgtcatgttcctgagaagatggaaaggaagatttgattggtttatggttgaacgagggacacagcttccaaaacagggaagggaaggcagggatgtctaaatgtaggtaagttcgtagatttgcttgcctttatgagaaggcctgagtctttagaattctaactttttacatcacatttgcttctaataaggcagttttcccctgcccccaatatcagctcttaagattgtctttttttgttagacaaatgatttgatagaactaacaacataagtactaatatgcatttgaatgcgttcttttaagaagcaaaacccttacactctgtatattttgccaaaagtttgaaagattaaggatatgtgagaatgtcaggaggcatgtatttcaccatacttttgagaaatgctaattagttcattaagtttagttgctaataaataagagaaaacatgtctgctgtgaaattgtgtcaggaaatgttaatgagcaactagtcgagacctcagtatgttctggataaaagtttaaacttgttttatttccctttgcttaggttggcttttttcccctgacttgctcatatctttatgcaggccctcctcacagtgggaagactgctttagctgcaaaaattgcagaggaatccaacttcccgttcatcaagatctgttctcctgataaaatgattggcttttctgaaacagccaaatgtcaggccatgaagaaggtatcaagattttactttcattttaatttcctatctcttaaatgtgtgtgtgtgtgcacatatatatgcctttgtacatgtatacatataaacccatagcaactatgttcttctcaagtggaaccaaattatcagcagaatatgggggaagcagtgactgttttagattttctaactttgtaatgtattttattgagtacctttaccttctaaattatgctttgtttaatacatattaagtttcattgcctagttttgtatcaatttgattaaaagagttatagttgaaagtgtttgaataaagtggacaaattcatttaggattttttaaagttctttcattattgtacaaagttgaactctttggggtcaattaagttgaggaagacagagatgtatcaatgggaaaatagtcccaggaatccctacaaaaggatagttttatattaggtaataatcagaatctgcttggtaacttaatgcagttctcatacatcttcctttctccaagtgccactcgtcaccttcttaattaacatggccactttctaccatcagtgaagttagaacagcatagaatagaatcctagagctgaaaagactgtaagaccatttggtccatctctcttacattcaagcaagtgccatgcaacaacaacaacaaaaatcaatgatgaagactctaaatggctgttccatcttacttgttagatcatgtttccattgctattctaattttgcatactgccagtcaagaaattattttttgtatccagctgaagtatttcttttatttaaattctttttttcatgcttgatcttttatagatatgaactgaccgtaagtccaagagatgtgggaaaatcagaatgaggtgaaagaatcttgagaattgaagtgctccctagtaaagacagctcagggttttcttttacattgctcttaggcattcgctttataaagatgtattgtagaattcttcggtgtttctttgggaaagagactgaagaagagaaatagatttaaaagatgactcccaaaaaatgtaagcttgagaagctagtctcttgtttgtgcaggtggcagaaaattgcacagggtacttcagatggatggaggaagccgaacttgtagcaggattccaggcatacacattgaagagtccagagaaatacataaaaatgtttgaaattgagtgtgaaaaggaaatattgccagatgcaaaaagaacttataatatcatagtttattctgtctctgaggtgaaaccaatagtatctgtccttcccaggaaaatctgaatagaataactgggaccagtgatttccctagagtaggtagggctgtttttctttgtttttcgttttccctctgatgggaacccttaacccacttcttctggtaaaaatttaaataacagcccttgaaatctgtagctgttgaatgtcccatttatttattgaatagctaattctatttgcattctcctaaatcatctattcctgtgctttttcaaaagtagtagtcatctttgcagatggtaaattactccattgctttccaccagctgccagcttctacctcagatgtactctgagatgtgggtggatggtcctagtttttctataaagtttttaaaaagtacttcaggcttctgcagatcaaagctactttgtaagtgtgagatattatcatttttattattttaatctcttgcaaattgacttgaagggggaaggtaatatgtgctgattttagaggcttaaatggttaaattaatggtttaataacttattatttaatcttcaaattgttgaagcctttcaaggtagagtttcagatgagtagaaagctagggagtataaaaataagtgtccatacaagcttattcaaaattgttttaattcatgattcactgtccggatcatccgtgcactcttaaaattataaaaattatttctgcttcagcagtataacaaatttatattagaatttttggttttccttgggggaaaaatattattctttgtcattaaagttcagaaaagagaaaggaatgaagcataggtttcttagaaatatattagaaatattacaaaatatttccctgcaaatagttttcacattgttacctaatgataggttgacaaaagcctgaggggtcaaaccagtctaaagatgctaagtcttccaggttgtttttgaaaatgaaatgtaaatgtcattctttagtataagttctagtctacctcccactactgttcttgcccctccttttttttttttttgagatggagtcttgctctgtcgcccaggctggagtacagtggcgtgatctcagctcactgcaagctccacctcccgggttcatgccattctcctgcctcagcctcccaagtagctgggactacaggcacccgccaccatgcctggctaatttttttgtatttttagtagagatggggtttcaccgtgttagccaggatggtcttgatctcctgacctcatgatccgcacgcctcagcctcccgaagtgctggaattacaggcatgagccaccgcgcccggcctgcacctccatttttagtgtgaggatggaaagaagatgttttaattttttttcagagcacaaataatttatagagttttataattctggagaaaacctttcttttgttgttgtaagtgcaaaaattaaggtagctttttctaattacagaaataatttagaaaatacaagaaagaacagaagaaaataacaataaattcatatttgtccttcaattctcttttctactcagacacatgtgtacacatgaacacatataccccctcccttatatattggggattacattgaaacatactgatgtaaacttgcttttttcacttaaaatattatgaacttttttcagtgtaactaaagctaatctgaacattattttaaattaatagctgtctaatatctgaacaatccctttttgttggacaattaggttgtttccaggtttttttcacaattataaataatatatatcaaagagttatctatactcccaagttcattgcagcagtattcacagtagtggaatggaatcaacctgaatgtccctcagtggatgaatggataaagaaaatgtgacacatatacactgtggactgtaacacagccatttaaaaagaatgaaatccttgtcatttgcaacaacatggatgaaggacctggaagacctcatgttaagtgaaagaagccaggcacagaaagtcaaatatcacatgtcctcattcatatatgggaactaaacaattgaactcagggaggtagagttagaatgatggttatcagaggctgggaagggtagtggtaacaaaaataccattaaatagaagtaataagatctagtgttggacagcacaataaattaactatacttaaaaatcatgggccaggcacagtggttcacgcctgtaatcccagcactttgggaggctgaggtggggggatcatgaggtcaggagttcgagaccagcctgactaacatggtgaaaccccgtctctactaaaaatacaaaaattagccaggcatgatggcatgtgccctgtaatgccagctactcaggaggctgaggcaggagaatcgcttgaacccgggaggcagaggttgcagtgagctgagagcacaccactgcactccagcctgggcgacagagcaagactccatctaaaaaataaaataaaataatgtgtcgttcggggagtgggcctggtggcagtggcggtggcagggaaagagttggagcagtgccagcggcaagcgaacaaggtgacggaaatcacgcttaacaactttgacaaggtcctggagcatgatggaaagctgaccgaactggagcagcgttcagaccaactcctggatatgagctcagccttcagcaagacaacaaagaccctggcccagaagaagtgctgggagaacatccattgccagatctacttggggctagtggtgggtggtagcctgctcatcatcctgattgagcagctggccatctttctccctcagagtgacaccagtaatgccccacagacctaggatgcaggcaccacctcagggcctggggactgacagctggtcctgagggagaagccaaatggctgcactggctggttccggtctccagagaaccttggtgtttgctctcccctgacccaccccagtgagtgccaaagggcagccccaacacgtgcacccctgcatttcttgtcatgccacagactggccctcgagggcaccctgccatactggccatgccgggccagccccacctgaagctcagtgaaagctgattaaaaaaaaaaaattatgtatagatcaaaataactacaagagtggaaattgaatattcctaacaaaaagaaatgatacatgcttaatgagtttcacaactacccttatttgatcgttacatgttttatacttgtatcaaaatggtgcatgtactccataaatatgtataactattatgtagccataactaaaaatttaaaatttatataaaaacagtattccataggactaccaaactagggaaattactgcccccattttctcattagatttttcttcactagagtagtataacatgaccgagaatttgggcttgctcagctctccacactgaccggccgaatgaccttggatatgtcatttaacctataagccactgttttctcatctgtcaaatgaagataatattaatagctgcattatagggttatgagaattagatggtaatttctgtaaagtgtcacagtgcctgggatataatatgaaatcaatgaagtgtagtggttatttttacttattattatacatacattttttattatttccttatgacaaattctcagaagtgggattgctaaggtaaaaatattagtattgtaaagatttttgatacatagtgctatcaaaactcttaggtaaaaaatgctcttggttttataaagcctacgccttcagaatgttgtactaatttacacttgtagcttcaccatataagagtatgagtttcttgggattctcacccgtacttgatattattaaaatattttttgccagttggataagcagaaggttggcatttagttatttctttagctacatttcaatgactaaatgctcaaatttaagatttttcaaaatgttttgcaatgacaatagtctgtgaaactgaaaaatatgtaacacattaatttttgttaaagatgtgtggtctgaattagttaattcatagagcatctttacctaccactttattacttaaaccaacaggtaagagttttagtagagagggctgttaggcttgctttaatgagtacatgagattttattataattatactattgcctctttttcacaaatggatggtgctaaaatacgtgaaagtagtttattctcaattaatttaaaattcaccttgtacttctcttaatttgcttattagtgaatcctttctccatggataaactcctcaaaactgctgaagtatgtatgaggtattgtcctcacgttctggggggtataccatatgttccattaagatgtttgaagtattcacagaccttccccttctcccctattttacgtttgcttcccaaacttcattctatttttaaattttaattcctttatccatttttgcatcaatacttgtttaaaaatctattttactagttctattcgtgccattaaatgaacaaaagaagaaagcagaatttgattttaactaattacctaatcttgatgctttctgagtatacaatcagtagagatgaagtagaacaatcagatagaactaaattgtttgaacaaaattaagtaaaactaccagtgatttataaaactgtacccattaataacatgatatagtcttattttcaaaggattgaaaattaatggaagaaattttcctttccactagctttgcacgaaagaaataatcttctttgaatatcctcctgtaaatcccactgcaaattgtagtctgcacagaacagaatcgtgatgcctaatcctcctcttttcatggtttagtctatacaaagagcagagctggaaattggatcttttgacagcagttactaagcaacagaatttggatgtttttggttaacatcctaatatataatgtagctgatttgttgaagtttttgcatatattagctgagagaagtgggcactccggaagtgactacaggtccctgtatggctggggaggtgggcatttgttgttgttttgttcaatacactgtgtcttttggcatttgtatctctttggcgtagaaaggaggctggtgcagaactttcagaccttgtgactttttatattattaagaatacccttctctgtggctcacgatatgagaaaatgtaagattttttcctgaaaagcagggagaacaaataaaggattttaaggtcattccaggaagctttagagctttgccaaaagtttaggtccacttcctgaggcagtttcattagcagacagctaatgtttgcttggtctactcccaagttatttttagaaacgagattattactgatagcacccatttgaatttgctcatttacgtttttatatgctaccaaatatgattagagtatgcttttaactaatcgctgacagatttactgcattagggattttctaagctatgagattcctacagtcatcagatttctactaactaggtacttcacgccaagtacttcagaactgagatgaactctttcagctcccagaagaaccagagtgtttggctttgcttacctaagggcactaaggaggtcccagaggatggagggctgaatctcctgagagcatgcttgttgtggcttgtgatcccgaaaggctgggattaatggaactaatgctggtgtgctcccatttgcacttgtgtagactctggagcccgtagctgctgcccctgtcccacacacaggtggctccccagttgtctgaagatcccaggagtgggctctgggacttaagagcttgccgtgtccttgagcaccacattcagacctgcccctaatccctgcgtggcagagccccgcttctcctgtccctcagtgctcacggagtgcatgtggcacactcttgccttaagcccaggctccccacactctgggttgtctctcatacccctccagcctgtgtcgtacctccacctttgcatgcaagagaggttacagtttaatatgacaatctcattatgtgcacaggtggacataacgggcttctgtgttttctagagctgctcttccttcctttagagtagacttcccgttatttcatgagacacaggctgactgatgccactctttcccacattgtttccttcttcagttcttcctgttttttctttagccttctctttcagacttccctcctaactttaagaccctatatatgtatgttgataattttacctgttctacaggaaacttcataatagaactgggctgactatacattctttttctgtgtgtgtgtgaatatatactttttatttagccatttttgtttacaattgaaactctgggaattcaaaattaacatccttgcccgtgagcttcttatagacaccagaaaaagtttcaaccttgtgttccacattgttctgctgtgctttgtccaaatgaacctttatgagccggctgctatctagtttgacggggattctcttgcccacaatttcgcttgggaagaccaagtcctcaaggaaggcatcgtgcacagctgtcagagtacggctcctgggacacttttgcttattttttgtacggcttttttgagttggcttaggcagaattctcctctgagcgataaagacgacatgcttcccactgaactttttctccaattcgcgtactagccggacttggattttctggaaagatttcagttgaggaacgggaacaaagattatgatagctttccgaccaccaccaacttcagtttccttggctgccgtaatattcagctccctgagctgagccttgaggtccgagttcatctccagctccagaagagcctgggagatggccggactcgaactcgtccggcttctcgccattgggcttcacgatcttggcgctcgaactgaacatggctttctcctgggagaacttgcagcgcctgcttaggaagagacccaaatctcgcgagagcacgtcaaaatccctacattcttaagattaattttggggggagtctgtaagatacggttcttaccttcttacctccagcctcagtcctcctggcatcttctgtgttggggcatctttggatctagagcaagcactgtgtgacctgctgtgtgctataactcacggtgagtttggcacttcagttgtactagtctggctagggcagtttgtacaattttacttttctcgcatctttctttccagtacctctcctcctgctgggatttatctacctaaagttgtggtgcagcttcccggcttagtatgtaaatatctcacttggattttcctgtggcagctaacctcacgtacttgccagccaactctgagtatcttcttagtgagaattctgctggggcctgggccagaaagggtgaaagggactaagggactgaggagactaggcagaaatcgtggatcctgggaagagttatgagcacaggttacactagtgactagataaggaagaaaatgtacatgtgagaagagaaagggatgtgtgtgtatgtatgtatttaaattagagcagagtagctacccggaggagtttcagttgactggttacctgaaactagtcaagttacaactggaattgcacagccttcgtcatggtcggtgtgttaatagagcttgctgtgagtgcacctctccctctgatagtaattagcacagagaccgactgcaaaaaacaagaacgtcactacttgatattaagtgactgctgcaggtatttttcctctcaaatgttatgtgtaggccatgcagtcaactgtgaagtgatttggaatgctttgtgaattacagtgtctgagataagttggtgagactacataccatgtagcaagtcatcattagtttagacctaagcaatgtcctgagtaaggtccttgcagccatataagctgtacattgttttgagaaggaaaaacatagaactactgcaaccagccaggctgtggtgttccaggtccctgtggctctaatccatgatctcacagcctgatggtcagagttatatgctggcatcagagcttttagtagaattctgaaaaatgttttgaaaagcaaagcattattttcagtgattccttaaaattacctgagtttataagataccacattggctgcggttccatcttcaaaaaaagtagcaaagaaccgctgtagaactgcttctgagcttttcagttgtctcgaatgtaccaactcaaagccaaaaggaaccatcattgtgtatcaagagactgaaataaatatcctattctcattttctctttttctgtgtttggggaggagaagataaaaggcccttcccttcttgctctttaaatgtactcatgatccattttcaaaccagcttcacctctgtgttttatttcagttgccaaatcaggacagatccttgactccagttttctctttcatcaccacacccattcattcaccaagttctttcagttcctcctcctaaacatctctagattctgtccacttaccagcacacccactccctggccaccatcatttctcacctagaactccacaatctcaattaactattattcccctctaatgcttttctatacaatcaggaaaatgtttctaaaacataagcctgacatgtcagtccattgcttataaccctttagtggcttgttattgcctttacagtaaaattttaactcatgaaatttgtaagactctttacgtccaagttccttcatcacctcttctaattcatctcacctaccactccactgcattgacaccaacaccactttattttaattcttattgaccgttcctgcagtgttcctgaatgttcacatctctgtgtctcctaattttcagtatattctgcttagaacactttcttccaccctttccactggttaactgttgttcatgcttcaagtctcaggttaagtgtcacttcctaaatttaggaaactgtcctgactccctaagtccatttaagagtcaagataggctgagttatgctgcatgaaaggacaacccgaaaatctcagtggcttaacacaacaaagtttattttttatttacactactatatctccgtcatggctcagacagtgagttctgttcattatattttctcagagactcaagctaatagataatagaggccccgccttacatctgattccatgatagccaaggcagggaaaggagtatggtgaatcatgcagtgactcctaaggcttctttcagaaaggggtgtatttcccctcatatttcattaaccaaagcaagccccatagttatgcctaacttccaaggcactggggaaatactgcctaccctgtgcccccgtatcatcttgtatttcccctagcctaataatgtcatgctttgttataattacatgtgacttgcttccccaactctaacttttgtgaaagtaggattatttttgtcttatttattatcctctgcagtgccttcattaatgcttgatacataataagaattcaaaaatatttgttgagtgagtgaatgaataaggcagcactccaagactcaatccttaggcctttttttcttcttcttctgccatttcttcttgaagatggcttcctctgtcatggtttcagcagtcactgccctgagagtgatttccattccctgacttcaatcagatatctccaacttctcacttaatatttctacttgaatttaaaatgtgtaaatttattcttttagtaaatacttcttaattactctctaataaggcattatattaaatgatatgaggatacagaggtaattaagacagcacttgccatctgagggcttgcaatctagtataatacaaaaatagtacaatgaatcaataatatatatacgtaatatacaaaatcctgtgccaaaggagaagacaagtgatttatggcaagatggaattggaacttgtgttgtttcaaccattgaacctacagagcagacatcattactgaattctgttctgtgctgggcactacacataacatgaacagaataaagcttttatccacctcacagtccagtggggagacagatagcttaggacgaaaggatagatggggtttagacagagtgtgggagggtaattagggggtaaagggatggtgcataggaaaacgttttcaccagaggggttgacctgattaaatatctggagaaattgtcagtatttatgccaggaaagaggtaaggaaggaactgaatcaagatggtcacagtgagactctattatggtaacttaattgttaggaatactttaaaaaccaagtatacacaggttgtttttaaacctaacatgaaaaatggttaatatcatgagtttgactttatttctgtacctaattataagtcttcaatggttaaaagatacccaggaaggaatatatgccattccaagcaagatgttggtgcgggtggggatcgggtttactatcttggtgtactgaggttggttaccaaccagagagagtgggctgggatgcagaaactaattcttactcatgacactgatgagatttcctgagccccacctgtagtctctggaatagtaccttcatttccaaaaaggctagtctcaaggccttgagtacttctattcaacttgcagataagctaattcttctatctgatttgaaattactacatccttgccaggctaaaaccgttccttcactgcttaatttcattctcattttcttgaccatcttaagacagtgcattcatatcttttgtctggttttatacgtacatctatctgatccttcatactcaacctttaattcttttgtaagctcttttaccattatggtctgatttgagttgacagaattctgatctttcagtgttacttttgcttaacagagccacaattcttatagataataaaatggcatctagttttattttacacatctcttgtggctccatctagctcttgagtcattacactaaagtcctgctcctgacacagataccagagaccagtgtgatagaagtgatgggatgtgtcagttgattaatgatcagctagtccccagcctgcccaggtgtgacacacacagctgttagtgctgaaaacagccttagcctgctctctgttcagcggtgatccagtgtgtcaattctaatttattgtagtccaaagtgttggtgttttcctgtgctttgtttagtattgctcaagaagtaactaaacttcttggaaattgtcgtaactgtggaggacagtgagataataaatgactttgttttctttcagatctttgatgatgcgtacaaatcccagctcagttgtgtggttgtggatgacattgagagattgcttggtgagtcctaacttctgctgttgtattatctttgccacattacagctaatatctcaaaagttacaagagaaaattaacaagtatttataaactgtaaagcaatagaaatacctttctttgtcttacaaggaaatataatgttctctcttaaatagctgacatcaatgatagtattcattttaatatgccctgtgactataacaccattataaactgctttcttgtaagggcccatgtctcattttgtatcttccagtgtgcccttgccatagtaaatgattagtaattttcattgatgagtatatctgttatttaggacctctgagctcagaaattcacttgtgaactttgacagaactaatgaaagaagggtttaggatcacagagaaatctgcaaattcactaaaacactaagggcagaagttgtaagctctctgcacctcagtttctgctcttacaaaacagagactataatccctctcttgcttatcccacagagtaattgtgaagacaaaaatgggataataaatcttgaaaaaattttgtaagttaaaagtgcagtatagtaatttttaaaatatgtattaaatatctcctgtgttgaagtgcactcctacagaatacaaacatgaagaagacttggtcctggcacttaactcataagaaataaactgcaaggaagggccagaaagttgttaattttatttcactgtaaaattaaatcagtctgacataaattcattacaacaatggctcaggaaggggtaatacactctattgaaatggaaacccacctggtgacttaataacatctgaaaatactacccagtgtctgaataatcccttcttctttaagctgtccataatggtgtagtcgtgatttcaagctaactgttcttactgcatttttcccatgattttcagacctgcttttggtcctctgttatttatttttttaagttttggcagtgtctgttataaagcaaagcaggtatatctgtgaggtctccataaattgatagtgggttttgggtctgctaggtttgatacatctcagcccagtttatgggatgatttctttaaaagcttttaggcacaaactcatagctctgtgtaaattcctttatcttaacacaattgaggtgtgtggtcatagcaacactaccatgtcaggaatgtgtgccctctgagtacatttcactggtatgaatagttatcatctgtgcatgcttgctcatttattcaataagcacttgctgagcccttcctcctctggtagaagtattagagtctcagaaaaagacgctgctgcctgtctttataacatatgttggcaaatgttaatgcaaagtagaatgtgccatgtattttggatattctgtttttttttttatttttattttccctcccactgttctcatcaggtggatagtctgaaaatggagggatcagttttgacctcagggggcctgcgagtagctctaagcccagggcagaggtgcatatgcagtatgcagagaaagctaagcaggtggcatttacgctgaatcttgaattattggtaaatgtttaacaggtcagatgttctcttagaaagttatctgttccttaccatctgagggccaatcttagtggttctgccattgtttccgttttattgaaattccttattttcccctttgcccattttctaacatcatgttttaatatcagtgtactgaatggccatggtttgcagtaacttcttagaaatgcttggtaaatacacctggaatttttttttccttccaaaataatcccagaaaaaacatctacatgaactcaaagtgaatatttagaagctttttcaaaaaatttatagagccgagtacagtgggattatggcaacctataatcccagctacctgggaggcttaggcaggagggttgcttgagcccaggagttcaagacaagcctgggcaacatagcaagaccctgtctcaaaaaaaaagttacagataagagttcttatattttaagcatttaggttattagagatattttttcttattataaatagttttatgactgttatttaagactgtttactctttaaattttttttttcttattctatacatattctgcttatgtagggactgtgtttacttttgatgcaaaaaaaaaaaacaaaaactgaatgtttggaatatgtacatgtgtatcaaatccctaaacataataatgtttcttttccagattacgtccctattggccctcgattttcaaatcttgtattacaggctcttctcgttttactgaaaaaggcacctcctcaggtaaaataatactactaataaggaatattttaacaaagagtttttcagtaaatcgcatataatgatacaatctttaaataagcaggttatcataaacataaaattctgttgttgaaaggattttgaaaggtcgtccagtcttgacttctgtttaaggtaaattattttatcaacagaatttttccattccttttctgaagaaatcaaaatcccacagtttctgtgtggaatacaacaattagcattgtattttgttgttttgtaagttttccaccatattacatatccctactacctccaactgccaagggagattatgatattaatagagaaggcattgaatatgttcccatatgtttcatttataatttcatgggttttcctaaaaatttgtttatggggatatttaagtttattttctttgggcagttaaaaaactatttttaacagatgatcttgagttatttttcttgggtcatgtggcacttttgaggagtgaatttatagccaggatcttgattcctgtgtttgcatttttactgatgtggctattagagacttgtgattttggtaggttaacaaatttaaaaccaacctatgaaggttggttaaatatgttaattatgtagaggctgccagagcatgtttggctgtgtcacaagacatgagttctcttgattgattctgcatgctgtaaccttgaaaaatgccaatcaaaggcaggtacaaagcagttaagcactgacttgaaaagcatcttaatgtctgtatgagaatctcatatttaaagttagagatagaaactaatctgtaaggaaaatatttactcttaaactggtgaatctaatttttaatttaacagttatatatgtgcgtgtattttgcacttaaaagtaaatgacttgtcttggtttttctggagtttttttttaacttctaaaataatgaaaagaaacataacctataatagtcttgaagatttgcaacatatgtgtactgtggaaggatttttaaatcagcttttcataaaccatcattcctagtaattggagtcttagcttatactaagggtgaagttagagaggtgagtgtattttccctttctctgattcctgcaatattttcttaagtaagtaaacgtatatatctaaagttgctgaaacagaaataattatctacatatatcatgattcctccaatgttttcataaataagtaaacgtatatatctaaagttgctgaaacagaaataattacccccaacatctacatatattatgcacacaaaaaaactttatgtcagcatattaattataaaaactattagaatgtgagactttttctaggcatttaaatttatctcttaaaatagttcttcttttttagctgaaaataatttatgctaaaagtcacttgggagaaggaagattaacttcagtgctatcttatacttcttgttctttacattgttaaatactatacacattgatttaaacagaggtacacccccttggctgagaagcatttgtgatccaaagtagatactaacagaaataaacagaaactattaacgaatgatctgccacactaagatttaagaataattgtttctgtgttgtaaaacttattgtaagatttttgagggaaggaacattatcttatgcttttaaatctcacagccaatggcatagaggcttatacgtacatgcttcacaaataccttatcaacaaaaaaaaatttttcagtgtcttttcattttagtgggctcaagtgttttcatattgctggagtttatatttagacaggatatgataagagtgaaaacattcaaaaataagtaaagttcaaatggccaacaagtataagaagaggtactcaacatcattagtcatcagagaaatgcaagtcagaaccaatagtgagataccactcattgcatacctgctagaatggctatcatcaaaaagtcaggtaatgacaagcgctggtgcagatgtggagaaattggaacctgtatgcactgctggtaagaatgttcctcaaagaggttaagcatagagttaccatataacccagctattccaccaagtatacacctacaagcaatgaaaaacatatgtccacatgaaagcttgtatgtgagtattcatagcagcattattcataactaaacatttatctgataaaatctagtatatccatataatggaatattactcagcaataaaaaaaagtagtaccattacatactacaacatgaatgaactttgaaaacatgctaagcaaaaggagccagtcaaaaagaccacatattggatgattccagttacatgaaatgtccaggactggcagatctataaagacagaaaatatatttgggatggcctagggctgggaggggagaatgagaagagtgagagggtcactgctaatgggtatggggtttctttttggggtgatagaaatgctctaaaattgattttggtggtgttgtgtatatctgtgaatatactaaaatactgaattgtacactttaaatgggtaaactgtgtgctctgtgaaccatatctcaagcgattacattttttagaagtggtttaggagctacttaaatgatgaaaggagacatagagttagaagtgaggggtgagcatccaaggtacgtggcccagcttgggagaaagaggaattggatcatttaaaaagaacatggagtgaatttatctaaggactgaagaggaagaatatagaaatatgtaagaagtaagagatgtggttgccttagtgattggaaatggcaggggttctctctgaagggaataccatctggtcattaatctgaatttggtgactctgacctggactgccagattacctgcagtatacatgaatcagtgacaggataaattaatatttgtagtatttctagttggcatgtatttaacaaaataaaaatgtgctttgtcataccaccttgctttttaaaatgtttatattctctcaagaaaataaggggaaattttcaggctgatccaagtgttaagaatattagtcattgtaaaatggaagcattcactttgtcaaaccattagcatatagttttttcagatgtttttaattaaatattaaaggtatattcagctaaatattgtagaaatgcatagagtgatagaaaaatatttattactggtaagaaaacaaaagttgtgagcatttttctttaaaaggaggaactatacttatatacactacagtaatcatatcagtcacagaatcctcaattttgcatttgttgtatttccagctttcacacagaaaaattgtgtgtgcatgtgtgcacgtgctcaaataaaagaatcccttcaggggcactatgttgttatgtatccagatattctcttttctccttccacccctcccccaccaccccctcccttcttgtaaattggcttattaaaactggttcccaagccctccttttttccctttgtgattgccttggtcttggattttcagtgtagaactaaaaattcaagtcagatttcagttactaggataattttctttgaattttaaatttttctaagtaaatgcatagatttttaatgaacctggtattcagtggatttgctttaaatttagctgcagagttaatttcatgattgatttattagccctttgaaagtataaaaagtggtatctgcagttcgtgaagagtgaaaaacatcatcacattttgtttagcatctttttaaaaccaattaaaagcttttctaaaatggattgaacaggagaaaataaaacatgttccctaggtctttatttcaatcaagtttccctgtgttctgcaggagaagagatcgagaggggatagaaaaattgaaaagggctgtcccagcagggagccaagccggaaaaaagggcttctctgagaactcagcagcagcagctaagaaagctcccagcctgcttcatctacatgcagagtcacacaaggcatgggggtgctcactgtcacacagaggtttcacatgtgcttccctgctgattcctgtgaaaagctaacaattggcttggagggtaaaagaccactgcagttcaccctccctgagctggacgtacaatttgtccagtgttaggaaatgtccggcttagcagtgagaggcttgaagacacccctccttccagtgagattcctaacgccgtctcttttacttgatgacactggggctcttttcaagttttgcagatttatggaagttgaggggaatgtgcttttcaagatcaggaggatgaaagccttggtcttaatgtcaaggaggaagcggtagtgagtggtaaggccaggtaactcttcctgcagcctgcaggaccagtggcttgatttttcctcatagatctcttctgccaccttcttttttttttctttttgggagacagagtgtctgaaaaggaactccttgggctgtaaaatgacatgattccccagtttcctcaacaagtgtgagagtagttaagcctattaacctcactgtttaatgctgggtttgacacttttgtgcatcaaattggaaaacctcatctgtatgtaacagggtagcctcgtaatttatggaggagcaatccttcctcagttcagtgcttcccaacctttttagattatggtgcatacaaaatgataacatctgatgatacacttgggtaagtggatgaggccactcacaactggccagggctctagccttcccaacagctggcaggaattgatatcttagtccaggtataactcatttgaagctcaacgattggaaaactctttggaaactttaaacttttacaaaagaagaattaccactccaacgtcatagcagtattactgaagtagaactcagacctaacagttattagtgttctggctaaattttatgatgttgttgagaatagtaacttcctcgctgctctgacacctaggaatattacctaataagagagaaatacagcttaaagcttggaggacctaaggtgtggaccaataagaaactgtcagcattctcaggatggggacttgggtagacacacttgtttctgcatgagttttgtttttaacatcagcagtctctagacaacattgctttcatgtagtccttacatgacatcttagcagtcttacttcagatatggttataggacatcttggtatcttgataatattaagcaactctttaggctttgggttgctttagtgaaataagcagataatggaagagactccaaatcatgcaggcctaaacatgagtatctctccatctatttgttcaaaattaactctggctaatgactatgatatgactcaataagatatataaccactttaggaaagaggcttagtcattttgccagacacattaattttaatccactgatgtggtgacttttgcattgggcttcatttcttttatctaaaaaaaaaaatgatgcttgacagtttagtggcctgcttagtaagtcagtgacattagatacctactatatttataatattctctttaggtatactttgcttagtatagtagattttcttggaaagtcctttgtagattgaacatgtgtgtgtgtatatatacatatctctgaggacaaaggaaatttccagagatctgtgttcttgttttctggacagaaagataatgtatagtgaatgtatagtgatcaactaagataatgcctagtgaagccctttgtaaacctgtggactacatagatagacagtattaaagaacatatatatatagtacatatatatgtagattaatttcaaatgtatcaaaaacagtgaaataggccagacattgtggctcacgcctgtaatcctagcactttgagaggccaaggcaggaagattgcttaaggccaggagttcgagaccagcctaggcaacatagtaagaccagtctttacaaaaaaaagttagtcgaatgtggtggtgagcatccgtagacccagctattcaggaggctgaggcaggaggatcgcttgagcccatgagttcaagaccgcaggaagctgattcttaccaccgcactctagcctgagtgatagagcaagactctgtctctaaaaacaaaaccaacaaaaaacagtgaagtaaattattttataaaacattgctacagatatctgctgaataaaatcaaattttcaaaatagggttttgttttggttttggtagagcacatctatagtagatattaataccagaataaattataagatatatatgccattttctgataactcaaaattaaatatctaaattttaatcatcagagaaatgctaatagtgttgagacgaaatattttttcattgctagaatgtattcttccagatccattgccttaaataagttactgtggcattacattagcttttgaaaggtggggattataacgtcgtagtagtccatgggtgccatgactctagttaagagcaccctttctgtagaacttactctttgtattgaacttgaggtttaaaaaaaaaaaaaagaaacctatgtcttagctcagatatcatctggcattatagccttgaacgtcccttaatttcttggtgtctatttcttcatctgtaaaatagagataattcctcatgtgttacctactctgttgagggtcagctaagataatgtgtagtgaagccctttgtaaactggtggactacatgagctgtccaggcgcagtggctcatgcctgtaatcccagcactttgggaggctgagacaggtggatcatttgaggtcaggagttcaaaaccagcatggccaacatagtgaaacccgatctctactaaaaatacaaaaattagctcaacgtggtggtgtgcacctgtaatcccagcgactcgggaagctgaggcaggagaattgcttgaacccaggaggcggagtttgcagtgagctgagattgtaccactgcactccatcctgggtggatggagtgagactctgtctcaaaaaaagaattgcctttggatagtccacagaaccttttcagcttgtaagataggaaaactgaagaacgtataataactgctatatagaggaagtttccataggaagtgagttcagagctcccactttggaatgcctgaacccaacttccctcatttgcagtactgggaaaagaaacctgcttccccatctctcattcactgaaatttagaagcttcctacatcctaagacaaatactcttgtctggggattagggattcctgttgtagaaagaagtaggaagtggagacaggaattgccaagatcagtaggccaccaccaggtcacacttgtcttcagcctccagggactggcccacctgcttcctttccctgccaccacctgttgcttgtggctgaagttccccttttctcctaactcatggtgcaacaaagtggtgcttcacagtttctttcctacctttctgtcccagaaacaagaatgcagatctttggagatttcctgtgtccttggggatctcacaatggccagaagccctggccctccctctactccttaccctgttaatcttggatggtaggattataggtgatttcttttttattttgctttattgtttcctgtactttatagattttctacaataagcatatgttactttgataatcaggaaaaaataaaaaatgtgtatacaattatttttaacttagcagtataactgtcaaaaattccttaattccattgctttggtactaatttgctgctaaccactagggttaaatgagactacctttgtatctaagcttgtctatgtataatatatttttaaccttgttctttttatgacttaagatttaattgaatatctgaaatatgctgtgggttttggagtaaaagtgtgcaagtgcctcctaactctcacagttgtcctgggaaacccacctggcacttggctcagtgccatgctccccatctaaacttaccatggttgaatgccagtgtgactaaagttgaccaaggtagatggtaacgattgtcttaagcttcattgaaaggagatcggaagtttctttttcaccaaaaatatttcttttgacatagaagtttaaaacatttctttaaggaacatctgcttttattagatgtacatttaagaaatccttctcagtatagagataaaaagatgaataagacattgtacctgccctcagatggctcatagtccaagaacactgttcaattgtgaagtttgtgcacaaggtgggcacaggtcaagtagcaaatgaaggttaacatccagcccacatgctgcccaccaaggagtccaccctggtttgggactgaatctgccctgagtaaggttaccagatttagcagataggaatataggatacttagttaaatttaaatttcagaaaaacatcacataattttttagcatcagcatatcccatattttggtcagacttatactcaggtatttctctagcaaccctaacgctgaacaagaggaagagggtgccttttagctcatacgaggtgctggggcttggggaaggaagcaagggtggccgcactcacccagatgattgcttttttctaatttgttcacctagggtgtgtgtgcgtgtgtgtgtgtgtgtgtgtgtgtgtgtgttttctgatccatgcagaagctaactggtgtccctgtcacaatccagggtgggagaaagatgtgaaaacatgatgcatagagttaggttttatatgttacgtggttccagtggaacataaaggaaagtgtggtccattttacctgagaagatgtgcaaatcattcacaaatagtagtttcggatcctggtcttgaaagatgagtaaaagggagatttagtcagggccattgtgccatgctaaggaattcaagcgctgcagcaatggagagagaaggtgaaggatttatgtatgctaaaattagcatattattattattattattattattagagataggatcttgctgtgttgcccagggtggagtgcagtgacgcagtctcaatcactgcagcctttacctcctgggctcaattgatcctcccgcctcagcccctggagtagctgggacaacaggtgcacaccaccacacctgactaatctttatattttttgtatagacagggttttgccatgttacccaggctggtctcaaactcctgggctcaagcagtccacccacctcagcttcccagagtgctgggattacaggtgtgagccattacacccagcctaaatttttttaattaacgtacaatatgatacttgagaatttgaggatatgttctgtgtacttatcttaggcttcatatggcatagtttcactggagggaagaatagaaattcataagaaattataggcttcattttttctaagtgactgaagcttaacctctttaaatatcaattattatactttagccttttttaagaggaaaaaaattgctacatacattcttagtgtctgaagcaaagtataataaactctatgttaatgaataaggaccatcataacaaaccataattgatgggtcagtattttcatgggtgggactcagcaggaactgttggaatatacaggattccgtcctggtgcctgttaggtagatacggtgtgccctgtttgttgagttttttgtaccttttctttttttagtggttttgctatcagctgttacttgcagaatccaagtgagttgtgtcagctggcctgcctctgatgactcctttttccagtgtgctgctttcatctgctataaattaaggcaggcaaccaccaggattcatgagctgttcatacagtaagagaactaaactgtggttgggcgcagtggcttacgcctataatcccagcactttgggaggccaaggcaggaggatcacttgagtccaggacttctagaccagcctgggcaatatggcaaaaccccatctctactaaaaatacaaaaaagtccaggcacggtggctcacacccgtaatcccagcactttgggaggccaaggcaggaggatcgcttgagtccaggacttctagaccagcctgggcaatatggcaaaaccccatctctactaaaaatacaaaaaagtccaggcacggtggctcacacccgtaatcccagcactttgggaggccaaggtaggtggatcattcaaggtcaggagttcgagaccagcctggccagtatggtgaaacccccgcctctactaaaaatacaaaaattagccaggcatggtgacaggcgtctgtagtcccagctactcaggaggctgaggcaggagaatcgcttgaacccaggaggtggaggttgcagcgagccgagatcgcgccactgcactccagcctgggcaacagagcgagactctgtctcaaaaaaaaaaaaaaaaaaaaaaagccaagcatggtggtgcacacctgtaattccagctactcgggaggctgaagtgggagaatcacctgagcccaggaggtcgaggctgcagtgagtggagatcatgcaactgcactccagcctgggcaaccagagtgagaccttgtctcgaaaaaaacacaaaaacataaaactgggctgcagtgagagctggagaggccttccagagagcaaggccccattttgactcctgtgggccccttcctctactaaaaaaaaaaataaattttccacctgttggtacaaagctgaatatattactatattaatattttcttccaccaaaaagttctttttttctgatttttttttttccaggagtgcagtggcgcgatctcaactcactgcaacctctgcctcccgggttcaagcaattctcatgcctcagcctcccaagtagctgggactacaggcgcacaccaccacacccagataattttttgtatttttagcagagatgaggtttcaccatattggccagactggtctcaaactcctggcctcaagtgatccgccctcctcagcctcccaaagtgctgggattacaggcctggcctgattttaaaagaaattagaataatactttcatgggttcctcaaagtttcataggccctgggcactgtgtctagtgggtaagttgtccttgcctgtcagttttaaagttacttgaacctcacattgttttttcagtactaggagtgagaggatttttgcttatttctggttcttggctgtgctctggatagttgaaattgtttagcagattggcctccagataagtaaggcattattattggatatagtaaattcatgttctggaagtttggggcctaaaggagcaatgtgggctctgtagggttaaatgagggcagggtatggtgagaaggcaaattttgaaacattgtgaacataagagacaattgcaaattggcagaaaactggagaaagcattttaataaacaaatgctatggataaaaatcacagaggtaaaaattaaattagaaaggagaatattgacctgattagaacacaggggtcaatttagggtatatcaagctaaaagctgagataggtagggaaaatctactgtggatataagagtggggagtttggatttgctgattaatgtgtggtcatcttagttaagtttctaatgagagagcatgcacagaacccttcctttaaggtattaagaatactatggcatggtcagtacaactttatctttttctttttttttttttttggacaccaagttttgctcttgttgcctgggctggagtacaatggcacgatttcggctcactgcaacctccgcctcctgggtaagagtgattctcctacctcagccccacaagtagctgggattacaggcatgcaccaccacgtccagctaatttttgtatttttagtagagatggggttttaccatgttggccaggctggtcttgaaatcctgaccgttggtgatctgcccgtctcaatatcttcttaatttatttaaccttttctcctaagagcacagaggtcattatttctaggtaataaatctccctaactcaaattaagagatcagccattgctgatatggggcttgtgggggcaggggcaagagtggaccccaaatctagtttaaaattacacaaataaaaacagtagacagcaaagcatagtgaaaatagcaatgaggcctgaactgtagtttcagctccctcactggacatgagagcctcagacagatcactttacctctcaccccaggtttctcatctgcaaaatgagacagagaatgagggggtttgggggaatgaggtaatctttaagagctgctcccaatgtaaaatctgatgattcagtgtctttttcacaaattggaattagatatcctttaatatcatgaagtctgcttttgcctatagtattttaaattattaagggttcagtttctcgtttcatattcagtctgtatcatgaattcccccccttattgtcttctgtcctgcttgcagcaccatgaggatggttacaaagaagtagactaagaatttgcttcagggtaaaatctaatggagagtttaagtgtagttgcctgcctagttgtggcatgatttatttgaaacatccttcctttggtattcagcttaaacatttaactgcaaaaaaaaaagaaaagaaaaagttacaggcatttaaacaagagaaatcagaaatgcatgcaaagaggcccaattcctctcccttcacttgtctctggttgcttttaatggtagtcgatcttttcccttggtttggggaaaccaagagttgtaggagatgttaatagtacttggtttttgtttttgttgttgttgttgttttgagatgttttgctcttgttgcccaggctggagtgcagtggcgccatctcggctcactgcaacctccgcctcccaggttcaagcgttctcctgcctcagcctccttagtagctgggattacaggcatgtgccaccacgcctggctaatttagtagagacagcatttcaccatgttggtcaggctagtctccaactcctgacctcgtgatccacccgcctcggcctcccaaagtgttgagattataggtgtgagccactgcactggccaatagtacttgttatctcactagcttaggttaatgacagctaatgaatcttatctttcctctgctagagaagtctgtgttatccagtcaatagctaatcaattgattaaaagagataagccagactttggcacgaagcatacatgccgttcattctagattattttctttaaaatttgttgctatcaacacttggggctcagaggtgtagactctgaaatgatagttactttccttttggacacttaatataatgtgcatttttctaggaccagaaagtaataatgaaggagtgatctgctacccttgaaagctatactgggattatcattcattcagtgcatatttattaactttgtactttgtacaaggcagtatgctagccctggaaacatcagtaaagccaaaccgacttaagtcctgtcctgatgaaggagaactagcaagaaatacagtaaatatagtaagtatatagtatgtaaaaggcgatccaaactggaggagggaaagggcaggataagggttggggagttgcagttttaaatggaggtatgtggggattgagttggcctgtggaaaagctgacattcaggcaggtccttgacttggagggaaaggcctgtgtggctatggaagggaagagcattccaggcagaggaatcctctctgtgtgccaggcatgccatgctgagtactgcaagggcgcagatggatgatacgtggtttctaccatcggggagttgacaggctagaaacaagattcaggcttgaagataaatgcagagaagcactatggcaaggtagaatttttctaagggtctctgttgaataatacaagctaagaaaatatgaaaaattattcctatttcaagaatgaagccaggttaagtgatagaccaaaggacctctaccaggaaagcttcttactcttggctctgagccaatttcctcctcagaagttgctgcctctccctgaggccccacgctgccatgagtccttctgactccctgtgagtcaccccactgccatgactccttcggagggggtgtctgacctcttgcttcaggcctcttctgggcctcacagtaacccttgtgaagctgaagatgggagctctcatcttccctaacccagagccaaccttggcctctctgcgtcatttgctgccagtgccctgtgtttgtttttgggaagagagggattttcaggcatcccgtccctcacccacctgacctaaccgtatggattcctgacaccacaggcagaggactattcttcaggttcctctgaagcccacctgttcagatgcttgcttcttttccttcttgcctgttctgactgtgatgacagagaccccgcctcaggaatctccacctcacactctattctcataagtaggtagaattttctcatcgcatatttatggttgaggaggagatagatgctgagaagttaaataatctaccccaaatcacacagctgtgagtgatggggcctctacttctgttgcaccaagctacctgtccatcaggggacttgcctcaccattgctttctgccagccctgggcttgccttaaaaaggacatcatatgcataagacactggttaaaaggtgcagcatggtccctggagatgctcactcttacaactggcctgtccttggggcagcagctcctcacaggcccctaagaggtagacctcctgcctgtggctgccagaaccctcttctccatcacaggtcttcctcctcaagagccttctctggtttcctgttgctttttatattaaatatttcccttagtttagcatcccgagtctgccttttgctgattgttccctccctgtgtctgcagacaacttcgttttcagccttggtgctctgtctcagctgcttctaccacacacataggatttaggcgcattcaggacctgtcccttcttttcaagggccttgccagtgcctacttgttgtcattgtctttgcagtactacggataaccttcctagataacccccctccaggaaactgtccccataaaccgggtgccctccgccatgattagtttgtatttgcgagtgtgttacttggttgtgttccctgaatatttatttggttttcccagctaagttgtaacttatttgaaggcacaaaccaaatctcataattctattaagtacctaaaaggagtaaattattgttaatgctccaattggctaatgtctatttcatattttacttaccagatttacaaatgcttaatattctgaaatatttcactctcatttacaaaaacatcagattctactaagcagaaaataaagtttaatgcccccagcacatagcagttttgagttgcacttttaaactcacttcttaatccatttcagggttttcaattgttcacagttaattcttcttaccaagggtgtattacacttgctcagcattgaatgatatggaaagaatggcctttctttcctgcataactgactttacttttgttcataggttgaaatcagcccttccatttcactgcagtattatattagtggcatttttatttagggaaaaaaaaaagctttcttccacttgaacttttgttacaaatcagtttattgggtccaatcaatgggcaagacctatgaaagggtgtggattatctggttggtcctttgtgtggcaaaaggcttagatgctgcttagtactcgctcattcttcatcatgtaaagaagtgttttttttgaaggatcaacacctgactgagccctgcctttttcatggaaatgttttcacctgagttgctgcttatggtactaagaattagttaactaatacttatttaaccttggaacaatgtttatcataatccgattggcagatagtcattttacttaggctttttctttatagcatcaggactagcaaatctcagtaaagagtatgctgggagcaatttcttttttcccaaataggttatcactctgtgctttttttttgctttccgtcaaggggcatgtttgggcactgtggacattaagactggtggccacacattaggaaggtggaggtcccctcttgggttgagcaccacttttgtttttaaagctgcatccccatttcatgctgctggcagtgtttcccttcagacgaatcccatgcaatgtatcactttaatatattcggagctgtttttcatgataaagcttccttatgagcactaccactaattaatacacaaaatggcccagcacaatttaataatttggtaatgtttttcaatgttttcttaaagatgacgctttacaagtcaagacccaaacttgcctgggtcatgacctctttgcagtttttggagtcttgttaaacaagaaggaaagcaaaacataaattagcgtctccagtatggttgctctacatttcccaatctttcaacactttgaagagcatagtcactgttaatgtaagagaacatctcatgaggaaactggcagcgattttaaaagtccggctttctggaatgagtaagaagcttcttcctcagtgccactgttctagggccaacattgtcctttgtgagagaggagcaagatgaggaagtttgcattatggactatggaacattaaaaagctaaaaaagagaagtaacagttacctttaatcatactgaggatgtatcagcatgtgtggcctttggcatctgttagcctttagggctatgttcccaagtttgccattagaatttagtgttaaaaaatactttaaatataacagcaccactttttgttatagtaaaaatgtatgtctttactcgattgtaattacctcaacacccagcttttgttgttattttgcccttggacttaggtatttctgttcctctggcttagaatgtccttccccttcatcttcctaatcaacctactcattccttacgactcaactcatgtatcatctcctccagaaaaagctttctctgccacgtgtttcttccctctacctgacatccttgtgcgtaatacctccacctttccatattgtactataattatctattttgcatctgtctttctgtggaaggtctgttgcatattcatctaggaacttggtaaatgtctgatgataagcatttgattttttcctagttgattcctcaaataataataatgattaccctttaatctgaatgctcacaggtgtacttctatctcatattctatgcgcagtcatctgttaagctaatggctaattgtaccagagggtctcaactttgtttctttgatctgcattggtttatggtggtaccttgcccattcttggcacagcaggtggataaaaacaatgagtaacattgagaaaggctaatgtgtcttattgacagtagtggtataatgtttaccaaacccaaattgaaattattttggtttcttaaaatcttttcccgatagcccatttattttaatgttctgaatttccaagatctgtgtataggttcaatgattagtctttactgaagacttatctatggactgagtgtgtattataaatctagtgacataagtttaaaacttattcctttttcattttccaagtaaacttttttagtaatgtgtttttctttgtaaagacaggcagtatatgatttaggtctggatctggtttccagtcttggctccatcatgtattggttatttggccttgaacacaaatgacttgccttgaacacaaatgacttatatctgtgagattcaatagcttcatcagtaaaatggggatagtagtagtactgaattttcatgattataatgaaaattaattgagagactgatctggagaggtgccatactacaaagaggattaagtggaggtgtccctattaaatggcgagatacccagaaacattaccctgttgactccagtatgctggcaacgaggctttatagtctttgggaaggagactggaagattcttctctgggaaaaatgtacacatactgacctttgaaggacccccagtaatcagccaggtcttacctgatcatcctatagtgaagccccccgacacagtatttccattcatagtttagctcttaaatgtgaattagctatccagcaatcaccagacacttgaggaaagcctccagaaaacaaattggaaaaaggggcaagtcataggaaacagacaaaacaaggaacagaagaaaacatcatttttgcaatctataatattcacaagtttgttttttgagacagagtctcactttgtcacccaggcaggagtgcagtggtgccatctcggctcactccagcctcaaactccttggctcaagcgatctgctcacctcaggctcccaggtacctgggacgacaggcatttgccaccacacccggctaattttggtatttttgttgagatgaggtttcgccatgttacctagacaagtctcaaactcctgggctcaagtgatctgtccatctcagcctcccaaagtgctgggattacaggtgtgagccaccggcctcagagatctaaaacaagatattgtattttaattgcacaggatgcaattaaaaaagaaaacattcagaaaacaagaagagctcttagaactgaaaaataagttagtgtaaaggttggaagataaaattgatactaacctgaaaagtattagaaagagaaagaaataaaaactaagagtaaataagaaaattagaagattagtcctagagaatcagtatccaactaagaggttcccagtgggtgatacagagaaaatgaatgggaggaaatctcaaggaaatgtatttcctagaactgaatgattggaatttccagtttagaaagaaggaatctagtgccagcaaaatgagtatagaaagaaccatcttaggatatgtagttttcaaattgcagaacataggaatgaagaaaagattctgaaagttttgtattaaaaaggttagaaacaaaagatcaaagatcagatagcatttgtcttttagccttcagtgccttcaaaattgtgagaaaaaaattatttctaacctttttatttatttatttatttttttgagatggagtttcgctcttgttgcccaggctggagtgcaatggcgtgatcttggctcggctcactgcaacttctgactcttgggttcaagcattctcctacctcaacctcccaagtagctgggattacaggcacgtgtcaccatgcccagctaattttgtatttttagtagagatggggtttcgccatgttggtcaggctggtctcaaactcctgaacctcaggtgatccacctgcctcggcctcccacagcactggaattataggcatgagccaccacacctggcctctaaccttattttttacaactagccaaactattaagacaaaggatacaatagtaaggctagaataaaggtatttccagacatgcaaggtctttaaaattttacctccctcactctttctgaggaagcttttgggtacatgcagcatagacaggggaatagatgaggaaaaggaaggctgggatacagggaatctaacagaagagagaggaaagctccagaactacagctgtgccccaggcctagagagtcaccgcttcagattgaactgtgaacacacaggactcctggaggggaatttcttcaagaacacaactttaaactatgtaatgtgtttgaacatactgaaaggagacttgtgattgttttagagacaaacttgtgataagtacctggtaaactaagcaaaggggaaaaaggcaattaactccagtaaaacaaaatgttgtccaagaaaggaaattgaatagtactctgcatggcctagctgtaaaccacatttgtataaacataataaatactgaatatagatttaactaaagactgtgaaataactgtatcggaaggatgtaaaaaggggcatgtggtgggggaaggggggtagtgcaaaattaataataaatccccatcttccatggtaggaagttagtaaatcatatttaaagctgaaaacaaaaatctaaaaccagtaatgtaacattattatttgaagataaggaagtaaatataagaagaaaagccaagagaattgaaaatggttgcctttgaagaaagggaactgagaatggtagcataagcctggcatagtttttaaactttttttaaaaaaatattttggggttaaaagtaaaaatgaaaaatattaaatgtgacaattatggaaagcactttagcccatgccttttacagttcagtgttgcataaatataaactcttattaccctgctccttctaaaaagtgtactaaagccttgtaaagccagcgccacatactttctattcatttcatcttttttccccaattcccaccatacatgtgccatgttggctctgaggaaggaattacatacatacacgtcagtatctttccatttgtttgtgtatcttcttgatttactaatccattgttttattgatgtgaatgagaaggagctgttcacatgttgccactttctgaatcatgtggttggtaccttttttcaggattttcaggaaaatcctgaattgttttcttctgttttgcctaatcatttgcatcggcaagattaaataaaagtcttttgcaaattgtgttcaagcttactgtagtttcctaattagtcttattatgtacattttaacacattttctccctatgatcagggccgcaagcttcttatcattgggaccactagccgcaaagatgtccttcaggagatggaaatgcttaacgctttcagcaccaccatccacgtgcccaacattgccacaggagagcagctgttggaagctttggaggtaaaaatgagtcaatggattgcacactgtttataagaaaggaattgaggctgaaataagtagtaccacattatacctggtgtttggtttttatgctaatctggaacatgggacccggggatattacaggttgtatataccttatccaaaatgcctgggactaggccaggcacggtggcttatgcctgtaatcccagcactttgggaggacggggcaggtggatcacttgaggtcaggagttcgagaccagcctggccaacatggtgaaaccctgtctctactaaaaatacaaaaattagctgggcatggtggtgggcacctgtagttccagctactcaggaggctgaagcaggagaatctcttgaacccaggaggcggaggttgcagtgagccaagattgtgccactgcactccagtctgggtgagggagcaaaactctaacaacaacaaaaaatgcctaggaccagaagtgtttcagatttcagattttttcagattttggaatattgcattatatttaggttgagcatctctaatctggaaatctgaaatgcttcagtgagcatttcctttgaatgtcatgttggcactcagaaagtttccaattttggagcattttagatttcagacttttggattagggatactcaacctgtacctccagttgttttcaggaattagagaagaaagatgaatatacatgacagtgagttaatttcccattcctcaatgtaggcagctacaaactgccaggaattaattgctctgtatccagcatgagtgatgtatatagattacttggaccagaaacttgaatgggtggtggtgtgggggtaaggtaatcactgtatagaaaaattaaccattcatagtggcttttagcacatttccttgcatttaataagttggaacaatgattaaagccttagaaatgtcaaaaaaaaaaaagctacagaagtaaaaggaactttattaacaagtttagaaatagaaatgttttcttaattttttgaaaatgacagtcatttttaaaaaagaacgttcttcatttaacttttaatatcaatattcacaagtaacttggtgagctctattggaaaatattatctactgagttgttcagcagtggtggagtcagtaaagcttcttaaagtcctcaaggcccccaacaaaattgaaatttatctatatgataaatgttttcaggttacccatgtagacagcttttgtgcagaagctgggtaagagaattaaaggagtttgctttgacacatacagattgttcctagaaaagaatgttaaaaattttaacttatatttattatggattggagctatttttttccccagaaaatataagttacatagcggtccataagaaaacagggtttaagataccagttttcactttcatgattgcacctaatgggtttaggatggtgaaggtcagactggattttaaagtaggagagaattctatcaacttgaacagttaggtagttcttatcactcttcttttaaaggtaaatagaattaaccaatgttgatgtgttcactgtaaaagtgctttgattattgtttattgtttttgtagcttttgggcaacttcaaggataaggaacgcaccacaattgcacagcaagtcaaagggaagaaggtctggataggaatcaagaagttactaatgctgatcgagatgtccctacaggtaaggtacttcgttctccgtatgactcagacagaacaaagcttcaggacacaccaagagggttcagtatttcctttgccaaggttttaattaatttaagttttgattttcttatattatttccaaacttaatttggtattagtagcctgcttctgagattgatcacttaacaatactttttaacttcttaaaattcaaaaatggaaggaaagattataaagttagttttcatttagggagccactaggtcttagaactagaaaagacttcaaagagcagtcgttcttctgccccctcattttggagatgaggatactatgtgagccacaggctgtcagtgaattatccaagatcacatcaccaggttattgatggagaagggatggtgttgcacctcaagtcagtaagcgactgcacatataccaaacggtgtctgggagactgctttaagggacaagttaattaagttgtgcagtctagacttgggatctgtatatttgtccctggctgggctcctagaaatttcatgcaaactactgtagggttgaagcatccagaatcacatagaaaactgagccccagggtgctgcctgggcaaagacagatgaaacttctttgggactttctcatatctcctggcaacttacctttcttcattttagaactccacccttccatgtgcccatgctgtgtcttcttgtccttatctgacatactaggtagctgataaatacctccctatcaagccctatgagttcagagaccttggctcttactattgagtccacagcccctggaacagagccaacacatatgaaggtgctcagtaaacttttattattattattattattttgagacagggtctcgctctgtctcccaggccggaatgcagtgccatgatcatggcttactgcagttttgacctcgcaggctcaggcgttcctcccgtctcagcctcccaagtagctgggactaccagcgtgtgctaccacactcaactaatttttgtattttttgtagaaacatggtttcactatgttgcccaggctggtcttgaactcccgagctcaagtaatccgtctgcctcagcctcccagagtgctgggattacaggcatgcaccactatgcctggccctcggtaactttttttctttttttttcttttgagacggagtctcgctctgttgcccaggcttgagtagtggcatgatctcggctcactgcagcttccacctcccgggttcaagggattctcctgcctcggcctcctgagtagctgggattacaggcgcccacccaccatgcctggctaattttttgtatttttagtagagatggggtttcaccatgttggccaagctggtctcgatctactgacctcaggtgatctgcccgcctcggcctcccaaaatgttgggattacaggtgtgagccactgcgcccggccagtaaacttctgttggatgaataactgtaaattcattttacagttaggtaaatggacagagtggctgtattctaggcatcatgtgttactaggtgttactaggtccatctaggtggacagagtggctgtattctaggcatcatgtgttacttactgatggtcctgcattctgctagtgtgggcagtgagcggcagaggtgaagtttctgtttcacagttacatctgaaataggctcttggaccaataacaaattggaaacgtgaagtgaatgctttttaatcttttctggtaaatttatctgaaaataaaatttttttgactttcagaaatctaatttaatctactgagctttcagatggactatttttaagtcaattaatttattttccattatgagccataaattaaagtcacagactaaccactttgtttagacttattcttggtaaaagtgcaaatacaggtgtattggctctttccttgaaaaaaagataaatctgtcagattgtcagcttctttttttttaagtttcagtataattttttttcaataattgcatagaagaaactatgtggattttttccccaaccctcatccctttcccttcctttgatgcctgcaggtcagtgatcaagttaatgcttcttatgcatgtgggatagagagtgagagtggggcactcaggcctgatcttcagcgactgacatttcataggcctctgagtttgaaccccttcatgtcaaatggatttcgtgcagctgagtgaattctctttagatctgccttagagaggctgaacctaagtgaagaggcatgtagttttgcagaatataagtcgtggtacctctctgttcactacatgctattctgttaaaacttgcacagagctgaggatctgctctgactggatgtcacctgagggaataaagtcatttatctagattacttttttcctccctttctcctgacttttaattccatagctacaggcaagtcagtaagttgttgctcacacatattaaatatatttaatgggcaaagaactgcaagtaccaactacaactgcgctccagccagttcttttttttttttttttttttaagaacttgacaattgattcatatgtaattctattcccaaaaaggaaaaatgtttcttttgttagctattcacactttttcttagtcctttgtagtctgacctcttacctttgatacatttgaaacttctgttcagtgtttttctgggatagaagaaatcttaaaaaaaaaagaaagaaaagaaaaaaaaatccgtggttggagtgggagtccaattgcacatctccccacagctgcactgagcatttgaaagttattcctggagggcagggagttccctcttgggaaacagactcctgctctgaaacatattttaaaagttaggtgtgtttcttacaataaaaattcatcttcaggaactaaagatgtttttaacgattgttttctagataacttcatatctcctgtgggcctacgagaataaagtacatttaacgagttagtataaatatgaatagaaaatgaaaaccagtcgagatagctaataataacgacctgaacgaagcacctgaaacaaagttgcgccatcttttcttagactcatgacacattcgcagtcacaggagacccagattcatctggagatgatttcaggaatcagcagtactcttcatttttttagttttagcacaactttgttactacaaagaagaaactatatgacggatactgaggctaagaaaagctacatggttggttatgtagagttaataagctattttttagttgttgaattaacctcaacttggtatcttctactttgctgtgactttagtagccttttacaccttcaacaggtgaattggttgtcatttgaactctgatgaatggccctgtccagtctcacagcgatgcctcacaggcatcagcacagggcacgcctggcccaagtgcctatgatggccagcgggcttgggtcttttggaacccagtgtacatagttctggaaaaccccattcacttcctccaaatgatgtgatctgctttgttttgtgtgagaatgctggtcaaggagcaggtaacacattcagtgacctagcagagcattgatgaagtgtgaaaccgaacactgccttctcatgaagcaagtgcagagttgttagaaggtaccattaacccatcttcatttcttctgatgtatttagatggatcctgaataccgtgtgagaaaattcttggccctcttaagagaagaaggagcgtaagtacatacaacatttaatgaccatcaaccaaacttaccaccctgttaaatccctgtgcctattctaagagttgctttcctagataagtttgtttccatttatttgaattcttcgctgtgttgtaggtccgagagaccaagcaaggaagttggttgtactgttggtttgctctccctgtcctgcttcgcaaaacttccttgtcacaatgcaggaaaaacttaatggtacatatttattggaacctgcttttacatgcatggagctgtgaccattttcttttgtgaagtgctcatctaatagcaaatgcatagtgggaaatgtaggataaccattaagaagcttttagtgattttttttttttttttttgatgaatagttttttacggaccctcatctgtttttttgtgttttggtatttcttttgcagtagcccccttgattttgattgaaaatgaactatttgaaacacacagtgaccaagggaagtgaccaaggtgaagatggcctaggatcttcactgtcttactcaagatactggactaagtggaacgttctctaccttcaacatgtgctcgctctgcatgattagtgcaataaaactcccttccttatgcatactgagatagcttagtgtctcgtggaaggtgtcaatttggtttagaatgctgcgcttaccttcccatgcaggctaaagtgattccttcttgctcagtccctctgggtgggaaccatccagtacttgtggacactacacgtttcaacctctctactagcaccatcacccttgaaaactctcagtcagtgtcatgaatgttgcatgacaacagttggccgattagaaggcagactttctacatgcaaatctggcttagtaaatcgaggtgtgggccagagatcctctgacagctgtcctgagctaacactaaaagtcactgggtatttggttaaaggtctcccacaagactggtattctctttgcctgaagaaacaaggcattgaatctctaaaatgctgttctcaatcattgtcagagatgttttcaagttgcagtcagaagatctttcttaatagaaagtcagatgactaccgtgttggttgtgacttccccttaagtataactaatttgctctgtggtaagagatatgctcattattaccacttagaagatgttgttaaaaacatgtgaaagataggtatggaaaaagcatacacccccaaacagaaaggagttattaaagtaatttacaaacctctcagcactaattagtgtccaactccaagtgggtcaattccttagtataatattaaggcttactagtatcactgctttttccttagcttaatgacttacttagaatttatcctttattttaaatgatctgtactatctagtgtctaaaacactattctccagaaaaatcaatcattttctagccctctccctcagtcctttattgtccattccaatacattgaacacatttcctttaccctccacacacttcttccaaaaggaagcacccgttgagtccttttgagggtgatttgtcttacaactgactgacttagcaggaatttaattaggtcatatttggtgatgagacttatggagtgtgcctctctctcccaactgctgcttaaaatgcaaggacaagcaattagaagccatcctaaggtgcttacctcacacgccacccatgaggcttgtggccacagtggcacttgggtgtggctcctctgttatttgtcctcatgtgagaaagcagatcatctccaaatcttgccatttgtatacttttggtggagacttggatgtcatatcttctttgttttgggttttcttccctagcttattttgtggcttttaaagaagtggattgtattgtgagatcctgtgattcctggtggccagtatcctggattcctctaagatcttgcctctttcctcctcatgaaagcagcacacattgtgttaacttatgtctcttgttaaatgagcttaatgtctttgtgttttgtccaaaactgtattgaaaaaatattgtttaatgcaaatgaaggaatgcaataaagagtaaatatacttgaaaatgttctgtagaccagtgtttcatatagaacgacatgaacagctgataggaatggaggaagaaggagggggctcaggaaagaaacctctccgtgttttgttacaagtagcataacatgagggatgatttttattttaaaaatctcttatttagaaagtatagttatttaaaaacatcattagagtatcagaaaaagttaatatacaaccatctttatgctttatacttattttatcttactaaaaaaaaaaaatgcctggcacggtggctcatgcctgtaatccgagagggaggctgaggtgggtggatcacttgaggtcagtagttcaaaaccagcctggccaacatggtgaaaccctgtctctactaaaaatgcaaaaaacagccgggtgtggtggcacatgcctataatcccagctactcaggaggctgaggcaggagaattgcttgaacctgggaggcagaggttgcagtgagccaggatcacgccacttgcactcagcctgggcaacagagcaatactttgtctcagaaaaagaaaaaaaaaaaatcaactcaggtacctaagccacaaacaaggttagtaataaaccagaaaggagggttgccactcaattagaattactcctttctgtgaaatgtacaaaccaaggaacttcaaggctctcagtgagattgcttcacatggttcacttttgtatcctccatagttttttacatttttctgagctatcagatctcttaacctcctaaaccttgatccttagcattggctcagtttaggacaggaggcagctcagaaagtccacaaggccctgtggggaagaggccagcttcaagaacttccacaacgggagttcctgggaggaggaccctgaggccgacctggtccctgcatagccttgagaaggtgggttcttgaagctgcccaaatattcttcaaagccagtgctgtacagcagagcgtatgagattacagaacggcctgtgaagaagcaaaggaggctccagctagctgctgccttaggtttcttcatctataggcgaattgttaaccggctatttttttgtcataagatgtttttgagatcaaaacctcaaaagaggaggttattttatcctttctaaatttgtacatcttcactgggacactttttttcaatgtcacacagaaaaattgcataattgtggttaaagtcagaaatatgtttttactttaaggctgtcttttcatatcctaaaaattgcagcctcccctttaaaagtttcagcaacaagtcacaaaatcatggagtagattgaagtgtgtacaataatcaaatcctgatcaacagacttgttgaaacagtgagtcagctataaacaaacaccccagcccaaacacagaaggtgaaagcaggatttcattttccttgcctgacaacttggtccatagcctctttaaagaagtgactgggggcagccgggcgcagtagctcacacttgtaatcccagagctttgggaggctgaggcgggcaatcacctgaggtcaggagttcgacgccagcctgaccaacgtggtgaaacaccgtctctactaaaaatacacaattagccgggcatggtggcacatgcctgtaatctcagctacttgggaggatgaggcaggagaattgcttgaacctgggaggcagaggttgcagtgagccaagatcacaccactgcactccagcctgggcaacgagcaaaactcttgtctcgaaaaataaaataagtgactggggaagggtgtgtatgagagttcaagaaagcaggtaagttgcagaatttattgcaaaatgatatagagtttctcatcagctggcaagccgtactgagactgggtcctggagacgagcccacaagggtgtgtgctggacgggcaccatggcataaagatgcgggagatagcgcctgtgattggcaagcatcccaagtgggtgaagacaaaatatccaaggagggatcatgtttgaaattttcccagcgtagacgccatgcaacttctgtctcactattttgggagtataagattaatggtaagaaatttttgcctcctagaaggttctctattaaactaggagaaacagtggcagtgtagcagcaatgcgtagctgcactgacttcactcgagtgtgcagaccagccacacacacaagaacatgtccctatgcccagggccaccaggggagacggcattaggtaacaccaagaatcatgtcgccatcatgtttccttgcttttctttttccctaccttctttccttccacctttctttgtacctcatcccctcatccttgaactgtctcacatgctttccttcccttctttcttcataaaataatattgctttgaaagatatcttctaattatgtcgtctctttcagatttttaaacaacgtcctcttgtgtttagacgtttgtaagtacttatacataaggagaaactacatgttcaagcacagctatcaactgtattctccttaaccatcaaataagactgggcagggtgtgatggctcacccagtaatcccaacactttgggaggctgaagtgggaggaccccctgaacccaggagtttgagaccagtgggcaacacagcaagaccccatctctacaaaagattttatttttaattaccatagtagagtgcgcctgagtcctagttacttgggaggctgaggaggatcatttgagcccagggggtcaaggctgtgttgagccatgatcatgccactgtactcctgagtgacatagacacttgtctcttaaaaattaaaaactaatcatacgattacaaatggtcttcattagtatgaatagggaccatttaaatatttggcaatcttattgattgaaaaagtactggccaggcagggtggctcatgcctgtagtcccaatgctgagaggctgaggtgggagatcatttgaggctaggagttcaagaccagcctgagcaacatagcaagacctcatctctaaaaaaaaaaaaattaaaaaattagctgggcatggtgacacatgcctatggtcccagctacacgggagcctgaggtaggaggtcacttgagcccaggaggtcaaggctgcagtgagccatgatcacaccactgtactccagcctgggcaacagaggaagaccctatctcaaaaaaaaaaaaaaaaagaaaaaaaaaggaaaaagtacctagaattctgggatagataagttcagtcgagcatccctaatctaaaaatccaaaatctgaaatgctctaaaatctaaaacttttcagcaccgacaggatgccacaagtggaaaattccacacctgaccttgtgtgacaggtggcaatcaaaattcaaaatgcagtctaaactgtttcatgcacaaaattatttaaaaatttcataaaattaccttcaggctatgtgtgtaaggtgcatatgaaatcaatgaatttcgtgtttagacttgggtcccatccccaagatacctcattgtatatatgcaaatcttccaaagtctgaaatatttctggtcccaagcatttcagaaaaggtgtagtcaacctgcattagctttatgcaaaagaaaaataaaaagtcgaaatgaaataaaaatgaccagactgtaagatgtagaggagatctgtatcctgtacgtgtccgattcgttgtatggctgaagtgtaacagtttttgtggtttcagcttttcaggggctaaagacacatcatggacaaaacagagtgcatcaacttctggtggctattcctaacctcaggtcacaggtctgaatacagcgcagagcagcccgcctccaccataggcggctcatggctttattttcctggtttttttttgtttgtttttttttttttttgagatggagtctcgccttgtcacccaggctggagtacagtggtgcgatctcagctcattgcaacctccgcctcccaggttcaagtgattctcctgcctcagcctctcaagtagctgggactacaggcatgcaccaccatgcccagctgctaatttttgtatttttagtaaaaacgggctttcaccatgttggccaagctggtctcgaactcctgacctcaagtgatccacccacctcggcctcccaaagtgctgggattacaggtctgagccaccccacccagcctgttctcattatttctcttcgtagtgaggtaagatttgttcctaaatgaggtaggtcaggagaaataaaaagaaaaaacatttttgttattctctgaaataatgtgctgaataaaccaaaggtgacattttatgggtaggtctgaaaactaaaggattgtctgttgtcataaaaccaacttgtggcatctcattgttgagaaggcataacctgtgagcttccagtgggtcctgtgaagtggcgatctgagagggtgcccatccccagagcatgcccactggcaggccctttctacccaaacccaaacccaacttcaaatgacaattgttccagacagcccacagcccagggcacacgctttcttcttgtagaccagcctacctccctctacggcttagctctcacagtggagctagcaggggacagacaattttcagtcaagtttcattttcaatagagaaaatcctattttcccattaaatggagttgaaaacgtggtgaggaggggattaaggcagtggccacccctgcggtctgctggccttgggccacatcttttaggagtgcctgtgacattaatttatacattgaaaatacttgagtctgtgaaatgaattagtacacaagttgttgttttctaaaactggaaattcattgttagaagttaacttagaacaaaagaagcctttaaaaatgtactgtggtgtatcagacccactgtccgtgacatctctgatgatcttgcttagaaaacagaggaaataaccttcacttggtcatttaattagctgaggccaccatgttcagaatctcgtatccttgacctcctgagcattaatctggaaactccacacagtgtacaatgtatccattttaggtttgtttaccttctctttaatgacttaacagaaaaaaactgcatgatgaaatatattttctccaaatatatatatatttatataatatataatcttagttaactcaaaggtatatacattgtataataaataatatttataaaaagagactttttgaatataaaatcaaaaagatcaacaacttctacaactttttacaaaactttggatacagcaggttggtaggaaatttcggttggatactattacctgactacggcgagaatcattacaatgcactcatgtactattattaaataattacttgtcagctacttgaatacgccccagaaacatgactttatcacttttaatatagaatacatagatatgaaaagattgttttgaaaattcgtatccattctgctgaagtattctcacataaagcaagtattatccagttgacatgatttaaaacttttcagtctaaggtgagatggggaggggcatttcagacttggcggagggggtgagatgtgtatctttagcagggcttgtggccagcagatttagaagtgaaggcgggctcctggacgaccatcttggcaagcccacctgcaccagctgggagatcgctgccctggtattttaggtcagggttaggtagaccccagagagaagggggagaaagaaaaatctttgttctgctcattcccctgctgcatctcttctttctgattctccctaagacagttgttgaaccaattcatactgtgaaatccatgtgcctcccttttgctagctttctctaggacgctcagctggaccagtatgcctcagggagaactcagccgtgagatgcttcacctaagggagtaggtgactgctggttcccctttgaacttctaatccagatccttgggaactgcatggatggaagctatctcagcatgcaggtgagggaggaagagctgggggaaagaactctgtgtctgtgtttactcacattggccccagagaggaaaggacacagtaagatgggtccgtattggagaggaagcaaagggatggttttcatcctccccatctgctagtcacaaagttggaatttcaggaattgatggctactccctcacggaccctttgtctaacttatactaaggtgacctggagtccaactgctctacctggagttatttgtacagagaatctgcaggtgagcagggctgggaaggactgaatggccccttctgaagataccgcttatttatttaggaagccatttgagctagagaagacttgcccccttacatagcctatttacaaggtccactaccaccaaaaaaaaaaaaaaaacaaaaaaacaaaaaaaaaactgcattgacggtggaaactgcagaatggtagaaaaagattttgagatctgactgcccctcgtgcagaacagggttatagagaaaatgagactgagaagaacacatggctgctcttcaaacggctgaccaggccaccctgagctgccagttcttccaaactccaaatcctactctaacaactgccacggaccttcctaccacttcatcctagctaaacctatggcttttatcagaatgagaaattagctcaaatttgaatgggagtggaccaagaaaaggagactgcaggggtgtgtcctacttcctgactcccaccctccaggcgtcttggaatgtcaccagaagcagcagtttggaaacagaaccttgcccatgctgatgtcttgactgccaggctgagagctcacattagcccagcctgttctgttggagtcaaattttttttcatttttattttctttaacatgtgcaaagataagcctcaggtctgttcctatcagaccctagagaactaaaaagaaagcccccttctttaaaaaccacacaccatccagagtagggtgagaaatgtaagatgagagagagggagagcctccccgtccacaggcgagttgggtctgggtcatttaccacgcgtgcggctggtgacagttccttgctgtctgacgctgagggctgtgcccggctctaggtcctgcttcccatgagacttcgctgaatccgcccagccacacacttcaccccttcccagcgcccttggggaaaatcaagaggaagaattagaaacataattccattcccagagaccacccattggggttcaaagatcagaggctgctgatggatctgaacgtgtccctggtgctcagaggtgatgaggacttgggtggtttctccacgctctcctctgtgctttgggcctgctgttgagggaggtcgtatgagtcacaggagcagtaaggctttcgagtccacagaatgggatcgaaattctacctcccccacctctagctgagggccttgggcaacaggaagcccaggagcaggtcactcaggatgggagaaacggtgcctggccgagggcccagtccccaactccaagtcaactgctgtgctgggctcacgccaggcatgcactgtgtttttgtaccgcaccaaatagcttgataatgagctgtccaaatgggagagagcctacttaattacgaacaattccttcccattggagcagcagtgtgttcattttactcatttgcatagtcatatctcacaaagggtttgaggcattcccagtcaacccccagctcttctagggggctgacaaggccaagataagactactttacagaggcagaaacaggctcagccagattgaagggacacatccaaggtctctcagcaaggcagtaacagatccaggacttgggcgcagccaggccactcgactcttgccagaacctttccagctccagctcaccatgttcacaacagcagagtgacgaggaataaatctggcacttgtaaggcaccaaatcaatggttagccagagacactgggtaaaagctacaaaaagctacagaaaaggtgttttccccacaaaggaaggacacaagccatttgacaggcgctctctcctcaccgtgtggagggcccggggcctgctctgcgactcccttctctctcctgcctgcactgccaagactgtcagggaagacaagagaacagctaacgactctgtcccctgccatccctgccagtgcatcccgcaggctcccgtcttgcctagcggagtctcggccgagcctgggcccattgctccagagcaggcggctctcgcctggggaggtggctctgggaggtcagctctgcttggcccaggagcctctgtggctgccctgtgagcagctgggtcctgggccaggcccttcatgtgcagggtctccagtccacaggacaaccctacacagaacacagttctcatccccagttcacaaatgaagaagccagggctcagcgaggcagaagagctggcctgggagtgtttatcagaagggcaccatgttgggagagtgtcctccactggtcacagagtgaggcctccagagcttccacagagaaggggttccgggtaggaaccacttggacacagcatcttgaaaccatatctatgtagcactttacataagattgaggaaaaaaaacactcattgtccatttcagaaatggggagaaagagggctgatgaagagtactgattctggccgggcgcggtggctcacgcctgtaatcccagcactttgaggggccaagacgggtggatcacttgaggtcaggagttcaagaccagcctggccagcatggcgaaacccgtctctactaaaaataaaaaaattagccgatcgtggtggcgggcacctataatcccagctactcaggaggctgaggcaggagaatcgcttgaacccaggtggcggaggttacagtgagccgagattgcgcacttcactccagcctgggcgacaaagagagactcagtctcaaaaaaaaaaaaaaagttctgctgggctcccattgtcaccaccactgaacagaggaggaaactggcgctcccaggccagacagctgagtggacgagtggaggcgctggattcaccttcgtcctctcccactccccacactgcttttgttcagataccgacaaaggtagtgccacctgctgcctttctggactgtccccaccaggacagaacttgagctacaccgaggggcttcctagatgggctgagtgagtcgcccctcagccagagctcttctccatgacgtcaagtacctcccatatctcagagaggcccgtccacttccctcccctactccctatggcacagacatgtgccagtagctcagaggtgccctgtggaactgcaggaagagggggcactctaccctttcacaggctgctctcgcccagcagcaccccagacaacaatgacccagcagggaagtgcttcccaattaaccaagccctgtcctcggtgtcctttcatttgtccctcacagcatctctggggaggatgacagatgaggaaccaggtctatgaagaatttcttgcttgggtcacacggttggcaagtggtaggagctggagcagggcagggcctaattccaacacccatgctcatgcctcgacacactaggctccttctcaggggacagaaaaggaagaaagggcaccccagccttaaaaccttccaccccgggggtccaggaccactcctcatccatgctgacctatcccggggtgctgtggaacccagggccagtgcatagcgcctcccatgcaggccacctctgggaagcttgggaacaaaatccacccgcctttgatccctcgattactcatcccagccactctgaacttgaatccctcctgctccccgtcatcatccataaactcggtgagagtgctccccactccacccaagcttcagatctgtcaggatatgggcttatatgccgcttccccccacccacctccctgaggttggtacgatttatgcttgtgcaggaacttgccctctaagttcaaggtggatgcacactgactctgcctcaggggtagaggagacattttggctcgctgcttgaggtatttaaactgccccctgcccttcaccaccatcaccactttatagtaagaaagctgaggcccagaaaagtgaaagaacaggaagttactgacaaagttaggaccagacgtcaggtctcccagcttccagccccccatctccaaataatgctcaagaatgacagctagcagctatgcaaaaatttgatctggctcataactaacttgtgtaaaaatgttaatcaattgctggcacctaatgtgcacacactgaattttgtttttttttgtttgtttgtttgtttgtttgagatggagtctcactctgtcgcccaggctggatggagtccagtggtgcaatctcagttcattgcaacctctgtcgcccaggttcaagcaatcctcctgcctcagcctcccaagcagctgggattacaggcacctgccacaacgcccggctaatttttgtagttttagtagagacgggtttcaccatgttggccaggccggtctcgaactcctgacctcaggtgatccgtccacctcggcctcccaaagtgctgggattacaggcgtgagccaccgcgcccggccaacactgggtttttatctgtgctttgtgcaatccaccaagtctctgcccaaggaccattcccacggatgcttgaaaaatcctagcttcctattttggctgtgggaacttgtgtgtcttggatagcttagaaacagaagggggtcgtcaagaagacgagatgggcaaacaaccccattccctgcgcccaggctcccagcctcccccctgcttcccggagccctacctggtgccctacttgcaggtgtgcacgtcgtagatgcgaatacactcctggcagctgacgtagcagcaccagtggaagatgcagtggcatttttccttccgcttctccgtcctcgtgttgtggccccggccacagcagagcagatcgcagccatcgatgccgtgggaggtgacattgcaagtccggtcccttgtgccaaaggaacccgtctctgggttgggctcacaaaagttgggggagttctcgtagtagaccaggtccctctccgtgggtggcttgaagagcgagtacttggcccggagggtctccacccagcctcgggactcacggtgcttctctactaccatctccgaggcgctgtcatacttgtccttgaggaagtcaccgatggcacggaagtcaggctgcgcccaccagcaggtcttcacctcacagctgcccgacagcccgtggcacttgcatttgaggtgcatgtggtccaggatagtctgggggagagaagtggcagctggccaacagaccgaccccacgagggggcacatccaggccttccctctctgccactgcccacccccttccctccagccttctctactcctctgtgacaggaagagaactgatggggactgaggcaagacctaaagaatagtgaccatgtttccctcccccttcacaccccaagcatgggtagacagcacgtccacttctcacagcgcatgaaatacgagttgttgcccaggcgcggtggtaatcccagcaccttgggaggctgaggcgggaggatcacctgaagtcaggagtttgagaccagcctggccaacatggcgaaaccccgtctctactaaaaatacaaaaattagctggtgtggtggcggacgcctgtaatcccagctacttgggaggttgaggccggagaattgcttgaactcgggaggcggaggttgcagggacccaagatccagccactgcactccagcctgggcgactgagcgagactccgtctcaaaaaaaaaaaaaaaagaaaagaaaaagaaaaaagaaataggagttatctccatttaacacatggggaaactgaggctgggaacttaacgtgactcaccctagatcatacaagcatagtaagggagtggaggctgaattcaaagccaggttcccaggacttgacagccctacaccgcgtgccaaggtgcacaggatgggtggtgggtggcacctgatcccacggggtggccatgctcccaggccgactcatcccgggtggggtggagtccaggaactgcccaaggaggaaggagggtggacagacgaagtggctgtggggtggggaggaggccaagcctggccaaggggaaaaggagcccgcgacccacagggctgccggaaggggtgaggtgggggccagggcagctccggaggggaagcggggggctgctccctgaagggtttggggagggtagccgggctcaccgtgcggcccgcctcgttgttgtgcttgttcatggccgagcgcgcgtccggcctgttctcgcgcgcatccgcgaactccctggacactaacacgccgaagtcagcgtcctcgctgcagccgccccacttccagccttcgccaggcggccccttatgatgcgagtcacagccgcaaatggtggaggtgccctcggcgcaggagcgggtgacggcgaaggccacgccggccgaggcgatggcgtgaacgaaggccgactcgcgggtggctgcggggaggtcgtggggaggcagcactcaggacccggcctgggagcgcctgccctgcctccacctcccaggccaggacgtgaggggaacgaggccaggaagagttgaagagctcaccagccctgaggcaagagggaggcagcttccccaccctctttggctggtttagacccagttgggtattcccacttcaccgatgagcaaactgaggccctgggctgctgattagctcaggacctcaaatgccacagggcaaagcagtgcctgttagaaacaggcgccgacaccaaagctctggcaggttgctgcagagataaggcagccacttctgtcctggtcccacaccccctgccctccaccttcccaaagtccagagaccaccctgcacaggcctgagccctcccacgcctgagtgagatccaggtctgtaaggagggaggcctgggaatctacagcctaaacctgcccaggcccaccccttccgcacgtggatgcatagggacggcccctctccttttctcggtctcagtcgccctttttgtaaaatggacacggcttccctccgctcctagagcccctcaccaggagggcagtggcccgtgcctcagtctccccatccccattctcctgccctcacgcccaggcacggccaactccctcccagaagggtagggacaccgggcagttcccctggttctgtcccagggtccagcgcagggaaaggagagactctcaagggtgtgctccagcctcctcacaacggtcatcgtctctgcatgtgcttcattcacatggaaagttttactcattttatagatgtggacattgacgattagggaggccaaggcctgcaagacctgcagcccaaccatctctctcctcatggcaggacccgggagccggaggtgactcgccacctgacacaggctgtgaaacgccgggccggcctagtcggcaaaattggtcataaatgtgaccaaatttatttagaagccaggcgcccgcctcccctcctgggctgttggccgagtgctgcaagaaggaagcccgggacccctcttggctcccgcggccgctctccgcggcccccacgccctcctgagccacctacagaggggcccgtcccacttccaacgacgggagggcgaagagtgcagagctggtcccgcccgcgccccgcgcctgcgctgccagggccgaccgaggacggcggcaagggggcccgacgtcccgcgtccagttgtgctcccggcctcggggtcccagccgcgccgctcactcgccccaatcctagacgccccagccctgggggcgcctcggggaagaggggccgagggcgggttcacagggcgggcgcccctcgtttccggccggcctgcggcctctcgcggcggcagcggcgcccgggccccgggccgcgctgggttcccagccccgggaacgcgggggcggcgggggcggggcggggattagcctgggagcggcgctgacagccccgctgtgccttccccgtccggcggggcccgctgggccgctcaatccgcctttgttcgcgcggtgtcacaccgcattacccgcataatgcggccgccgggcccgggccgccgggccggccgccaccgcgtagcaacgggcggctcccgcggccgggccgcgcccccggccccggcgccgggccgcgaaatccccattgaagcggcgccccccgcccccgcgccgcgccgcgccgcgccgaatggccagagggcgtgtgaatggcgcggcggccgcgcggtgggggggcggtgctcgggcgcttttcaggccgcccaggcccctccggcgcccgcccccgcccctgcccccgcccccgcctggggaagcgcctcgggcccgccgcgccgccgccgcgcctcgccccttccggccgccgaccccgccgcccccagactcgcggaagacgcgcgccccgggctgcccgacccgctgcgccccgggtctcaaagcgcggggcagagattaacccttggccgcccacgcggcggtggtgtggggactcgccgggggcggggtgcaaacgtggggccggagctgggcgcgaacctgggttcaaggtccgggctctgggcaccgaccggggcgcgtatgcgctcgcggcgtcttccgggatgctctcctcgccgccgccagcaaattcccaaactctcgggcacacatcgcccctccccccgcaacccaaacctgtcctcgggccatctagggaccggggcgtgtgccagaacctacggtggtgacttaaaacgttcaacgcggagtgaatgggtagcgctcccagagccgctttcccctggctcttggccggagacgggaagagcgatcagaggtgactcgcttttggggagcgcgtctagacgcagggttgtttgattcagcgctacctggcccgaggaggggcaccggaaagcgctgagaccaacacaccgacaagaacgagtttgaaatgcaaaccgccgccacttggccccagttaagaggccaaatcttttatgtcaacaaggaataattagttttggcaatagaagcgtaaacagaatcatcatccattgatttgctaattaccctcctgtcccatgacaatagccagcactttgcctgtaggtgggacagaccctgagcacctgaggcaccggtaaaggggaactgcactctaaaatgggggttgtcagcttcccccccaaccccacccagcaccccaccccttcacctgaacgtcagatcccttttctttctggctgtataggcagctctcattcattccctagcttctaataggagggagggccaggctcagcggtttgggtggcagagcaactctggctgtggccagcccggccaggatcgttaaattcctggacactgccgttccacaaagagctgcccatcttccacccagtccatgagcccccaagtccccttcttgggaggagttgtcccacttagcctccctcccagggcctgcaggttcaaagtcaaatcatgtggttccctgtccacttgaggcacagccagttagactcccaggctgcaagacggccggaaagttacccagaggccagtgcaccctctagccccaccatgattcctgggcatatccagctgacagggcatgaggatgaacagaaacccagaggggctcttgggggcaacgcaatgctaccacagcaccaggcagcttcctcacctactgaggactttctagatgggagggacctaggggtggcaatgctctcacccccaccccaaagcggtatttgcatagcacttaacacagcattggggaaatgtcacaaatgtccacagcaggagcctgaggcgcccactgtgcaaaagccaggaaggaagtctgtggccttcttggtgtcggccctcaaacctcaggatcctggagcatctcaaggcggcccagcccccagcagcgcctgggaaggtgtggcagtcatgcaaccaaatttatcaccctcccagagggaccctggcttcagagaagaggcaccctgactggggtggaagggcatacagtcctgatccctccccccacccagcccctccccccccctcagccccaaggcagtacctttgtcgaggacgggcccaaagatggccaggctgtcatctatggtggtgcagttccagcggcggccccggaactggtgctggcactcctggatgcccagcttcacgccctcggccacgctgggcatgatctcgatgtaattgcggcagaagcgcagttgcttggggaccaggcctgggatggagccgcagagcaggggctgtgagcccagagatgtgtactgctggcccagggccagggacctgcaggcagacagagggtagtaacactgtgggcacaaagcacagagcccatcctgggcaccatggccgctttgtgaaccctccggggtaggtggagaggcagagggcctgtgccctggcacctgaatgtgctacctttgacctcgggagcatgccgcccctcaaagcgcagagctctgacccacgcaagtcagccctctggctgcatccagcttgcagggggatgggaccgcagaagccgcttgtgggggcccttgggggcaatgcaaagccatgaaaagaggtttggactagaaagatggtatttggggcccagatccagtcctttccaggttctgggtccagcttccctgatgggcattgaagagatcaggctgggcaatttccaaggcagtccaggatactggggccacatggacacttccagtgactcatgggacacgcgcgcgcgcgcacacacacacactacccttggcaatgccctcagcctcttccctgcgatggtgccagcccagcccagagcctcccagtatctccccaaggaattgctggcttgcaccaagtcctttgtctaccagggcctccatgaccatctttccagtttcctagaagtttctagagctccacctcttttctcatgagagactggagcttggctttgtgtcaaaacaagtttagcacagagtcagaagggagatctcagatctcactgcccacacccaacaccaggtgactggtcaattcactccattcctctgcccctcgctttgtaatcaatatcccatcaactctctcaggttttatagtcaacaacagaaagaatgaccttatgggggtggggcagaagagtttaaaatactagaaaaccaaggtaggaattacgacttttccgttccctgccctcagcacaggaacagcagaaatgacattttctgggagaacctgagaaaatgatccgtgagtgtcagtggccttcaaggacaattgcaatctgctctatgaccaggggcagtgtgagctggaagaaggggcccatctcctctccctctgtgtccagcactgaccaaggctttggtccagcattggcctaagtcaagtttcccacaaaaagtgatgggcaaaagcctcggaaagaggggccgggagaagaccccatggggcagggtgaggttttttgtgtgctttttagtacacaaaagcttctgggctggacacagggccgagccaaacatctgccatttggcaactgttactgcttgccaggcactttatatacaacatttctgatcaattcccaaacatgaagaacatcactatctcctggactaggaaactgaggtttagagagtgaattagcttgcctacggctttttggtctgtggtgggtcagagagtgccatgtgccttcccccgggtccctcctccatacttgagcttgatgttggccttggccaattcgtggagactccaaggcacagagctccctgggcaccgtgcaggggcatgctacccatccaccttggttgtctccaggctcagttgtcagggggagaggcaggttctcctttttccatttgtttattttgggtggaggaactgaggagccagatctgggagtttggatggtaacatctgtgaggcattccaggtcttaagcactgagctttttctaaagagaaagaagcagcagccagaagttcttttttttttttttttttttttgagacagagtctcgctgtgtcacccaggctggaatgcagtgacgtgatctcggctcactgcaagctccgcctcctgggttcacaccattctcctgcctcagcctcccgagtagctgggactacaggtgcccaccaccacgcccggctaattttttgtatttttagtagagacggggtttcaccatgttagccaggatggtctcgatctcctgacctcgtgatccacacacctcggcctcccaaagtgctgggattacaggcgcgagccaccacgcccggcccagaagttctgatttatcggtggtaatggctaattactgatttccccggtgcctggccctgagcagaggcttttccttgggtttgcctcatttaatcctcaaaatagccccagcacaaagtagggtcattattagccccattttacagatggcttagccttgcaggttgatgaagcaccccagaccacagagctcctatggaattgctggttggaacccagggtgtcagactccagagcccatgggggtcatcactatgtgaccctgcctgctgggcagtgcctgcctgggtcttcatggggtgaaggtggcttcaggcctggcccatctgcaccctgggcctccatactgagcacatgcctgagtgggtagagtcagtgagcccagagccctgatgggcacacggcgcacacagcactgcccctgccctgttagaagcaggttagagtgatcatataatccctgtggtttattatgggcctatcatgtgctggacacagttctgagtgcttgtgtctgttaccttatgtaatcctcacggcaggtctgtaataaaaacttcattatcatcgccattgtcccatttccaagataaggaaactgaggccagggagctaagtaccctgccctgtctgccaggctgcaaaggtccccgttgagcctccctctgggctcaggctgcccctcccgtgctcttaagcagcatctccagcccagccctgctgtgccagctgcccccacagccctgcaatcactggaggggaaactgagggagagttcagtgcagacaactcggccttgcaccatcctagatgggcagctcaggaacaagacccagggaagaagcctgggctgtccccgctccttcctctggtgtttgggacccagagccctatatgggaccactggagcggagagctgaggcgggagtgagaggcactcggagacccttcctctgccctcctccttcccctcccgttgccttcctgcctcctccttcctccccctctcccagcccttgcttgacaccttctgcaggcctgggcaccctcaagctaaactggaggctgagccctggtccagcagcagaacccacaggaggagccctaagggagcacaaagcccattatacagatgaaaaacagaggccgaccatgccaggtggctcacgcctgtaatcccagctacccagaaggctgaggcaggagaatcgcttgaacctgggaggtggaggttgttgtgagccaagatcatgccgctgcactccagcttgggcgacagagcgagacttcgtctcaaaacaaaaaaggaaaaagaaaaagcagaggccgtgaaagaggaccaacttgtgcgaggtcacacagccatatccacagagaaagccaggccggctggcttgggggactgaggagtcggggggcccatgctggcaaggcggctcctcacccagctctccaaggggctccctgcttcctggtttcaccagttacctccctcagggtcccaggtgggtcttcgcagcccagcagagcacctgagctctggcacactgcctgcatggcttgattggcctcaaaggtcggagtgcttcccagacatctccaggaagaaggtgccactgagcccttcctgctgtgcagacgcagtctctcctctgccccacagggatttccttctgtccccacagttacccggatactggcaatactaatgacaactatttatgtagcacttgctctgtgccagtcacttcaaatacataatctcactgaatcctcacaacaactctgggaggtgggcattgttatccccattttgcagatgaggaaactgaggcatggagtagttgggcgacttatgcaaggaagtggctgagccagaattcaagccctgagtttgtctgactcccagtgtgatgtcctctgagaacaattcctgagcctcagtcatgatgagctgttttccctctttccaccaaaccctgtctccttcctgttgcccaggtcccaccaactgtggacctgggagccatggtgccagggtcccatccagctctaccacttcctagctgctgatctcagcaattttcttaacctctatacctcagtttctttatcggtaaaatagacacgacaggaggaataagtgacacaatccagtgcatggcacgtggggagcccttgctagatggtggttgctatggttacggtgtgtgtggagctgtccccagcactttgttccctgccttgtcaccaacctcatttctcccatccttgcatccctgacttggtagaacacatcagaaatctcagccccttcctatccaacactggaaaggatgcctggatcagacctcagtcctcacaggggtggcagaacaaagacagttgtgatctggatgagggttcaaggtcactcaaagagtgcaggcaaaaggacattttcaggatgctccattcaaaggcttcagttcagatggggtcatcctgcgagtaattagcaaggcctctggcgatggggcttagctcctgggccagtgtcggagactaaagaggctgtggccatgggattgatttctgcaggatggctgcccttccccaaacatgcccggccacccccaccctgagcctcctgcccgcacactgctgaaattccaccatcgcagacacattactttaactcgccactcctattccccattattgaagtacacgttccacttcgggaggcggcacagtgactctcatgctcctcgattctttgtgccaaagtgtgcgtggctttgacggatttgcctagccagctgaatgactccagcggggctgtttcacacttctgcacatttgcacatgctgagccctcggctcgaagcacctctccactgcccggcccccggcaaccattctacaccatccttcgaaacctgattcctaggtcaccaccattctaaagccttctgtgagctccagacagaagtcacctctcctccgcctgaatctttcctgtacctaattcaaaccttcttatcccaaagtgctgaactgatttgtttccaattccatctggctatgccagtctcagtctccaagaagagaggtagtggtagtgttttctccagttattccccggtccctaccccatcacacacacacacacacacacacacacacacacacacacacacacacacaccccagcccactcggtcttccaaagggccgggcacatgctaggtattcatgattctggaggaaaggaatgaagaactcttccaaaggacgagcctgatgcccctcactcgccagacctcccggcatccggagcttccgcctacacacaggacaagactccttggttccgctcaggaagttcctacgtttaggatctgagatgatggccaggctcccaagggggatagagacctgcctggcactgacagctggtgagggggagggcggaggaccctgccaggccttcgcagctgggccaggggctatttatacccagctcctggcccggcccttcccttccctaggaccctgccaccctcctcctgaagccggctcatcctccactccgaccacccactgcccagctgggccaaggacacacacgggcagccaggcggatgggctgcgggtgccctgcacaacgggctgcttgtggaaactttggtgttgaccccttggagtgaaatatccctccacaaataggcaagacctaaaccttgtgcatggccttatctaactcccatccccaccccagttctgtgcctctaccctgataacgcctgctgtggccagagggctgcaggaggcctgcatggtgagcacaaggcagagaggaccttttttttctttttttgagacagaatcttgctctgttgcccgggctggagtacaaagcgtgatcttggctcactgcaacctctgcctcccgagttcaagtgattctcctgcctcggcctctcaagtagctgggataagaggcatgcgtcaccatgcccagctaatttttgtattttcagtagagacagggtttcgcaatattggccaggctggtctggaactcccgaccaagtgatccacctacctctgcctcccaaagtgctgggattacaggcgtaagccaccatgcctggccatagagaacatttttagagaacatttttaatcagtgaattcaggtcagcctggatgctgcattgacttacgcacctaacatatggtgagacacctaaaggcaccctgtacagtgcgtcctgcctgatctgacactggggttgttggcctcagatgctgccgtccacccagtgacggccaatcccctgctgatgggggtctgactgtgctgccagggacacccactgtgctgccagcacccactcccctgagtgatccattagggtaggcagtcctgcacccaaccaggtggcctcccaaatggaatcacacacaatctccctcctctcccctatatacagaacatatgaaaagagggccctgtccctcaaaaagttaaacatagaatcaccctataatccagcaatgccacacctggtatacgcccaaaagaattgaaaatggggactccgcccaggtgcggtggctcacgcttgtaatcccagcactttgggaggccgaggcgggcggatcacgaggtcaggagatcgagaccacggtgaaaccccgtctctactaaaaatacaaaaaattagccgggcgtggtggcaggcgcctgtagccccagctactcagagaggctgaggcaggagaatggcatgaacctgggaggcagagcttgcagtgagctgagatggcgccactgcgctccagcctgggtgacagagcaagactctgtttcaaaaaaaaaggaaagaaaatggggactccaacagacacctgtacaccagtgttcacggcagtgctactcacagcagccaaaaggtagagacaacccaagagtcctcagcagatgaatggataaacaacaggtggcccatacatacagtgggaccctattcagccagaaaaaggaaggaagcgggtgtggtggcggtaatgccagcattttgggaggctgaggcgggtggatcacctcaggtcaggagttcgagaccagcctggccaacatggtgaaaccccatctctactaaaatacaaaaattagccgggcctggtggtgcgtgcctgtagtcccagctactcaggaggctgagacaggagtattgcttgaacctgagaggcagaggttacagtgagccagttgcgccactgcactccagcttgggcgacagagcaagactctgtccccccaaccaaaaaaaaaaaaggaatgaaattctgatgcttctgatgcaagctacaacgtagaggaaacttgaaaacaagctaagcgacagaagccagacacggaagaacaaatactgtatgatttcacttacatgaagttctaggtaaagacacgccagcttaggcaacagagtaagactctgtctcaaaaaaaaaaaaaggaatgaaattctgatgcaagctacaacatagaagaaacttgaaaagaagctaagcgacagcagccagacacataaggacaaacactgtatgattccacttacatgaggtgtctaggtaaattcacagggacagaaagtagaacagaggttgccaggggttctggaagggagggagtgggaagttactgcttaataagtacagagtttgggatgatgaaaacagacggtggtgatggtcgcacagcattggaatgtacttaatgccactgaatagtacactttaaaatggttaaatagcaaaattaaaaaaatcaaaggagggatggtgcttgcatccccagccttcaactttgcacctagagcccctgtgcaggacgaaattccagagccccgggtctagtctaattccctcttcctctatacgggaagattgaggcccagagaggtttgtcattttccggggtcacacagctggctgcccaggaggtgggaggagaacccagggctcacagttcttttacccaccaggcttttaacctgggggtgatgaatgcacattctcagaagcttctctggggctgggcacaaaaaggacccacctggcttcacatgggtggggctgcagaaggtggacccaggggctgcggcccagggaaaggctcccctcctccctccggtctcagggtgctctccagggccaagtctccccaagtcatgccttctttgcagaaataggccctttgcccttacctttctccatgcggaaatctaaccatctgtgccagcctcaaagggaaggcatcttaagactctgatctgaagatctagtgtctcttaaaatgactgacatggctgctgagagggagaggaggagggaaggtgaggagaaggagtcagaaatcacctctcctgtggtcattttcctctccctgtggtgggggccacggtgctcctgtcaaccccacaacaggccagggccaggtgctccacctgctggctcctgggcagtactggacagaggcccaacttgttcctgggcccagaagggctccaccctccacggaaacttctagaagggaaaggaaaggtttgaggaaagagcaggaagtgaggaaccaagcgttggctttggaactcaggcctctacctttccacttaggtcaagaagccgttcaggattggcagatgtcaggacaggaagcctagccagttcaggggcatgtgtgcacaccgtggggctgggcctggtgggctctgatgcacccaactacacccatagtgacgaggcaatcactgctgtggatgagggaggccacaggcctggactggagccgctcacctggctgcttggcagggagcttgtgacaaaaccagagaaacctagctcaggattccagctgccactgttcctcgccctcctggaacacatgtgcaccctgcgggtactgagcacaggtctggaccttcttgacatttcagtgcagggccaagggtagggggtttcttctgagcccaaagggactcaggtggggctgtgtcctgtggctgtgggagagcgccaaggtgcctcagggggtgcctttcatcaaagaagtgggacatgtctctgggccttgccattaggggctagttcattctctcaacggggctagttcattctctcaacggggccctctggctcgcctgcatctccagcaggggtgggagcacccttgcctatgtctaggacaggaagggaagggtgagggtagagtgggtgcaggccctgagctgggacccaaggtcttgagataaaaccatgaaggagcagctgcccgggctctaagcccagtgggctcctgtcttgatttagccccagctgtcaagactggggcctggtgatttgtggagtcagtggaagtgcctgtccttcagagagcaggttaaagtctggccttggtaaacaaagtcattcactgcctattcactcaacacgcacgaattgagtgatgactctcagcctggcagggttccaggttctgggaacgtggagattaatgaagccacacctgaggagcacccagcccaggaggctgctgtcagtaacagaccaacaagcatttcttgagcacctactaggtctgggcactgtgggtgccttaaatgagtgagacatggtcccaaggcacttgtaactttcagccccagtaacctctgggccagagggtgcatggtcagggcgagcgatctctaggaacgggggcaagtgtgtcctcactgcctctggagggctccatgtggagcagctaccgagctggagaaggatggctaggggccctcaggtggagccaggtggcagggggacagccccaggcaaggtggcatgcctccccaagccagggtctaggagccacacagagaagcagaggaggggaagcagctagaaaggggccctgagtgccagacattattcggacaaactagcaccttccttagctgggctttggaatatcatcctgttagttatgtgcaaaatgagacaagaggtgggtgctgggaaagcggctgggaggcggggttgacgtggatgctaaggagactctggggcctggggatccattgcaacctcccagggctcagctctcattgtgcagctgggccaagacccatgtgtctgggtcaccggggtctgtggcaggggatgggcccgctggtcatctcaggacagtggcttcaggaacagacaggaagctgtgaataaggactggtagccgtttggtcccatgagaaacaggaggaaggaggaaagtatggccaaagttttgagccaggatgaccaggaagatggagatggtgtccaccaagatgggaaggtaagaagcaaagcagctttgggaacaagacgaggaagtgcgtggggccagagggacttccaggcaccacgtagagacagagctgggcccaagagagggacggaagctagaaatccatctggggatgcttgtaaggagctaaaagttgaattatactttaggccccatcttggctgtgggcacacggtgggaggacactgagcgtcacggtgggagcattgatgccatatgccaaggggtggaggcaccagggagggggctgggggccaaggggcagccagcccagcttcagggcctgaacctcacactaggaggctggaaaggtgggctctcccgaaacctcagcccctgcccagccaacactggcagcaggcgcccaggtctggcttgtgttttccatattccggacgaggtccccacgagatgcacagccaacatacctacacagagggagccactgtgcccctacctcctctgcgctttcccctttttgcttttcttttttttttttttgagatggagtctcgctctgtcgcccaggctggagtgcagtggcgcgatctcgggtcactgcaagctccacctcccgggttcacgccattctcctgcctcagcctcccgagtagctgggactacaggcacccgccaccatgcccggctaatttttttgtattttttagtagagacggggtttcactgtgttagccaggatggtctcgatctcctgacctcgtgatctgcccgccttggcctcccaaagtgctgggattacaggcgtgagccaccgtgcccggcctcccctttttgcttttcttatgatgcatcctaagccttcagtgcacagctgccttcccttggggacccctctctgaccacacagtgggacctcccagccctaaccatgctcctgttacaagctacaaagccagctcttccctgttgtcctgggatccaggttctgggtctgtccctcacgttgcctcggcttaactctgagcctttgggctttggccagcccttcctggacctgtcaccctgcattgtgtcactaatgtcaccgtgagtgcagcaggaacagaaaggtgaggtctgggggtgactgagtggaaggggatatcccaggcagtgatccacgccataggagaaaaacccatgcacacggagaaaagataaccaaggaaaaagctattccttcccctccgacaggagcccccgaggacaggccccaggagccccggaaactcactagccctgctggccaaatgaccacttctacatgctgtggacgactttagcaactcccttctgcccgcagcttctgaaggttccctttcagggccacgaggggccttccgaggaggtggcacagctcagctgccagggaccacctgagagcccgggaggaccatggttctgggcagccgtggggagaaggaaagggtgcgggcagaagctcaaagccaagggtttggccacagactataccccagtcagagggaagaggctgcgggccctgtgctccatcccagggagccctgtgggatgtttctttggggagaaaagggaagggagggaaggggtgtggagggcggggcagtgcctgggctggaatgttgcagcttctgttctccaaagcagctcctggagcgcctgcctgcggctctggctgatctgataagatgtgacaagaccgcctgaaaaatgttgaaacctgtaaaatgtttaaacctgttttttgttgtgttgtgagcatgaagtgctttttccttctttcttacccaccccccccaccccttcatttcacaggaaagtgaagttgataagcctggaaaaagggaggagggtgcgagagagggattgttgccttcagccaaattgtggtccggggcatggagcagtctggtgggacctggggaggaggaaagagagtggaaacaggagggaagaggggacaagaggtgagaggagtcaagggtggaagaaggaggaggacaggagaagcgggggatggaggggtcctgcacccctggcctgctcagcagccccagcccatcctccccaggaccaaacacagtcccccacttggcaccccagaggaaccccagggctgtgggtctcttccttcaggcaggggattcacagggaagggcctaggcccagaggggtgtccagagacgggtaaaaggcagggacctcactcttcagaccccagagcgtctccctgagaggcaccaagcccacaggtgggcaagtgctgcctggtgaccacagaggggagcagctcccaaggacacatgctgagagctgggtccgtttctccactttgctgcgcagttcaggactcccaggtaaagcccagatgccctgtgcgtgctcaggtagggtcccagccctctgccttcagacacacaaaggggtgccgtgctctctgttactgaggatgtcatcaaggcccagaggcctacttggggtcacagcatttctgcccatcagttttgggtgattgtcatacagctccccctaaatgtctagtcttggcaactcaggggatgctgaacattctagaacattctagaaaccctggtgggcccaggtgtctctgggggtgctcatcagtacaaagatagatgttcagtaaaggccatttttcttttcttttttcttttttttttttttgagacagggtctcactctgtcacacaggctgcagtgcagtggcacaatcacagcttactgcagccttgaactacttggctcaaccagtccttccacctcagcctcctgagtagctgagactacaggcacatgccactatgctctgctaagtttttaaaattttttgtagagatgaagtcctgctatattgcccaggctgggtttcgaactcctgggcccaagcaatcctcccacctcagcctccccaagtgctgggattacaggtgtgagccagcgtgcccagccaataaagacctgttgaagaaaagtctccacctgtgaaagttttcttgctattggagtagggcgggggcgggggaacaataggagtgtcctggaagggctttaggagcattctgtaaatggccacgcatgttagtgattctattacagtgttaggtcataaaatgtcaaagctaagcgggacctttgacatcacctagttcagctccttggggaaattaaggcccagggaagcgatgtgccttccctgctgttcctccactggttggaggcagtgcagagagcacagcccaggcctgctgactcccagccagagcttgtctctctcatagcacgcagatcgttcttgaagtgccccagacctgatcatctgaaggctgggcctcattcagtacctgcatactatgtgcccaagatgtatgagatgtagcctcggccgggcgcggtggctcacgcctgtattcccggcactttgggaggccaaggcaggcagatcaactgaagtcaggagttcgagaccagcctggccaacatggcgaaacgcctgtctctactaaaaacagaaaaaattaaccaggcgtggtggtgggcacctgtaatcacagctaccctggaggctgagacaggagaatcgcttgaacctgggaggcagaggtttcagtgagccgagattgtgccactgcactccagcctgggcaacagagtgagactctgcctcagaaaaaaaaaaaaaaaaaagatgtagcctccaccctcctcagtgaccccacctcagtgcaggtgaccagtcagttgcagagtgtgagaagtcccacttgggacttcaaggaataggggtgctgaggggaaggaagtgggagaaggcaaagaagtccccttcaaagaggtgacattcgagctgggccttgaagttgagctcagcttggccagcttttcctcctggagcttggccatctgtttctttgcctcccactccactaagtggaattctaattcaaatttttcctaagccatgtttgcatctttagttcattttaaccttgtaacatttctccccttcctgacccctccaaaccctaagtcagtctcccattttacagattgggaaatgagaaccttacagagttaggctgccgttctgagcagccaagtctgctggttcccacaccaggattttgctgggtccccacattgctatacccttcaagccagttctggtaaaagacaagacatagcctgcccagccctcttgttcgcttctgactccagacttctattcatccctcaaggtcccatgtttaaatccccttttaatgtctccaattcaaattgttccctctggccatttccccagctcttatacatccgtcacaggtaaccttcaatgcactcaagtgcattgtccaccgactccattgatggtgagttttttgagaggagggattctttcactcgtttccatgtagaatctagcacctgcttcagcaggtgcagtggccctgcgaggacctccctgcgaggacctccctgcctcctttcactgccctcagcagccccactgagtgcccagtcctttccttcgtctctcccaggtcccacaggctgtctccacggcgagctgagggcaggtgatggccatggccctgctggctctctgggccttttaacacagctgctagctccacagtttgggagtcctttgtttgaatcttagaagcagcccagtggggaacacacaaagctgtgctgcttggctgggagctcactcttagagcagctccccagggctcctcagagagccaccagcctggtgtgtgtctttattcaataaacattcacgctgggccaggccttatgctggacgccgggagcacagtgcgtggggcactcctggtcttgcaaggactcttacctgaacctggagctgccctgaggaagcccattctcctctttatgggggcccagaggccaccctccctgcctcacacctgatagcactggccaccagggctggcacctacctggactgtcccatccactctcttattctatgctcttcagaaaaccaaggacagtccctgaccagctggctactggggtcagggatgcaggctatacactacagcagatcacttggggtggttttgaaaaatacagacacccaggctccaacaccagcgtggcaggatcagagcctctggagaggagtccaggaaactggatcattaaaagcctccaccagaagtgtgacagtagaatggtatgagatgatgcagcaggaaggccccaaccttccctatgatgttctttggccaaagacgtttaatctgatctaaccaagctttgagaggtaacctcttgttatcagggaacacaagggacagaggaacaaaccaaatgacaccatggggaagcaactggacaaattcagagcagggtttgaacccagggccttgccagctggagtactaaaccatggctgggcactttgaggccacagtgcactggacactgcccagggctccagcttggacctccagctgggcctggccctggccctaaagccagcagtggcagatgcgcacgcaggaggcagctgcaggttgggaggcctcacgggggatgctgcgaccacacccaggtgctcagggcaacgattccactctctacctttcaaggtgggtatttccaccacattcccaggagggcttctttgcgcctcatccccccacggcgctgaggatgggcaggtgaagacagccctgcccagcacctggacttcccccactctatttagggaggccccacccaagttcaaagcgctggctgcccctcccttgcagccccattctccatccccaggcgaggcagtccagagcgagcctcaacattttcctctgcacctccttcccccaacttcatcagtccctgccacccattcctccgcaggctccttgctttagctctgtcctctccttgcaacaggcgcctgggtttgcaaacatgcactcagcacctgttaggagccgaatctgggttcattacagacccacgcaggacttcattacacattccagcactcagcagggtgggccattggttctcatccctggctgcatagtaagtggccctgctgagcttagaaacaaggctgcctgggccccctgcagagaaagggatttaagtggtctaggtgctccctcccctctgtggtatcctccctccctccctcaaggttgagaagcactgccctaggtcacagacagggctggggacctgcccacagccccaccctgggtccacagctggggctcctgggtcctctgccctccccctgggccccacctcctattcccagtaccagtccctccaagttgttaggatcaacccgtcccctgttttccaacctctggtcttgtccacttcctctcccgaagtagccctcccccatcatctctctccttggcctctcagcaaatctccatgttcacggccacagaagcaaaacttccctgatccagcagccatgaagaagaagcatttgggcacgcccctccgtttccgtccaccttggcagaaatcagaggccggctactgcgctcgcgttttatgtgcgttccaaaacacacgctcacgtacatcggaaaaggacaggataaaagatgtgtttcaaaagaaaccttttcctcctgcagcctcatgcgtcatctggaaccccctgcccaggcctgactcctcgtttcctctggggttttcctcttttcttttcccttcttcctggtttccccttagctttcttagctgtgcagtggggtgtatctgtttgtgagtaggtggaagttctgtctgcaaaggtacaggatgctcacactctttgggttcaaggcagcaagccttttccctactgggttgggggctccacaccttccttggttcttgcctgcagctacatttccccccaacccaggacttcgctttccttactcttttttttttttctgagacagagtctcgccctgtcacccaggctgtagtgcagtggcgtgatctcagctcactgcaacctccgtcttccaggttcaagcgattctcctcctgagtaactgggattacagacgaggaccaccatacctggctaaatttttttgtatttttagtagagacggggtttcaacatgttggccaggctggtctcaaactcctgacctcaagtgatccgcccgcctcagcctcccaaagtgctgggattacagacgtgagccaccacgcccggcctcctcactgttttctgaccagaaatggtccactctgctctgcagagcctcacctcctctcccactcccttccttcccctcactgtgtacaacaccctgtcactccaccaggccaggcatgccctggtaagggtgctggggcacagggagtttctgtaatttctgtctgcattctacttacattcatcacagaagtaggaaggcatttcttctgggggaaacacacgttgtgtagaaaagataaaatctctctctctggcatggtggcgcatgcctataatcacagcacttcagaatttcgaggcagggggatcacctgaggccaggaatttgagatcagcctgggcaacacagcgagacgctgtctctacaaaacacagaaaaattagctgggtgtggtggtgcacacttgtagtcccagctactggggagactgaggcgggaggatcgcttgagcccaggagtttgaggctgtagtaagctgtgattgcaccactgcactccagcctgggcaacagagtgagatcctgtctcttaacaaaacaaaagaaaacaactctctcttacacatacatagaaatagcgaacatttaaagtcaaaaaattctaaatctctgcaaatgggatgtgtgttcgacacaaaaggcaaaatgtcagtgcacattagccccagttaaggttcccccaggaatcaccctggcctaagagaaggctcaaatcaccatgggtgggaggaggtgtcctccagaggggggatgacgtcatggagcacctttttggggacactcaggctgtgaatgaaataaagaacgcttttacaggtgattacccataatgaataagataaggtggggtacatttatttgggtagagagtggctaataaggtagtgaagaacttcaccaatttcctcaactctgctctaagtaaggtagtaaggagcctattcactgaggcactcagagtggccattttattatttttttgagacagagtcttgctctgtcacccaggctggagtgcaatggtgccgtgttggtttactgcaacctctgcctcccaggttcaagcgattctcctgcctcagcctcccgagtagctgggactataggtgcatgccaccacacctggctaatttttgtatttttagtagagacagagtttcactatgttgaccaggctagcctcgaactactgaccacgtgatctgcccacctctgcctcccaaagcgctgggactacaggtgtgagccatcacgcctggccagtggccattattaataataatagttaacatttattgaggcctgactatgtgccagttgccatgtaaagcactttacatagaatacatcctttaatttgccaaagaacccaatttaacggatgatgacatgggctcagagaggccaagtgactcgtctaaagtcacatagctaggaaatggtggcactgagatggcaaaaaaagcagtgagggctgagggaggtggctcacacctgtaaacccggcactttgaaaggccgaggcgggaggagcacttgagctcaggtgttcaagactagcctagccgagaaagcaagaccttgtttctactaaaattaaaaaaaaaaaaaaattagctgggcatggtggtgaccacctgtagtcccagctacttgagaggctgagttgggaggattgcttgagcccaggaggtcaaggctgcagtgagccaagatcgagccattttactctagcctgggcaacagagtgagaccctgtctaaaaaaaaaaaaaaaaaaaaaaaaaaaatgaggggagacatttaccaggacagggtttatagagagcatgttcatggaaggctaaggagaaagggaaggaagtgctcaggtcctgctctgctgctccggccgctgttggggttaacatccctgtaaattcaaatgctgggctcccgcctatcagtcttttttctttcgaatgttggtgcagatcttccgcactggaggtccatttctctgtgtctcagacaaggctggacccacgcccaaggcattgcaggaggagaggagacccccgacctgagggctggaggcatttgtgtgtgagacaggacaaagaatttcaggggaccagagaattcaaggtggcagagggttaacaagacctctcccaagacaacacacccagcagatgctgacaaatgtgggcaagagttcctgagagagaggccagggtagatgacacacgttcccagcaccttccaacctgcaaagcatttcctcacacagcttctccatgaatcctctcaacagccctgagagtagagatgccggctccagtttaccaatgacagattgccatcggccaggaagtggaggtggagttggaccccaaatcccatgctatcgctattttgccactctgtccagaccccaccctctggagataaccagtttatcccagcagagtgcatttattcggcacctgctatgtgttcttcactgaactaggcacgacggggacataaccaagacagtgtcacacggtgaaatctaacaggcatgttcatagggaacagcaggaggttagcaaggggacagccagcttataaactctctggtgggaggggcgtgggggagagcaagtgaaggaggacatagaacaggggtgggggtggataaaccacaagacctcaggggactgtgccctgagagaaaaggaagaggatgggcatttctgggacattgatgtcacataaaactccaaaacccaagggaccaagaagaaaggaggccagggcctgaggtcctgctgatgagcttcaatcttactagcggtgaagaggggtcaccatctatggggctgaaagaagcccaggccctatatgcaggctggatcccccgacaggacctgtcagagctagaaggagccttgggggtcatctggtccagtttgcatattgcacagggctcagagctaaggccatctcactgggctgaggagccaaagaacatagtcagctctgagaagggctcttcaaggctggctctcctttgtttgcagaacacactgtaccaccgtggagaggataaaaatctaaaattcagcaccttaacccattctcacaccagtcaaactttcgacagtcctattggtctatagatgcctgggaattccctcctttcccaggtcaggaagatctcgacctccttccaccagcttcccaggactttcttttctttctttctttctttttcttttttttttttttttttaacagattcttgctctgtcactcaggctggagtgcagaggtacgattccagctcactgcaacctgcacctcccaggttcaagtgattctcgtgcctcagccttccgagtagctggaattataggcacccaccaccatgcttggctaatttttgtatttttagtagagacggggtttcaccatgttggccaggctggtcttgaactcctgaccacaggtgatctgcccgcctcggcctcccaaaatactgggattacaggtgtgagccaccatgccaggcccttcccaggacatttctgagacacctggtgggaattcttacctgcttacctcacctgtgtccctctgagccaccattttggccctcatttcccaccctcgggtgctgagggaattgttccctaccaggaatgaatccccaggcttgtctgctcccccataaacaccctctggaatgtgcatccgaaacctcctaccccacaccagcgcattcagcccctctaccggcgccccatgtctcactcccctggtgtggccagaactggggatggtgcaagaataaagccctaggcagtgtggaaagcagacagctgaccctgtgacttctggggctcccctccgaggtggggaagaacagaggagctggcctctggggtctgagaagaccagccggcccgtgggcaaagggacgacagcaaattctcctccagtgaccctcagcccctgacgccctgtctaaccctctcagatccaaagctgcgagccctcaggaacatgtggctacctctaacccagctcacttgcctggttaaaagcaaccacaggtgtccagcctgcaaacatttcccggcacacagggccctgtgcaaggggcagtgggtgacgacaccaagcccagttccggagcaccctgctgttctgcggcactgctgactcacaagcgattctgccgctgtgcagtctcaaagccagccccacccggggatctctgtcttccttggtctgtcatgaaggtgctagtaacccccaggcttctcagataactccttctccttcacttgtgcactcttgctctctgtctctctctgtctctgtctctccctctctctctcacacacacacacatgcatgcacgcacacacacgtgtgcacacatgttaaattctaacccttgcagtaccatggatttccattttgttgagatgaatagaggattaaaaaaaaaagaactgatcaggttgtcggcagggtaattatcagtaaaaagaaacagaggagctgtcccatccgcaggtggtaggtggcaccctccacgcctgcaggccagggctttgtgatctggctgaccccaatcctgatcttattgctaccacccattaccacgtctccttgggaggactcaacttcctaatgagaaaaacatcccccacttcaaagaggctgcggggaggaagaattgaaatgatgtagataaagcttttatcacagtccctggcacatagtaggtgcacaataaatgttggttgccattgtcatagtgctaataaagaccagtgacatcctctatgccaggcactgtttgtgtgcttgccgcatattaaccccataataattctgtaaggaaggtatgttatcatcacccctatctcagtggggaaactgaggcagagattggcccacattacccaggtaattagggacacatctggtctggctccagaggctgaagacttaaccacaatgttctcctgcccctctcagaaggagttggatgagagatcccatctgtatgtcccactcggggcacacagagaggcaagcgcaacttggttcctgccccgcaggggctcccagcctcattgggtgacagatcctaaaaatgcaactacaggggacctaagacgggagaatgattcaccagccagacagcccgggtgtcccctggtgcaagatgagcggtgcctgatcagtccctggttcctggctgctgcataggagagggggctcagctggatggctgactgattggctgactgcttcattcattaattcctgagtgcattcattcattccttccactcaagccctccagaaagggtggtctggactgaactagtttacacgggatgattacaacagaagtcagaggactctcagcttggttaccgaggaaaataagaccacaaaaccaaactgactgaaataggcaggagaatcttctcgatcccattttccaaatgggggaaaatgggaaaagggctccaaggttaaatatttttggaaaacaagttaaacaaataaaaacgggtcacactggtaggacctctcagtgctgcaactatgctaatgagctgctaatattcaaatgagaacaataaacaccaagaggctccaagttgcctgtggcgattcttaagtttatttgactccagaagcctttctcaacaggattatgtggggctgatgttataagaaacacactatgcgatgtcctactctggcccaagagctgtctggaaaagctgttccaaaaacctgggagagagtggaagtgaggctgagaggactcccaggaagacggcagctccaggctgggttttgaaaaatcctgggaagttcagggccaagtggaggagggaaaggaaagagttttccagtagggaatgggatcctgagagaaagacggtgaaggcccaaggcagtggagtcctcaggagtgggcttgcctcgggcgggaagaagggccttgggccatgggaaaaacaatctcaaagatgacagcacagatgggcacaacctctttggaaaacagtttggcatcatcttgtaaagctcaacattcacacatcctgcaacccaaagttccacgcctaggcaggtacctccatgaacacctttccctgctgtgcacagcgagatgcacatccatggccaggagacaaaatagataaactgtatattctaaagatggactattatgcaactgtgagcatgtgagaactacagcaagatccaggaacagtttgaaacttagaaacacaatgcagagagagaatagctcaacatagagggccacatgcagtataacaccatttttataatgctaaaaataggcaaaataaaacatttcatttaggcattattacctgggaaaaccagttttttgtttgttggttttttgtttttttgagacagggtctccaggctggagtgcagtggcgtgatcccggctctctgcaacgtctgcctcctggattcaagcgattctcctgcctcagcctcccgagtagctaggaccacaggcgtgtgctaacacacccagctaatttttgtatttttagtagagatggggcttcaccatgttggccaggctggtctcgaacccctgacctcaggtgatcctcccgcctcggcctcccgaagtgctgggatcacaggcatgagccactgtgcccagccaaaaaccagtatttttaagtaatggaataaataggtaaaattcaggatgtggtcacatctagagggagatggggaatgggctgaggaggacccacagatggacacgacggcctagtcacggtctggtccttcagggacatagtgaggctcaggttttcattctgtcatcatgtctaatatatatgattgttctcttgtatatgtcaagtattatgtaataaaaatatttttgatcagcttgcaggagaatagctggtatctgcttaggcttgtgccagccataccattggcacatcagctcttcttcaccctgaattccttctcagagtttagcagccctctctcgcctaaaggttggatgcacacagtgactgccagccctggatcagcctgcatcccacccaggcctcctgcacttccagccacactcactcactgtgcttagcaagggcttacacagccagtgcctcagccattaactagggtgatattaaatctacacagaccactccttggaacccccataaaaatccctgataggctgggcgcagtggctcacacctgtaatcccagcactttgggaggccaaggcgggtggatcacgaggtcaggagatcgagaccatcctggctaacatggggaaaccccatctctactaaaaatacaaaaattggccaggcatggtggtgcgtgcctgtagtcccagctacttaggaggctgaggcaggagaatcacttgagcctgtgaggcggaggttacagtgagccaagatcacaccactgtactccagcctggtgacagagcaagactccgtctcaaaaaaaaaaaaaaaaaaaaatccctgatagctaaccacatttaattcacccttcccttcctgagaactggaggcctttgtgagtactctggctgaacaggataccagaacgcaaggtcatgccagagtctgcattgccttttgtccaccaagtcacagacttctgccacatgcctccccacccgcttctttcttcagataggcttattggttgggacaaaccaacataaagtgtgtgggattccctgaagccagccttttctgttttggaaggaattcagatctttctgctctaaagaagcctggcctgggagagaatatttttataaccctgctacattagatgacctgtagaacatctttaatgattcaccttcaactcagtttctattatttctactttttttttttttttttcgagatggagtctcactctgttgcccaggctggagtgcagtggtgtcatctcagctaactgcaacctccgcctcccaggttcaagcgattctcccatctcagcctcctgagtagctgggattacaggtgtgcgccaccatgcctggctactttttgtatttttagtagagacagagtttcaccatgttggccaggctggtctcgaactcctgacctcaaatgatctgtccgccttggcctcccaaaatgtagggattacaggcatgagccactgcgcctagccagtttctgtctgttatttcatttcaacctcacaactaccttgagatcatattttttattcccattatacagaggaagagactgagactcagatttttaagcaaccacccaaagcaaagttctagaagctatgaagtggacatctgggatttgcaccacaggtggttctgtcacagagcctaccctctttctggagtgctatgttgcctccccacaccaaggttagatgcccagagccggacttcctgggagatcacagagtgaggggagtgctgtcccagagagtggggaccagctgagcctgaactgcagcctgcttgggaaggagtctgattcctgggccaagtgctaacagaattcctatttatttatttatttattggagatggagtctcactgtgtcacccaggctggagtgcagtggcgcgatctcggctcactgcagcctccacctcccaggttcaagtgattctcctgccttagcctcccgagtagctggcattacagctgcccaccaccacacccagctaatttttgtatttttagtagagacggggtttcaccgtgttggtcaggctggtctagaactcctgacctcaggtgatccgcccacctcggcctcccaaagtgctgggattacagatgtgagccaccatgcctggcctgataacagaattcctaactgtgctcctgcaacactcaggatgatgtgtgaggctcgctagtgatgcagaggcctacagagcagaatccctgccctcaggggctgactcttaacactgggaagacaagacagatgcacatgaagaggtatctgagaatacaggaaaatacacaacaagtaccagctggtcttcctggcagagcatcacagaggcaatgagaatccagctggagcagggagacaagagtctgggaccagcaggtgactctcaacagtgtcctttcatcccacaacctgtctttgaggatccactgtgtgccctgtgctatgtttggtggtatgggttgaaagatgatggagaactggtcctgcccacaggtgacttacagtctagtccatgaaatagatgtgctcagaagggcctttgctggggccgcggtgctgagggaaggctgcgcagaggaagtgatggctgaactatgatttcaagaccgaacaggagtttgtagtcatcccaagagaaggcagggggtagcacagaggcacggagaagtgaggtgtgcacgagaacaacgcagactgtaacatgaaattaatgtcagcaaaatgtgtgtctaactcactgagtacacacctgaccctgtgctagtctcacatgcgttatatcctttcatcctcacaatagccctcgttatccccattttgcagagagaaaaccaaggcttggagaggtgaagtccacccagataaaaaggcagaaccatctagagtccaggactgctgtacccaggcccatgtgcttacccatgttggggttgggagaggagcgggtgcagggcggcaggggccaggctgaggagtatacaacaacacagtcatatctgctgctgctgcactcctaattagaccgtttaaaaatgaccaaagtggccgggcacggtggctcacgcctgtaatcccagcactttgggaggctgaggtgggcacatcacctgaggtcaggagctggagaccagcctggccaacatggtgaaaccccatctctactaaaaatagaaaaattagccgagcatggtggcaggcgcctgtaatcccagcaacttgggaggctggggcaggagaatagcttgaacctgggaggcggaggctgcagtgagctgtgattgcgccattacactccactctgggcaacagagcgagactctatcttgaaaaacaaattgaattgaattgaattaaattaaattaaattaaaataagactgactaaactgatcagaaaagaagatccgttgaggctgagaaaggctaaaacatggtccaagtttaacaaaaagggacttggaggtaagtgaccacagctgtgagggagggcagtgccactgtgggtctgccaagggagggatggagatgatgcagccacattagaggaggcaagccttcttcccgatgctgtgccagttcgaccctagtggaactgtttccccgccaagccctaaggcctggctgtagcattgagaccactcaacgaagcctcatctaccatgtgcccagtattgaaaagtttcatgccagattcacaaactgttaaacataagatattctatccagctcattaagctgtacactgacaagttgtgtgctcgcctgtacgcatgtttgtgatattataaaatatatatttggtcttcgacctagtttcccagcgtacaactcctaaaatccttagaaactccaaagtgatgtctttttgtatgctaatgagctgacggaagagctggcagcccctaggcagcttcaagattgaggttggttaccccaaaagacccaggcaggattaaagggttggactttcttttcttttatttatttattttgacggagtttgactctgtctccctggctggagtgcagtgttgtgatctcagctcactgcaacctccgcctcctgggttcaagcgattctcctgcctcagcctccccagtaactgggattacaggcacctgccaccatgctcggctaatttttttgtatttttagtagagatggggtttcaccatgttggtcaggctggtctcgaactcctgacctcagatgatccacctgcctcggcctcccaaagtgctgggattacaggtgtgagccaccgtgcccggccaagattagagggttggactcccaaccctaaccccaaccccatcctttgggaaggggagagggggctgaagattaagttgatcactagtggccaatggtttaatcaatgatacctatggaatgaagcccccatacaagcccaaaaggacagggttcaagtgcttccggatagcggaacacgtggaggttcctggaaggtggtgtgcctgggaagggcgtggaagctcagtgcagcttctcccatacctcgccctatgcacctcttcatctgtatccttgtaatatcctttataataaaccagtaaacgtgtgttcctgtgttctgcgagccactctagcaaattaatggaacccaaggaggaagtcacaggaaccctgatttatagcaggtcagtcaggagcacatgtaaagcagcctggggcttgggattgctactggaagtgggaggctgtcctgggaactaagacctcaacctatgggatcagatgctatgtccaggtggagatcatcagaattgaattggattagaggacgctggctgatgtctgccgcagaattgacagcttgcttggtgtatgcacgcatttggtcacagaagtcttctgtaccaattattgcagggtgaaagcagaggaaagacagtttacgtcttttcctgtactttcattaaaaagttaatcacttggccaggcgtagcggctcacacctgtaatcccagcactttcggaggcccagacaggcagatcacctgagctcaggagtttgagaccagcccttgccaacatggcaaaaccttgtctctactaaaaatacaaaacttagccaggtgtggcggtgcacacctatgatcccagctactcgcaaggctcagggaggagaatcgcttgaacctgggaggcagaggttatagtgagatcgtgtcactgcaatccaacctgggcaacagtgcaagactatgtctcaagaaagaaaaaaaaaagttaaacaatcattctatcctcctatcttggcaaaaaccttacttgccacctagagggctaggttacctgataaagttcacgctagacaatggtgacatgggagatctagccccaggcctgcagcctgcccatcccttctgcatcccatgctggaggccccagccacaccctcaagctccagccacagcccttgcaaatgaatttcccttgaccagcccttggccacaggcagtgtggcctgccctggcagaatgggccccaggcagaggcctgcagagcccggaagcaggctcacggctgtctgggccagatactccaggagcctaaattctcatggcgcagctgaagagggtgggcacaggctgtaggcgggcatttctccctgaggacccagcatgccttctcctttcaggtaaagcgtgttttcccttatgtcctggctgtgaggaaactcagggcaagctccatccttgcacctgcattgaccttgacttgcatatttgtcttctccttgaccttgatcctgctcttctgtttttgttatttatttttattttttgagacagagtctcactctgttgcccaggctggagtgcagtggtgtgatcttggctcactgcaaccaccacctcctgggttcaagcgattctcctgcctcagcctccccagcagctgggactacaggtgcgtgccaccacacccggctaatttttgtatttttagtagagacggggtttcagcatgttggccaggctggttcgaactcctgacctcaagtgatctgcctgcctcggcctcccaaagtgctgggactacaggcgcaagccaccacaactagcctgtttttattttgttatttaatctgatgtgttttccgtcataagcctcttgagggcaggcatgctggattccagactccctgccctatggggaagggaagtgctgtaagacaccagacggaagcctctaaatcagagagctgatggcaggccccctctttccctgatttaaaggcaattctgtggctataggacttgcaggaagttgtagaaaagctggtaagagatcagaagaggaagaacaagtagttaaaggtgagtagaggatgggtcacctgggaggaattgttctagagaaggaatgagagatgaggccagccggacttcctgggtcaactggggacttggagaacttttctgtcttacaagaggtttgtaaaatgcaccaatcagtgctctgtaagaatgcaccaatcagtgctctgtagctagctagaggtttgtaaaatggaccaatcagcactctgtaaaatggaccaatcagcaggacatgggctgggacaaatgagggaataaaagctgcctccccgcccaccccccccacccccaagccagcagcaccaacccccttgggtcgccttccatgctgtggaaactttgttcttttgctcttcaggataactcttgctgttgctcactcttggggtccttaagacctgtaacactcaccgcaaaggtacgtggcttcattcttgaagtcagtgagaccacgaacccactggaaggaaccaactccagacacaggaagattcagggatgagacgaaccctggtcctcaagtgcaaactggaaccctacccctggaatcccagcactttgagaggctgaggcaggaggattgtttgagtccagttcaagcaagagtaatgtagggagatgctatctctacaaaaaaaaagaaaaaaggctgggcacagtggctcacgcctgtaatcccagcattttgggaggttgaggtgggcgggtcacctgaggtcaggagtttgagaccagcctggccaacatggtgaaatcccatctctactaaaaatacaaaaattagccaggtgtggtggcgggcgcctataatcccagctacgtgagaggctgaggcaggagaatcgcttgaaccggggaggtggaggttgcagtgagccaagatcttgcaattgcactgcagcctgggtgacaagagtgaaaactctgtctcaaaaataaataaaaataaaaattaaaaaaattagccacatatggtgcttgcctgtagtcttagtgatttggcaatctaaggcaggaggatagcttcaccccaggagattgaggctacagtgggctgtgattgtaccactgcactccagcctgggcaacagagcaagatcctgtctcaaaccaaaccaaactgaaacttgacagtgatattcacatccccaggaagaaaacctgggcctggattaaggaaagactgaagtcagatctaaggaggaacttcctggctgtggtgtggtgtggtgtcactgaagggcctggcttcaggcagtttgtctcttgtttagagctctggggtttaccaaccatggagccttcggcaatggaatggtgcctcagggcctcagtttctcatctgtagaatggggataacaagagtctctgcctcctggggttgtcgggaggatgagctaatgtgtgtgctttgtttcctcaatgtatgtgatacccgggacatcataagcgaggaattactagctgccactggagccgcccacttgcttccgagctccttacagctcctggttgggtcctgtgatcctcggttttctttttttcttttttctttttcttttccttttttttttttttttttttgagacagagtttcgcttttattgcccaggctggagtgcaatggccaggtctcagctcaccgcaacttcagccctcggttgaagcgattctcctttctcagcctccccagtagctgggattacaggcacgtgccaccacgcccggctaattttgtatttttagtagagttggggtttatccatgttggtcaggctggcctcaaactcccaacctcaggtgatctgcctgcctttgtcccccaaagtgccggggttacaggcgtgagccaccgcgcccagctgagcctcagttttctcacaggtaacatggggatgaagaggctgctttctcgaggctgctttagcttccaggacagtgcagaggtcacagactccatccttactggtagcagagaaaggctccagaatcccctatggaagcttcagttaagatggagaaccacccagcctgaggctagacattctctcctccgaagtcagggactgggtggggtgacctgcacatgtgttgcccaagggcagaagcggaggggaggggagagccggttagagttgtgaggacaccttgctgggtgaatggggagatccctggccgccgctcccctctgctcctccttggggctccatctgcagagtggggcttggccctcacgatggctgctggggacgggagcagctctgttggagagagggtgggtgctacctgggcactccgtcacctgtggaatggtggcaatagcaccgtcggcttccaaggcaagggagggtgggaggaaccagttgtgaagggagccaggggtaggggtggacatagtcattggccaggaacgagagacagtccctagaggaagattaggaaccaacctcagctttagagtggagaagatcatggaggaaaaaaaagaggcgacttctctgaagacaagacctttgtagacttggggaaaagctgacagtaaagaaacagaaagaaggccgggcctggtggcttacgcctgtcatctcagcactttgggaggccgaggcaggtggatcacttgatgtcaggagtttgataccagcctgaccaacatggtgaaatcctatctctactgaaaatacaaaattagctgggtgtggtggcgcatgcctataatcccaggtacttgggaggctgaggcaggagaattgcttgaacccgggaggcggaggttgcagtgagccgagatcatgctactgcactccagcctgggcaacaagagcaaaactccatctctaagtaaataaataaacagaaaaaaaagaaacagaagcagactggaattctcataactcaaaactatccagtcaggaccaactccctcccagagcaatgtttattttgctttttaattcgcatgtgccttgcttctttccagaaaggatttgaagaggttgacagcaaatgtgtatcccaaagacaagtctttattgaggatccattatgcccaggccaggtacaaagactccaacatgtctgccctcaagaggctgatgacggaaaacacatcagattcaataacaaaataaaaacggaagagcaggatcagggaaggtccacacgggtgcaaggatgtggcttcaggtggacctctgagttttctcatagccaggacataaagggaagcatgctttatcagaaaggagaaagcatgctggctcctcggggagaaataaagctgaaggtcgaattgtaaaagtgaaatgaacaattggctgtttcagagataccaacacaagaattggactagggcaagaaagaagattctgcccagctgctttctagcacgtatatgatggagaccagatgcaaagcagcaaaaaggactaagtagaaggaaagagcttagtgctggaaggaatctgagaggtcatttacgctaccctttctgtttcacagatgaggaaactgaggcccgggaggcagtgatttgatcaaggtcgccccttacccatcccaggggcaacaaaatcctcacatggccactgctgtcagcaactgtgcaatcccagcttgaggacagcctgatggcttgtggaaaggtggccagtgaagaggacacatccccaaataagagacttcccagacgttcacaaatagtatctataagcccaaagcatcagcctttgagtggaaggtcaagtgtaaacttgtctcaaaaccatcctttggggaacaaagtagaatatgaacaagcaaatttttaccccaataacaagtccacaactgagcctgaatggtggtagaaggaaaaaggctttaggtccaacagggtgtgggctcagggcttcccatgccatgcccaggctgcactgtgggactccctatctataaactggcaagaattagattcagataaatcatgatgtctgcatggggatcagcacatagcacatggtcaacaaacgtattaacctgttcctagatagagaaacaacttctgccaattgcaatcttaaaattaatgacttagacacttaagcatcgtgtgaactggtgaacatggagggggaaatagtacacaaataggaaacgtttacaagtggaactgggattaaaaaaaaagaaaaagaaacccaggggaattgacactgtggagaaaaggctcatctccactcctgggacagcagcctgctcaggtcgaggggcccatccaccttgagagaccctctaaggaccctccatagttcagggctgttagctacatgacctgagccaagtggggtccgagctgagcagcgcagagcagactgaccccaggtcaacaggccccaggttgggctgccttttaaagtcagagagaggaggtggaagtatttcaatgaacaagcaaagaggtgagtattccagttgaagtgggttattggggggatcgagggggtttgtgaaagttacaactgcgcaggtggacagaagtgaaatcatagggagcctcagtaccagataggaagaggggagccatgggaggtgtcagagcaggggagtggcaccctcagcaatccaccttgtgaagatgattggtgggagctggagaggaggcgggatcctgctcactcacagcacaagccctatttgcattcctaatgggccctgcgagattggttttccttgccggcccagctggctctggcagataagtgggactctgtgcccaggggcaggtttcccagaaaggtcttccagacagacctgggtgcttggtcctgttgctcccatccccctccccaacacacacgtacacacactcagtcctcgcagtttttccagccgagctggagggaatggcttgtgcctgtctcctagtttgctaggccttacccaggccattaggattccctgatgactacaggcctcagcagagccccttccagctggcagccctttgccctcgcccccctcacctccacctacatcttcccatgtgtccctggttggaaatctcactctgggtctggccagtggtttttgcattaggccaggaggataaccaagccccatgccctgagctgtgaacctgggtatgccccgtgaccagttggcttcagacctgaggcctctgtgccctctcccaggggctctccagtgagcatcaggacccctacaggaaggagctgaggactcccctgtccagccccacttcttcctctgctggaaatatcaactcctcaagctcagaggctcaggggggctcttaggtccattcttagcactgtctgagcagggactagctcttattcctctcctcttttctttctttcttttttttttttttttttttgagacagagtgttggtcttgttgcccaggctggaaggcagtggtgcaatctcggctcactgcaacctccgcctcccaggttcaagcgattctcctgcctcagccttccgagtagctgggattacaggctcccaccaccacgcccagctaattttttgtatttttagtagagacagggtttcaccatgttggccaagcaggcctcaaactcctgacctcaggtgatccacccgcctcggcctcccaaagtgctgggattacaggcgtaagccccatgcccagccttcttattcctcttttctaggactcacagtgatagttaacttctctggaaagaacctgacacttcccaagtgtcctcaggaaggagtcctcagctccttcctgtaggggtcctgatgctcaatggagagcccctggcagagggcacagaggcctcaggtctgaggccaactggtcacggggcatgcccacaaagattattccacctgaagctcttcacggccctgcaagcaggcagggcaggtggtcgtgttattatcatcatccaatttgcagatgagaaaactgagggagggaggagactcatccactgtctcacagctctttgtgtgtagagtttagagctctgcaccccccacccttccctgagaccagctttcagtgaccaccccctccaccaggcacagatggtccaaatagctgggtgacctgaacgcggaatacagcctccatgactgcaatctcggagctggaagtctttggccagcagcttatccaactctcctagttactgagactcagaacagttcaggaagttgcctaatatcaagatggtggcagagccaggtctcaggtgccctaactccctgcccggaagccgcccacctcctcacactggcccctctcgccccagagcccgctctggcatctccttcattccctagatgtatgggtgtgcctgacatttctggaattcactccacacacataatgaggccattttgagaaggcccgcctcagggggaaccagagagctgtctagtgtccccatcctgacccctgccaactcctcccggctgtacaggccaggctgcaaaagggaaatgctgatgtcaactcagcaggtatggaaacagaatgggggctcctgtcaatggcgcggaagtgattgtagctgcacccagtggcattggggtgactctctgagatattagtttgacatgagggtatggggccgtgcctgctggcagaaccgttgtgcacctggggtagccactgtgctcacgagggacaggctgcctaacgctgaagaaccgggtttcagcctctgagcgcaggaccttctctccagcccccatggcccactgagacctgagcaacagaaaaggagcaaacctgcaggcaggccctcccaggcagcagcaggacagggtgcccgaaggagagcgtggagttgcctctcagaagattctagaaactctggctgggtgcggtggctcacgcctataatcccagcactttgggaggccgaggcgggtggattacctgaggtcgggagttcgagaccagcctggccaacatggtgaaacccccatctctactaaaaaattcaaatattagccaggcatcctggtgcgcacctgtaatcccagctactcgggaggctgaggcaggagaattgcttgaactcgggaggcagaagttgcagtgagccaagattgtgccactgcactccagcctgggcgacagagcaaggctctgtttcaagaaaaaaagaaagaaagaaagaaactcaactctgcccaggtgccttagctattccgctgcccagaagcagggaggagacccagtgctccttcccagaaggcccgttttccagcccgtcgccatccagtctcccttggagaagtcccgggagatgggatccagcttccttcctcttttcccaccttctccactcccagaagctattcctgcaatcctggcctagcctctcactgagagcagggaattccctctctggcagcgggataaagaaggaccctgcttagagccgggacagccaaagggacagggagggcctggatggggaggaggcagaagtctggcccctgctgcctccccacacatacctccacccccctacccccgccccaagaatgtaattaagcagcagcttctgccaggagccaagctttctgccttccgactataaatcaccttctgaatcatctctcagctcctagagaagcaacttctgctcaggctgctctgggcggccctggtgccactccccctgggaagcctgcctcccccaccccttctgtgcccagccccctggctctaggtcccagcaagagtctggcagactctgggggtcggggaatgattaggggacactccagcaaccttctctaccctgccctccccttcctgagcaggtaaagagctgaagtgagattagcctggcccagcaccctcaacttaagaataaagctaaagcactgtggggcaaacaggcaaaaagaagaaaaggggaaaacagagccaggtggggcaaatctgggagggcttcttggaagaggcaagtttggctccagggcttcagtgagccaatagcttgcagataggaggtgaaaatagctaacatcgatatgcttcctgtatgcaaggtatcattctaagaagtattcactcaatcattttcaaaaccctatgaaatagaggcaatcattacactcattttacagatgaggaaactgaggcttgcagaggttaacttgccctagttacccaggtagtacatgaaaaagccagatgtgaatgcagatggcctggctccagaagagtgggagtgtttggggcgaggtttggaagtgcaagcaggttggcttggcaggagtggggcagccagctctttgcgatttaggtcagatggagccacagaaagaaacgggtggactgtctaatacaggcccggaatgtgtgcagtagagtgtcatgcttcacagcaacgagcccagaacctgtcatagccctgggactctgagaggcaaaagggacccctccatgtggttaaggaaaatgaagcccagaaggaggcagggacttgaatgaagcccagagaagggaagggactcatcctaggtcacagggtccattggtattaaacttggaattcagacataggtctctccatctccccactctcaccattttccagcatacaagataacatggatgtacagatgtaatatcaggatggctctaacctttggcggggggtgggggtggggctaggcatacctcctccctgagttaggaatgaggggtggaggatgtcttgccctccttggcagctggagaaggtttctgtggctcacatcagggtaggtggaaaaggttctgctcaactcctggctcatcacattctgagaccagaaaaatcttcctttttcccacttccttttccctggaagggtttgttagctgcatcctcctctgtgataagtcacctttcctgtgccatcccctggctccttatcccctggctccttgtctcctgcccagaccaaggagagacttcttccaattctacatctgcccaagtaccattaatgtttattagcattaagttctgtagtgaggaggatgagagatgcttgctaggctgagtgcattctttggagatttccacccagagccctcgctgtctgcctcagtttctccacctttgtcagtgactgagcatgtatccagatgccagagtgtgggccctggtagggcctggctgggtttgccactggtgaagctgcagcaagcacctcctaaaggacttggcaccaaagtccagctcctgcctcttttgacctcatcgccaaaggtcttcccaccaggccaggattaattgcagggcagacatcacagacccaagccctcaggatccctggggtggaggtgggggtgatactcagactccacccatctctcacctcttggccccggagctgttgacaaaatgctctgagagtctagaactttccctgagagcgtccccttcccccatgccatccacatacatattacagcaggttcttctaaggacataactcagctcaggctcttggtattattataacgtttgacctgttttcttctttttaagcaaaatgtgatcctatcggaagaataccaacagatcggccaccaattttgctccctctggactccgaagccccacccataatgggggcggggtgagcgggagggctgttaacttccaagagacctggactaatttccccgccatatcccccccagggaaaggtctgccctggaagggagaccacccggttaaagcctggccatccgatctggtatctgcccatctgtctgtctgtctgtctgtctgtgggatcaacagcctccagctagctcagctcctcaccagccccagccagcccagccccagcgagctgtaattcctgcctgttacaagtgttaacacctggcctggggccttcctcccccgcagtctccaggtgcctccctgggcccagcccactgacccccacggggtttgactgaacatgttcacaagcctctgaaaggtgggtggaggtgggagtgggtgggagaggcagcaggacatctgacagatggggaaactgaggtaggtcttaggcaggtgctcgagtgggaggatgggtcctgggatggcgagaactcaggtgtgctatttcccagctcactgcccttgtcctctgcaaaacattttcacccaagctgtgaggcagggcaggctggggactcctgggtgaagtgtaaggaagcagacccagatgggtggccactggtcctcagtcacacagcggcagggtgagctcctgatctccagcaggccccctccatctgcacgtccatcgctggaatgtagcaggtgctgggctaggccctaataacataggttcatccccccaccccagcgcccccaagaagaagaagaaagacaagtttctccaccaggagctaactgggactgacaaggggaattcgagaaatcagtgctgttgtttcctgtcccggctctgtcactacctggagaacatctcttccttccaggggtgtcagtctgaggccccttagagctgtcccttctggtcaaccttctgtcaggactggggtctgagcagtgtggactcagggtgtcatgcttgagggtccgcgtggacagaaatcccagctacatgacttcccctgtaaatccttcctggggaatgcatgagctgggtgggccaaagagggcaggccaagatgggcttagatgctcaaagtactggaatctgactgccaggcggggggctgggttggggagtgggggcagaaatgggatcaggaatcagaggcccatctaccctacagccccagccctaaccctgagaaggtgactcaccctccaccccagctccaagaccaaagaaaaacaacctcagagagaagggccagtgactctagtgcctggacagacaggacaagctggtgtcaaggaagcctgtgcccctgcctctctagcttgccatccctggccagctgtgccccctgcagccaccttgtgagacttttgcttcctgttggaccttccctccaggcccatggctgcccaccaaacacccaagctcaggtgtcattcatacccacaggtagatgtctgcaaagatattcacagccacacagccctgggcccagcacctggggacaggatcacaggcggactcagacacagccctcacacagctatggacttgaggctcactctcctccttacaagcacaatcaggtcatggccatgagcactgatattcatgcacaaagacatctgtggggctttccccacactgtcatgaaggcatgcgcgcgcacgtacacacacacacacacactcacacacacgcacgcacgcacacacacactcacatgcccagtcatgaacacagtcaagcccagcgtcacaggcagacacaggctctgacctttacatgggcaaagatacttctagacttctctctgtctcttacacatgtacatacacacatcacagcaccagccacttgctcacactcgtgtgcagacacacacagcacaacctgtcgtgggcatggatcccccaacacgcccacacgatttcacatccatagtagcccagttgcaggcacaaacacttttgcacacagagacacactggtgtatagaaaacacctcttagggtcatagacccagaacacacgcacacacacacacacacacacacacacacacacacacacacctctctccttggcttagacaaagcagcattcctgtcccccaccaaattcccaaacaagccatgtgtctagcattatgttagggccaatgtcttgaccttccaggtttccccagcgtttcttcctattgggcaatccctatctagatggtccccaagataccatttcacaccagaatctacaccaactggaagagtgccctcttctagttcatagggccggagagactggtctctcttcctcagtccctgccacctatgggccgccaaacctttccttcctaccctcccccaacccaccagagtctctgcgaaagcaaggcgaaaaacggcatggccttggcccgggaatgggaagagggtcaggaatggccgggtgaggctggactggtgttggcagcagcctttccccagactggccgaacctccttcctgaagtccctggctgccctggccaccccatggacttctttatgtgctggaagcctcaggttagcccagccccccggaaaagtgtgggttgggcagaagaaagacttccccttggctggctgtcctgggagcaactcctagcaccctctaaacagagacccttggccatgtccccaccctctctcccaggagccccaaacacccagacacaaatgctgccatccccaaacaactggaagactcggggtgtggcccccaagtctcgctgtctctgctcctcctaccctggactctgggttggcgaaaggcagggagtctggggacctgcaggcggtaccgcaccgtggtggcacttctttctgactttcaccccgggggccacagcccacttctcactcacagatcccaaattcttcctcctcacctccccccgcccaggccaaggctctcctatgtccaggaggggaagattctttaattaaagttttccggaatgtagggggctggagactggggagaggcggagtgtaatttagagaactggtttcagtgtcttcccctctggcccctgggacctgcggagggtgggagagcggcgatggggccgctcggaaaacaaggggactcctggagctggggctcccaaagcgatgtttattcctcacccaggccccccagacacgcacagccccccccaagcactgctcccggcttcccagtcttatttactaaaatgtcttttgtatccacatttctcagggacggaattctcccttccctctccctttctcctcggtcctcggttttccaaaaggaagaaatgtgacatggagaattggatttttggtcaaagaacaacaagcctacccctcccagacaacacattttcaaggaaccccccttttgccagggtggacaagcaagaaatgaataaaatccgaattcaatggcatcccggatcagcaaataccatattcacttcagaggctcaagatgaatctagagcggtggggagaatctgatgaaatccccccacccactcccctgccccgggaggagccctgaagcctttggggtctgaaataggaaggcaaaggggggttattatggggaatctcttgatggaggcgccggcagaggtggggtggcagtgaaggaacaggatggttttgcccatgaagaccccaaaatggagaagaggagtggctgggccccagggacagtgctggatttccagaaacccaactgcaagcaaatggggggtcttcgggggcctctagattgggacgggcagagggttaggatctaagaataagaaaccttctgagatgggaaaagtcctccagcccctgcagcggggagcagggaaaatggtgattatcagaggagccaggagttggattctgaaggcgacaccagcagaaaatccaggaggggtgggcgggtggggggctggagggaggcgaggagaggagccccagccctgcagcggcccacccccagccggcgcccccaccttccccggacgcggcggagaaaccgggccgcgggcagacaagaggcgagtcttaccaccaaattgggtagccagcgaggaccctggtgccaccgagcaggaggccgaggagcagcccgagcaggtggggctccattagaagaggcgccgaggaggaagtttgcccgcgaccatgaagagggggagcgacgcccccaatagttggaacaaagtccacttgagattggaaatgactttcgggcttgtcagaagcgcacctccacccgcagccgcccccctcccgagcccagcgcggagcagccgggtttgaggatgtcagcgagcagccaatcagcgcccgcggcctaaggtaagagatgagtctgtagttcagcctgtcaatcacgcgcccctcccgcccggcccacaactcgggctccgggaagggcatcgcccagcaaacttgggcaaagcccgcgccccggacgccgcggggcttcggggggacgcggtgggccggaccctctgctaccgccgcggtcccccgctggccagggttagggcgcgggggctttgacccgggcgttcacatggcgagggcttggcgtgggcatgaacgggtggctcctttgctggcggggaccgtgacccgttgggacgtgggcccgcgaggaatcgagggtagaaagcacagggatgtttccagaagccccgctcgggcaggtcaggatcagagggtgggggaacgcaccccctcccagcttccagcctcccgagtccgcccgctctctggcctctcgtcctggccgcgggaggtcacttcccgggtgtccgaggaacgtgcggaaaagtccgcggaggctcgaaggtctggctgcgggcggcgccgggggacggagccgagtgtcatttgagtcttttgtcagggatcagatcggtatcgggacctcctgctgcctttgcatttcctgcaactgacaccagcggccagtcgcatttcctgctctcggagtcgggtcactttctcctccttgaggggttcaggcccgacctctggcccgggtcggaggcgtgacccacagcctcagtgggattctcggttggaccatcagggaccggtgaaacgcgcagctctggccgagggcggcccaggtccttggaagaccttgctgccctccggagcgcccctcactgcccgaccgtcccgcctgaggccccggttctactgatagggagctccagcctggggtttggcgataaaggcccttgccctgtgcggacaccaaatgcctccagttacccacccctccccacaggaaaggagtccttccaggcccccttcgggcttgcttcctctcctctccctctccagagcgaggaattaggtctcagccctgggtggtattgacatcatggtcaggttttggggactcacgcccggtcacctgggtgcctttccctaggccccctcccaggccacctgaggcaccaggactctgcgcagccccggtctggggtgaaggaagcactgccggtggggagcagggaccgctgtgtagggaactgtggcagaaagggcagagaatgagccgacccgagtcccacagaggcctggaacggcgggcgttccacgaggtgagggccatggctgaaggaagtcttacgccagggggccagacattcctggcctttgatctgagccccccgtacccacagctccaacctgctgccccttctggtcggcgagccctctccgcacgcggctgctgccggcacagggagcgcggggaaatggcctcgggggcaccaagggtcgggagagccgcctgggcttgtcatggctcctgctgcgttcccagcccattgctggactggagggggtgggaggggaggttgaaagagaggaaggaaggggaggaaaaggagaatccgagaggaggagagagagagaggggctcagagatgagagagacgctgagacagaaaccaagaaaactgtcggggggaggctgagccaccggtgtgaggaagaaaggggcaggggggaggcggagagcaccaaggagctgcaaggcgaagaaaaatcgtgaacctgaccaggagtggtgaacctggtgggggctgcagagatggggatccctagagatgctcctcatggctgggctgattctggggtgccctgtttctgattcacctggaaagagggttaccattgccatgaatgcagagcctcaggaccaaggctctggcagtggagagctttccacatacctccctcttggatggaggcctgctaggtcctacctggagtcctgtcccacccacagggctcccaggtggctttctgatcagagctgcctgctggagtcctgcccaagggctcgggagttccagagccccatgacagtggtgctgagagctggggagggctaccttccctggccactcagacaccactgtggatgcagtatggtggggcgacagggcctggacttgatggcttcttggggtcattactgggcctcaagactccacaggtgccaaccctgtgaggtgggagcaaaagatccgaggctgtcggtgggagtgtgtgttggctgagatatgcccagccagcatcctgggtgctgtgggcaagaacatcattccctgaggggtcatgtgtacctgaatgcctcctccaggcagcctggagaactcagacgcaggtcatgtgcatcaggcaggaaacaagtgggttgaagggtggaatctaggagctggccatgtgcgcctgggaagtgacagaggagaggactggaacctaccagcggccctgccaggcccctagtgaatggaggtgtgtgtggggatttccgccacttgaaagctcctcagacaaggggagcctgagtcccttcctttcccccaggtgtccttccttcaacacaggtttaatttccttcctcctgcaccccttgcgctgccgcgggtggaaacgcaggaatggtttctctcaggggagggcgggcgcccctgaccacacatcacagatagaaacaccctctctctaacaggtaccccaagccccagggtggtttcacttggtggagaaagggttaaattcactccaagaccaggaagggagggcggggtggaggcatcagccggtggaccaggaggccatcgccctgaaaggaagggtggtctcttggaagagggcagaagaggcagcaagggccagggacctggggacatggggtggcacgtgggaagcactttttgttgtgtgtgtgaatgtgtgggaccttagacctgggaaggggaccccagtcccaacccaacccctctctctagctggctcggaggttccttttgatgtgcactcccccggggctcagagtctgccgctgtgtattcagtgaggctccactggaccccctgcggaggcaccgtgtagacaaagaatccggtggccaggcccccgcccgccctcatggggctacccgtctgtcgcggggaaggaggaggaaatctccgatccaggcactgtgccattcatttttgcttgaaacaggtcttggggctgccaggcgggagtcgggagccggaccaacctgggggggtaaagggagaggcgaagccgttgcagcggggaagcaggtggggaagtgcgaagggccgaaggcctaacaccacagggcttatggaggaacagtgcaaagggagcacatagggggctccaaggcctctgacctggagaggagggcgtttaactttctcctaggagctgtaggaaccgcagagcggttttaggcgagctccctagaggccactggaaggctggacagcagagcctggaagcaggaaggccctagcgtgggtggtgggcgcaggagtaaatcggatttctttccactgcccagcctagtttgctggcatagaggctgcatcctggaaatgcaggaagcccctgacctgcaccgagtaagcgcatagtaggtaagcaccagatgttaatctaacacacaaaggagcgcaggtgcacgcggaggtcggctcagagcccagcggcgcgggcgcgccccctggcggcagtgctgatagcaaggcgggaggtcagcaggcgaggaaggggtcgcgcctggtcccactccgctccctgcgggcccggcatcctcaattgttgctggtgagcagcccggatttcggaggatcttggttaagcaggtgccctcctgagtgaatgcccttaatctacctcgcaatcccggagcttagctggggataaggggtgcatggcttcaggctcccctctcctctccagacaggcggagggcgagcgggcccaggtgatgccggtccagggcgcactggggcaccgccagatccaccctgcggatgcctccctcttccgctgacatatgggaggctgccagcggcaggcggatgtcaccagttcttcctggatcccgagatcacaggggccgctgtgggcacctgagaggttctccctgtggcagtagttcctcctgtcttagctctagctccccagggcattcagttttatgtatttatatatatatgtatttataataaatatgtatttataataaatatgtatttataataaatatgtatttataataaatatgtatttataataaatatgtattatataataaacacatatattatatattatatattatatatattatattatatatatttatatattatatattatatatttatatataatatattatatatatttatatataatatattatatattatatatatagaaaggtggaatttcattcttgttgcccaggctgtagtgcaatggcgcggtctcgactcactgcaacctctgcctcccaggttcaagcgattctcctgcctcagcctcccaagcagctgggattacatgtgcccgccaccacgcctgactaattttttgtatttttagtagagacagggtttcaccgtgttggccaggctggtctcgaactcctgacctatatttttaagacagagtctcactgtgtcgcccaggctggagtacagtggtgcagtctcggctcactgcaacctccacctccccatattcaagtggttctcctgcctccgccgctcaagtagctgggattacaagcatgcaccaccatacccagctaatttgtgtttttttggtagagacagggtttcgccatgttagccaagctggtcttgaactcctgacctcaaatgacccacccatcttggtctcccaaagtgctgggattacaggtgcaagccaccatgcctggcctccccagagcattttggaaagcgatttgcggtgaaagtcctttagaagggagggaatggggtggggtgggggcactggccggttgcctgtcatctctgagtccctggcttcggttgtggagtggagataacactttccaccttgtagggagctgtcagcgttaaatgagaatggtgctgacggaatgccagactgcggatggtgaatacaaaatattgggtttccttcttctcttgaggcaaggagtaagcctctctctcaggtctctcttcctgccccagtcagtgtctgctaagcagtcccccttcaggcgcccaggagccttctccagaaggatttatccgggataatgttgtctgatgtccccttccaagacccacttcaaaatatccacttcagagaggcccctccagaccccttgccactccctagccctgtcctgtcaggcctcttattcagctttattttccagcatagccctgacactgatgtgattaatatgtgattacacatattattatttttttgagacggtgtcttgctctgtcgctcaggctggcatgcagtggtgtgatcttggctcactgcagcatccacctcctgggttcaagtgattctcttgtctcagcctcccaagtagctgagattacaggcgctcgccaccatgcctggctaatttttgtatttttggtagagacagtgtttcaccatgttggccaggctggtcttgaactcctgacctcaggtggtacgcccgccttggcctcccaaagtgctgggattacaggcgtaagcccccatgcccggctgattatacatactacatagcagacatatctgctcagtttcttgcatatgttgtccgtctccaactgtgaaatctccacaaagaaactccctccacaagactgctgaacccccagtggtgagggatccagcacttagcagcccctcgaaaacactgttgatgatgggcccagaggagagggagcaggcagggccgaggtctcagatagaagggccactgactcaggtctgggctccctgtggcccctcagggtcctcagtgcccctatcttgagtggccctggcccctacaactccaacccaccccagctaccctgctctgtcgcttggttcctgtgtccctttcataggaccctgtgctgcctccagtgggatgagattaagggtgggcagcctgttgggaagtcactgccacatgggggcatctggggcttggtggcccctcgtgctgcctctccagccatgtgccacacctctttctccttccctttctttctcttcagcctccctctgtgcccctttattctgccattgcctcataaccctgagccccatccctggacatggctggcctgcccaaggcttttggggctctaacccaaggccagctcctagcatggctgtgatcctacctgaggagttagagccagacctctgtgtgtggctgccacggtttctctcagtcacctggaactagagctcctgagttttccttccactcccctgtgtatgggacataagcaggcagggaaggggagggagccctggttgcaacccaggaggggcttggagccatctttggtctcttctgtctccaaccttagtcacgatgggcccccaccttccgcctgggctctgagggcggaaagtgtctgtatttctcatcgcacacattgactgcatgcctgctgtggacaaggctccacgaggaatgggactaccctcaaggagtctgccttcttccttataacccagctccggttgatgcacacagtaggtgctctgtgaatttcacctggtccatttcttcaacgcatcttcatggagcaactctgtgtgcagctgccccttggcagctgagcactgatgagcaaaagcagcccaggttttggcctgcaaggaacttgccatctgctggggacagtcattcatcagaggaccaaatacgtaaatgtttccttaaaaaacaaaaccaggccaggcatggtggctcatgcctataatcccagcactttgggaggccgaggtgggcggatcacctgaggtcaggggtttgaaaccagcctggccaatgtggcaaaaccctgtctctactaaaaatacaaaattagctgggcatggtggcgcatgcctgtaatcccagctacttgggaggctgaggcaggagaatcacttgaatccaggaggcggaggttgcggtgagccaagaccgtgccactgcactccagcctcggcaacaagagctaaactgtctcaagaaaacaaaacaaaacgaaacaaaacagaggtgtggaagttctctccatctcaggggtcttgcggggaagacttttgtgggggcacattagggagatagaatagaacaagcctgataatatccttggagatggtgaagaaatttctagtgaagtcctggtttgcaccttccagaactctgccaactaaccaccttctccacagaccagtatggccagtagctgtcattgctgggacctcagggtggccagctatgggccctgagtcctgggagcctaatcacatggatggaggcccagtgggctgggaatggggtcacagctgcctcactggcaagggcctaggcacagctggcacagacgttggagggcccttgggctaagcagggacatctgcctggcatttcccacatcccagcaggacccacctcttatgcacctttgtcttggcttctagataaggcctgaatggggattcacatgtctgactgggaaatcctctctgagtggttgcgttagagcccaggtctaccacaaccccagtgaatcccagctctgcctcttactatgtgacactgagcatattatctaacctctctgtacctgcttcatcaactgcaaaatgggtataataacacttgtctcaaaaagacaattgcctattcagcagagtgatagctgctgtgtttgaaatggcacctgggacatgtaaaatgatcggtgagcatccactccctccctctgtggcaatcagctgctctttttttttttttttttttgagatgaagtctcgctctatcacccaggctggagtgatcttgtctcactgcaacctgcaacctctgcctcctgggttcaaatgattctgctgcctcagtcctcctagctgggactacagatgcaagctaccacgcctggataatttttgtagttttaatagagatagaatttcaccatgttggccaggctggtcttgaactcctgacctcaaatgatccacccacctcagcttcccagagtgttgggattacaggcatgagccaccatgcccagcctcagctgctgtttttgaacttctggaagacaggcttctgtttagatttagtgtagctcacactgctggtggtcccttcctccaggatggcagaggcccccagtttgttctggtctttactcctcccctaccttgctcagaggtaaatcctgactgatctaagtcaatcacggggacccattctgcttgccagggattggcctaaactgggtgacatgtgcctgagggaggtcagctgaagggtgcaagaaggtttctgggaagagtttttggggctcttaaaatgacacacagtaagaaatatcttttccctgcttttggacattgttgttttgggttgggatacctggagctgcagcagccattctgtgactatgaggaaagctgcctgaagatgaagctgaccggcagaggaagacagagccaagagagagaaacaaacttcatctctgacaccattgctgagacactaactgccttcagaggagtcctgctttggaacttcttgtgatatgaaataatacattttccttgttcgttagcccacttgaggctgttacttgtagccaaaggcctcctaactatctgtatcctcctcacccatcatgtctagtgtagggtagttggattaaatgtggagactgacttacaaggtgagttgcttttacttaaggatggatgagtgttaggatttctttttcttttcttttctctttttttgagacagaaatttctttcttttttttttttttgaggcagagtcttgctctgtctcccaggctggagtgcagtggtgcaatctcggctcactgcaagctccgcgccccaggttcacaccattcccctgcctcagcctcccaagtagctgggactacaggcacccaccaccacgcccagctgatttttttttatttttagtagagacggggtttcaccatgttagccaggatggtctcgatccgctgacctcatgatccgccgacctcatgatccgcccacctcggcctatcccaaagtgctggaattacaggtatgagccaccgggcctggccaacagaaatttcttttcttttctcttttcctttctctctgtctctctctttttttcctttggatttctttttcttttctctttttttgagacagcgtctcactctgtcactcagactggagtgcagcagcacaattttggctcagtgcgacctccatctcccaggatctaatgatcctctcacctcagcttcccaaggagctgggactacaggcatacaccaccacaacaagctaattttttaaaatttttggtagagatggggttccatcatgttgcccagccagggtggtcttgaactcctgagctcaagcgatccatccacctcagcctcccacagtgctgggattacaggcatgagtcaccacgccctgccagggcttctttttcttgatttgagggtttgtctaggtgggggtgaggttgcaactggagcctggagctgggagcctcattctgagatgacttgtggggagaaaggaaacaacaaaagggagggtgtagggttgaggtgaggtttaagatgcatccagaatgtagttctgcccaggtcgggcacggtggctcatgcctgtatttccagcactttgggaggccaaggcaggcagattgctttgagctcaggagtttgagaccagactgggcaacttggtgaaaccctatctctacaaaaaaaaaaaaaagaattgccaggtgttggtggctcgtgcctgtagtcccagctactcaggaggctgaggctggagaatcgcttgagcccaagaggcagaggttgcagtgagccactgcactccaacctgtgtgacagagtgagaccctgtctcaaaaacaaaaacaaaacaaacaaacagaaagaatgtagttctgcccagtgctgcctttgcattttcctaaagaggctgcaacttgactgctgatgggtttgaggttcatgaaaatgttttggaattagtggtgaaggttgcacaactttttcaatatactggaagctactgaattgtgcactttaaaatggtgatttttttatggtgtgcaaattatatttcaatttttttttttagacagagtttcactcttgtcacccaggctggagtgcaatggagcaatcttggctcactgcaacctcagcctcccagattcaagtgattctcctgcctcagcctccccagtagctgggactacaggcatgtgtcactatgcctggctcatttttttgtatttttagtagagaaagggtttcaccatgttggccaggctggtctcgaactcctgacctcaggtgatctacccgcctcagcctcccaaagtgctgggattactgtgtaaggcaccacgcctggcctcaattttttaaaaagagaaaaagcagcagcccagccacctgcctcctacagtctcccctctgcccttcattctcaggtgtctaggagccattctcaggctccctgagtgtgtttcggggatggaggggcacagccccaccagccatgccacacaggagcacttcctaaagtctctgctgggaggggctggtggaagccttgcctggggacactgggactcactctttcacctgaggggatggttatctcctaaggcctggtcctcactggccaaatagcctcaggttgggatgggagtagggggtgggggcaaagtgatgctgtggtggggtggggggagcatgagttctgtgatcagaaagaacaagttcacatcctggctccctgctgctgagctgtgactttgggcaagttatctagatctctctgtggccgtttcttatctggcaaatgggtatactaattccacccttggcagggttaaatggcatagtttacccaaaaagctcagggcatctagtagataacacaggctgacttcctaagacctgttattatcatgagaccaaacataatggcagaatcctaaccaggctgtcttagtgattgaggactgttggtgacgagatgttcccagctctcttgcttttctcagactgcccaaaagccttcctcccctcatcctcatcacccacccctacctttgcctaccatagcctccccacccccacacccagccttttgctatgcacatcagcaggtgtggtaatgtgggaaatcatatttcctttcttttttttgagatgaggtctcgctctgtcgcctgggctacagttcaatggcacaaacacggcttactgcagcctcgacctcccgggctcaagcaatcctcccacttcagcctcctgagtggctgagaccacagacatgcaccaccgcacctgcctaactttttattatttttagagatggtgtcttcttcctacactgcccaggctgatctccaactcttgggctcaggagatcctcccctctcaaagggctgggattacaggcatgagccaccacacctggccagaaatcatatttctgaatcccaaatcagagtacatggcataaccaaaatatttattcttttactttattttcttttttctccagaatttaagaaaatctgaaatgaaaatctgaaatgtagtttggtcaaaggttggacttttgggagcattttgatggctagtggtgacacttctcatggctagagagggccacgggtgttctagaaggtgaggcatgggttaaaccactttgaatcacacatggagaaagctcatttattcacaccccctgttccattctccttcactccttctgagtatcctcaaagaaaaagtctggttggtcctaatacgacttcagcacctctccaacacttgctaagatccttttctaataaagagagaaagtcacacattcagagcctttgcagggccatagtgtctggttagaatgaaacctcattgttgaaaatgagtaaatctaaaatcttcttttcagttgacgttattaagaacaatgcaaatcaatgtaaagaaaagtgttcaaaaaatagcagaacaggtatgcatgcagctatagagtgggggtagcatggaaatgcctggagtctggaaaacaccggaacatgggacaacagagctgagggcttgcagtcagggtgcgctgtaagtgcctgaccatacagtctgtgtggtcagggcatcttggttggccagagaccctgtgggtgagcgaggctagagctggcagaaccccagaattgcacccggaagccacctggctatgagctgagattacccccagcatctgctctgcctcaaggtaccagataggtgatctggggtggcccatccagccttaagagtgggttggatgacagaggaggccagcactaggcccctgtgactcggatactcacgttggagggagaggtggaggacgaagcgtaactgtcttccagttgtccagaaaggctgggcaaggtcctgggtcaccttctctgttctaggcccatcagaggctttcttcagggtctaggagaagagggggagggccccagagtggcggggtcaagttcagacacccctgagcactgctctggaggcaggcaggtcaggcccaaaaggtgcgtgggcctcagggagccacttgttcccctccgggtcccctccagtgaagagccacagaggaggggactgggaaaccagggttccagcttcagctttctcctgactggctgtgtgtccccggacaaggcactcaccccctctgggtctcagtgtccctgcaggttgaaactgccaaatgaagagttctttgggtcctgtatgcattgagtgaatgctctgcttccccgtgatccctgaggccaacaccctttgtgttcctgtgccctttcagggcagaccaggacactgtgccagagctggctgcaggcctctggctagagctaccccagccttcagcagaggcttgtcctcctaggtgaagggttgtccatgcccagcctcgtgaggcccgcgtggttttgggcagtgcccagtggcactattggcaggctccaggcactaaaggaagagaccgagaccctgaaaggtgggggaggaagacagagaaggaagaggtgcctgcagagggggtgctggtggctgcccctcacaaacgtgccaaaggttgccaacttgagtttaagccttggttccagaacacaaagcctcctctctgggggccttgacccctcggagcccccaccccgggccggctgagctgcccggagggaactagccccagaagggcctggttgttggctgcgaagtggctgggagggaagttttaatgatacacaacacaagacacaggggggaaaagagagaggggggtggtggaggagagaagggaggttggggggagaaagaaagacctcctgccaggcctgttgccaggaaacggccaggcagccagaatcagccctgctcttttcacagttggctttaagcaccgagagaaagcccgggccataaagggggacatgtgttgctgggtgtgtaaggctagcctctgcagttaggggagcccctgcccccgcccctgccgctgcaccgagagccccttgagcccccagccctgcctccacgcctggggattatggatgaacgattgagctgccgagcaatggaaaaggcaggggtggccctggccttccaatgtcgcagccactttgggggtgaaactcaccagttgggtccccaggaagctggcaggggctggcagggcagggagatctgggattccaacatggcacgtccacagaaaagtattcctattggctctgcgtggtccatccaggttaggggggtgaggtgtctggacttctaggaatcctcaacagggcactcagaagggagctgacaagtcccagaaacctgcattctggctcctggttcttgtcacggatgccatggtgggaacaggcccctttaggctgtgccttggcacttggggactgtccctgcagcgcagtgactgctgtgtccctgaagagtccaccacacagccaggaaagagcaaaaagagggggagggttgttgacaaaacgagctcatggccctggctgccaatccagagtgatgtcagctgaggagtgacatggtgctctcagcacagaggacgtcagcaaaccgggaagcagcatgtgcgtggaagctgggcctgagccctgacgcttcagctgagctccctgggtgatggctccttccacaagttctaacgtcccactgaaagcaagctgcaatttctgttgcttcttgtatcaattgcatgaaaggacgggcagtttcttttgatcctctggcatgccaaggcctgaatgccagtcctgggagccttaccagccctctaagaagaatcagaaggtgagtgttagggaggaagggacagccaacccaccccgactccccatctggtcacctcactgcctgacttctctctgagctttccgagacactgctggaggccgacctgagctcaaactcaaaccccagtctcctgctcagtgtggtgggcagccctgcttccctggctcatggagtgagtgagggtgtgtgtgagtcagttctaacaaaatcaagaaatcactgtatcttccaagaaagctttgactcagtgcatgtgtgcactgagctgtttcccacgtgagtgagcgtcctggaaaacaggcctgcccggggaagaagtgagccagtctgcctgctagaaactgctgggggctcctgatcgggaggcttgcttttccttcaacttccttcgcctctttttctggctggagtgtgtggttctgctagttctggagtctttcctgtccccattctggaccatgtcccatcccaggtatcaagaatggctcatacctgtaatcccagcatcttgggagtctgaggcaggaggatcacttgaggccaagagtttgagaccaacctgggcaacatagtgagaccctgtctctgcaaaaatttaaaactaagtcaggtgtggtggcatgtgtttgcagtctcagctactcgggaggctgaggggagaggattgcttgagcccaggcatttgaggttgcagtgagctaggatggcaccactacactccagcctggtcgatggagtgagaccctgtttcaaaaaataaaaaaagaaaatgtcttacttccagaggggctgaatctccatgaggtggtaaccaaaacgacggatttgccaactctcagggggaagtggtgtcctgggcagtggctggagaagcaggtggtgcctgggtctgatcgcaggagggaggccttctgggttctgcctctgggagagggcaggctgctggggagggcgcgcattaggagatggagagttaggccaccaaggagcccactagggcacctggcaagttctgctaggcctgccgaggcatggctgggctttacaacagggggtacggagctccttgagtggaaagctcctctcgctggcttgcccctgatttcatctcaagaacggtcaactctagcaagcaaatatacctcctgggctgtaggtaggggctcagccctgtccctgaggctgggcacaggcttggtccttctcgcctgcctcctccccttccctgtcctctgtcacacccctcccccatgcagaggagccagttttaacctggaaggttccctctgccctctcacaactcagcacccctgttattccttcagaacccctggccagctcctcaagggcttcccccacgctaatatactcttagagtctgtggcttctgtttctctagcttgttcagggaagagtctctggaggcccaccttacccccagaagcattccaaaaaatggccattgagctcacctgtcagtgttcctcccccaggcagcatcaaactccctagattggccctcagtctctcttcttcttctccttctccttctccttcttcttctttctggagacaggatctcgctctgttgtccaggctgcagcgcagtagtgcgatcagtgctcactgtagcctccatctcctggggtcaagtgatcctcccacctcagcctcctgagtagctggcactacaggaacacaccaccacacctggctaatttttttttatttttagtagacagatgaggtcttgccatgttgtcccttattcttttttttcttttttgagacagagtctcactctgttgcctaggtttgagtgcagtggcacaatcccggctcactgcaagctccgcctcccgggttcacgccattctcctgcctcagcctcccgagtagctgggactacaggcacccgccaccacgcccagctaatttttaatatttttattagagacagggtttcaccgtgttagccaggatggtatcgatctcctgacctcgtgatccacccacctcggcctctcaaagtgctgggattacaggcatgagccaccacgcccagcccagtctcccttattcttaatgaggtgaccatgagttaatctcttaggtccaccctcacctcctccaggaagcctccctgacttacccctcctcctttgtgccttctagcttctcatcagtgtagtcattcctgacctacagtggccctcagcagttgccaagatttgtccccaaagctcagggctggtggtcaggtgggttagggatgagttgttaagggttgggagaatacatctcctaatgcaatgaggaacagatccagctgggttggagggaagggaggagggcctgcgccccctcagcccccttcactccccacctctgcacccctgcctagcttcttaaccaggaagttgagctaccttcactaaagaagagtggagacaggagacccggcccttctctctgggacaggactctcctggtggggctcctcagaggtgagatcctgcctctgggcccctgggagaccctggaccttaaagttattgtgcccacacattctggatggggcctgcgaggatggtcagggtcatagtgccacctgctggggctcccaggaacagcagctggagagacgctgacgtgtgtgtgtgtgtgtgtgtgtgtgtgtgtgtgtgtgtgtctcggttgtggtggtggcggggcaattaataacacctcaccacagatcttaaaattcgcctgatattgaacccttaccccctttccaaggaagcagccaaaagagtgcggaggaagtgatattggaattcaactggggctcccagggaaatccagggctgcagggacataattgcattccttggaactgctgttttttgaacttcattcatgaagcctggtttctagggatgctttctcttttcatggacccagaaggaaagtggagatggttcttcatgcttctatgtgaaatggggtttcaagggcaaaaaacaagtaagcactttgaatatctttgtgtttttttacactgataagaggaagaaaagtatgtcacattgtaaatgtcgatgattagaaacagtccaaggtgatcattgtaatgtcaatttctgaagcagttgggagaaataagtaggataatgaaatgaatcagcacagtgcctctcacttgctaaatatgccgcatgttgggaaattcattgataaaatgaaacccactgtggagaaagtgactggccttcctggcaagccaggctggaggtgagcagggttggccagggtcatggggtgatgtcttggttggaagccaccaggtgacctgtgtcctgttgacacacaagtatgctgcttagtaactccctggaattatttttaaaaagctagatgtgtgaataaagaatttgggggattacaattttggtttgtaaatgaaccctttgctttaggaagaactcagcataggacccttgcaagtatttctttttctttttttcttttttttgagacagagtctcgctctgtcgcccaggctgtagtgcagtggcgtgatctcggctcactgcaacctccacctcccaggttcaagcaattctcctgcctcagcctcccaagtagctaggactacaggcactcgccaccatgctaggctaatttttgtatttttagtagagatggggtttcaccatgttggccaggctggtcttgatctcttgacctcgtgatctgcccgccgcggccccccaaagtgctgggattacaggcgtgagccaccgtgcctggctgaaccttgcaagtatttcacatgatatttgttttgcccccttcatccctttacttatgtaaccaaactccacctgcagtgacaaggctggcctgataacctactcatggagccaaatgcagatgcttcttaggcagaatttggagtataaatgggagaatatttgggggactggagggtgggactgatgttggggaatcagcaagcaccaggccaccatcttgctgtatgacatttgtttccccatcgaatcctcactagaaccccatgcaagagctgccgctgccaccctcgttttacaaataagggacttgtggcccagggaggctgtgtgacctgtccgaggtcatagtcctaataaacgctagaggtgggatgtgaacccagagagtctggggtgactccaaaggactgaggctgggaacacaggaaggtggtgatgcccctgctgggaatgtgcctgggggaaggtttggagggatggctcatggtcagtgggatttagtttcccactcaccaggcagaggactgacctggtatatgccttcagggctgatatgcacaattgtgcatgttgtgcactgcaaaaggttacaccacatatgaggacactgtgcacatcacggccatatttgcagtgattgttttctgacagttgggaaaaaagtgcctggaggaggagggacctctttctaaatcactcagaggggcttcatgggtgggtggcgttttccacgtgtacatcaccgtctttctccacccaagggagtgagcaggtactgggacaactttaggccattgctccaacccctgtgttgagggggtggaggaaccttttgcattttctgccccctcttcacttctcccagaagtcatgggaggggcaacagacagcaaaagccttctctgtgtcactggccctactgttttctctctgagacatctggctgaaaattcaggctcttgccatccctgtggaaacaggatcacataattggtggtaaggtggggagggaaggaaggagaagtgaggaacagccgagtgggtcagtggatcagaagagatagaacggggcctgccttaaaaaaaaaaaaaaaaatcacaggccaggtgtggtggcttatgcttgtaatcccaactttttggaaggccaaggcaggaggatcacctgaacccaggagttcaagaccagcctgggcaacatactgagaccccatttctacaaaaaatgaaaaaattagctgggcatggtggtattcgcccataatcctagcttctcaggaggctaaggcaggaggatcgcttgagcctgggaggtcaaggctgcagtgagccatgatggcgccactgcactccagcctgggcgacagagcgagaccctgtctcaaaataaattaattaattttaaaaattaaaaataaaatttaaaaagtacatatacacacacatccacgtatatgtaaaatgtcatagataatttgggttgttttaataagcatatatcagccttcaagcagatgcagtccataaaaatccgggtttacaaaaacagataatttggcatagaggcctgtgcacagagaggggattactcaccatataaaatggtttccaggggcttgttttcttttctaaagaattttgttttgttttctgagacggagtcgcactctgtcgcccaggctggagtgaagtggagtgatcttggctcactgcaacctcttcctcccgggttcaagccattctcctgcctcagcctcctgaatagctgggattacaggcgcccgccaccatgcccagctaatttttgtatttttagtagagacagactttcaccatgttggccaagctggtctcgaactcctgacctcaggagttccgcccgcctcggcctcccaaagtactgggattacaggcgtgagccaccgcacctggcctctaaagaattttaagtgaatttccaagagtttcaaagatgattgttatgtttatggaatgcttattctattagctctgaactcatgctaatatgtttgtggccatgcgacccagcatacactctgtccttgtggccactgccaatgggaccagctgtgggtacctgacccttggcactcttagcccctggcgggtccaggcagcactggcgtggtgtccacttttttctcagacacttgcatcaggttgtatggtagctgccactgggccccaaagctgtatggctgtggcacaacgcaggcgtcaaggcagccatgactgccatgcacaggctgtaaattctttatatatatatatatgtttttttattatactttaagttctagggtacatgtgcacaatgtgcaggtttgttacataggtatacatgtgccatgttgatgtgctgcacctatcaactcatcatttacactaggcatttctcccaatgctctccctcccccagtcccccccgccaagaggccccagtgtgtgatgttccctgccctgtgtccatgtgttctgattgttcagttcccacctatgagaacatgcagtgtttggttttctatccttgtgatagtttgctgagaatgatggtttccagcttcatccgtgtccctgcaaaggacatgaactcatcctttttcatggctgcatagtagtccatggtgtatatgtgccacattttctcttttctttctttctttctttctttctttctttctttctttctttctttctttctttctttctttctcttctttctttcttttttctttcttctttctttctttctttctttctttctttcttttctttctttctttctctctctctctttcctttctttccttccttcattccttctttctttctttctttttgagatggagtctcactctgtctctcaggctggagtgcagtggtgtgatctcggctcactgcaagctccgcctcctggattcatgccattctcctgccttagcctcccgagtagctggtactacaggtgcccgacaccacgcccggctaattttttatatttttagtagagacggggtttcaccgtgttagccaggatggtctcgatctcctgacctcatgatccacccgcctcggcctcccaaagtgctgggattacaggcgcgagccacggtgcccagcccattttcttaatccagtctatcattgatggacatctgggttggttccaagtctttgctattgtgaatagcaccacaataaacatatgtgtgcatgtgtctttatagtagcatgatttataatcctttgtgtacatacccagtaatgggatccctgggtcaaatgatattgctagttctagatccttgaggaattgccatactgtctaattgaactaatttacactcccaccaacagtgtaaaagtgttcctgtttctccacatcctttcctgcatctgttgtttcctgactttttaatggtcgccattctaactggcgtgagatggtatctcattgtggttttgatttgcatttctctgatgaccagtgatgatgagcattttttcatgtgtctgttggctgcataaatgtcttcttttgagaagtgtctgttcatatcctttgcccattttttgatggggttgttttttcttgtaaatttgtttaagttctttgtagattctggatattagccctttgcaggctgtaaattctaagcagcaggaagtaggtgtgagtagaagtggaggcagaaagcagccggttctgtttccaactgcattctcctttcctgtgcccctgtgtcatcaccatggaacgcctttcccgatgctacttccaacaggaggcagagggtgggagaattcaggttggaaggcttatccctaggaaagagggtgccgacagacaaggctccttggaagcctgacaaatcaaatttaccatttattgagcacctactatgtgacaggaacatgacacgcatgatttcatttaatcttcacaaccagcccaaagagcagctttctccctatttacagtcggagaaacggaggctctgagagattgtaagggacttgcccacggtcacccagctaggaaggaaagccagaaggccagcctaggtatcctggcggtcctggatcagagacactgctgtgaggcttcccggtgggaagaaggaaagtcatgcatcgatattcatcaccgagtgagagtgagagttcagccctgtcccaggcacctctgggcgggagggtggagaatccgaaagaaagaggcccgtccctggtcctcaaggtcgtgccaacaggccaactaagccatgtcccaaattgagagcgggttaaggtgggggcgtggggacgccctgacgcaacagggcttcggagaagggagcgctgggggctgcaatgccagaggattccttgaggagaaggggctggtggggcgggtaggggctggccgggagcaggaccgggaggaactggaccctctggactggggagtgcggggtagatgaaggcagaggagatggaggttctgcagtgtgaggcaggcggacagggaagcctgcatccagctgagagaccttgagcaaccacgtcctcctctgagctccgcgtttgccgtgtgcaaagtgaaggggtaggccgaccccgcagggcccttcttgcgctcctctgcggtgtgtgggggggtctctggtccgcgagaggacagtccctgccgcgccgagcgtcctccagcgtccgcggccgccgcgagcagcgctgaccggcagggggcgctcctgcagaaggctggccgcggtggcgccctcggcggggcctgggctggcctggggacccgggaggcctccccctccatccctccaggtcctctcccaccacttgccttctcacaccgccccttcccactctatgctctgggattaaaggcttgggaagttgctggtatttaggtccttgggcaggccacttcgcctctctgtgcctcagtttcttcaggcgcaaactgggttgtgtgaggaagagatgagttattggtcaggagagccttccagccacaggtgaggtagatatgccgctgctgcacaccccaatatcattcctagggcaggggctgctgctctacaacctcagggttacagttagctttaaatctttatttatttggttgttttttcagacagggtctccctctgtcgcccaggctggagtgcagtggcgcgatcacggctcactgcagcctcaaactcctgggttcaaaccatcctcctgcctcagcctcccgagtagctcgaaccacaggtgcataccaccatgcccagctattaattttttttgtagagatgggatcttgctttggtgcccagagctggtctcgaactcctgggctcaagtgatcctcccatctcagtctcccaaagtgctgggattacaggcatgagccaccgtaccctgctttaaacttttattcaaagtccttttgtgcaaagatagaaataattcctggatcctacagagtgcctggcatgatgagtgatgctcaaaacgtagctgtggaatgattagttttttgaaaccatccagacagaagctatgagaaaatcagacagtgcacctcttctgaatcacactggaagatgtccacattcatcttcacatttctcaccactgttctgtgaggaaggtggacagggagtgttgtatccattttatggatgaagaaaccgaggtcgcagaggaagccagagacaagattttaagttaggacccagggttctctccatgcaacctcaggtaaattatcctgttgttgctagtgactcctattggagacatgtggtattgcaaccaggccacattagacactgaaggcacctcatgaggaagaaggtgggcacatcctgggtgccaagcccagagagggagaaactagggtagatattaatatcggagctgggggaatgaaaatgatatttcagaatcaacaacagattggaaaggcttaactagtttaaaacacattccctattcttaagtccccaacactttttcaacctcctctcactccaaagtagaacttaatgtagcaaaggtatgctttgtagggtgaacccttataattataatgacaaccagtgggaaaacttggtttcctttcaaacgtttgtgtgactaattaggagggactattccattcgttaaagtgaagaaagaaggactgaaaaaaaaaatcactctgcaaaatccagctcaaacattgctgcatctcagttgccattgtcttagctacctcttccctggaacaatgaattgattgtcttctttcctgggttcctgcctcatttggtactttcttctctttactgctgcacagtcgttaaatatgtgtctttggtgccagctccctgggttctaatcccggttctaagcttactagctggccagttacttgacttctctgtgcccatttcctcatttgtaaaatgctgtgagcattaaatgggttaacagttttataggacttagaacaatacctggtgtaatgtaagtgctcaataactagtttacacttatatagatatgtcagaatgctctctgtatttatttatgtgtctttcccaacaaactgtgtgctcctcaaggacaagaactgacttcatcatctcctattccagggtttagcaccagatgcttattcaaagtatgttaaactgaatattatgtattcatactttattattattttttctaagacaaggttcttgctctgttgcagttcttgctctggagtgcagtggtggcatcatggctcattgcagttgcaacttcccatgctcaagaaatcctcccatctcagcctccagggtagctgggactacaggcatgtgccacaatgcctggctaattttttttttcttttttgtattagcagggtctcactgtgttgctgaggctggtcttgaactcctggcctcaagcaatcctcctgcctcagtctcccagaatgctaggattataggcatgagccactgtatccagcctatactttatataaagtagaaaatatgcagtgaggtggagttagccaccttttttttttttttttttttgataagttaagcctcagcttactgcttcccagagataaaccaaggttcgagtctctcctttgtttaaagaaaaacatctggctgggccactgcagtcctaccatgagttcaggaaaacgtgctatggtccaactgtctaccagtcaggacacagttaatgagcacttcctgtaaacttatttgtacctgcagttctgataatatgacctggaggaaatggtgtggtggtggccgatttctaaaactaactgcaaaggattgcattcctctaggcacctatgaacttcaagatgggacccctttcctctcgtccttctttttagagagtttagagagcaagaacttactcagatgaaaacaaactaaaagatgttgagaatgcctctgtgcagacccaaatctataggatgttatttatagtaaattatggcatatttttaaacttctagtccctaagaaagttgttttcttgcctccctccttcccttccttccttccttccttcctctttcttctttctttcttttttattttttggagatggagttttgctcttgttgccccagggctggagtgcaatggtgggatctctgctcactgcaacctccgcctcccagctgcaagcaactctcctgcctcagccttctaagtagctgggactaccggcatgcaccaccacacctggctaattttttgtatttttagtagagatggggtttcaccatgttgaccagtctggtctggaactcctgacctcaggtgatccactcgcctcggcctcccaaagtgcttggattacaggcgtaagccacagtgcctggtctccttcctccttcttttgagcagtatccatagctatgtcctgtgtggaatgcctttctgttgtaaaacaccccaacgtagagtctttcactagtgctttgcccataggggacttcacggtggttgaagacagaatgccctgctgctccgtgccacctgcccagccatctcctagtctctaggtcagctcactgtattctatgctcctggaagtggtaaccagggctggggtgggggttatattcacggtgagcccagtgcccaaacagagcttggacatatatgtcacctgacatacatgagtcgacttacagggacaatggagtgagttatctgaattttttttttttttttttttttgagacagagtcttgctctgtcaccctggccagagtgcagtggcacaatctcggctcactgcaacctctgcctcctgggttcaaacgattttcctgccttggcctcccgagtagctggggactacaggtgcccgccaccacacctggctaacttttgtatttttagtagagatgggtttcaccatcttggccaggctgctctcaaactcctgaccttgtgatccaaccacctcggcctcccaaagtgcagggattacacgtgtgagccactgtgctggctttttttttttttttttttttttgagatcaaatctcgttctgtcctccaggctagagtgcagtggtgtggtctcctttcactgcaaactccgcctcctgagttcaagcgattctcctgcttcagccatctgagtagctgggattacaggcacctgccaccaggcccagctaatttttgtattttcagcagagatggggttttgccatgttggccagggtggtcttgaactcctgatctcaggtgctccacccacttcagcctcccaaagttctgggattataggtgtgaaccaccgtgcccggccatgttatctgaaattgagagttctcctccaggtcactacttacttacctataactactagacagaactggactgctcaaagcactcctgctagtttcaaccgtttcagtacagatggctcatcctgtctctcatgaacattataaaatcagaggcagggtttgtagccatcaataagtcaggtctgaccttccacagtccaatgtttattcattcagttattcattcattaattcagttatttaacaatgtttttactgtgggctgaaactcagtaccactatgggaggaagtgtgggatagaaaagaaacaggggacagggtctcagatcttgaggtgtctgcagtctacacatagcagggatgcctaatctcccaaactcaaggacagtgtatatcaacataggcactggcacaaagtacagttgtgccaataaaggttgtagaaccaatgtggtgagtgagcagaggcaggaattgtcagtcaaggtggggttccagctgcccttggccacagaagcatggctgggtggggggccaccaaagggctgcttctctgcattcagcctgccttggctgaactcaaagatgctgctggataaagggctggagaatggccttgaataggcaaggggcaagagaaggtgggtcccacaccgtcctcacaacacaattcaaagagttctgtgaggaagaagagggagggagggaggaacagaagtgagaaggcctcgaactggaagtgccatggggagtggtgagctctgccagctctggagtgagcttcccaagataggacaggggcccttcccgcagaaggacagatgagtgaaggtcacagaggactccagtccagaaatactgccctgcccctcccaaatacctttcctgcaaatgcttaaagttccaccattggagatgtattgttatgtatttttctcctccccactttcagtaatttttttcattataaatgtcaaacattcttgtcatagaaaactaggaaaatgcaaggaagataaaaacatttcttaccccacactcccaacctccaaggcagcccctattaacattttggtgtccttctctgcccccttttttgtcattttcaggcatggctgtgagttccctggaggggattctgaagcccactttccccacttagcttcagtcctatttcagtctggtgttccagaaaaatcaagtcttccatccccgagagccagtgagttctatgaccttgaggaagtcattcatctttctggactttagtgccctcatctgtataatggggacaatcatggcccacatgctacctcacagtgctccagagtcaatgctagtgcaatgttgcaagggcattgccaatacagttcaagtatgtggggctaggactgatgggagtggtcaggactcagccagtcatcataaggctatgacaagaaggccaggtcacctggaggatggggaaggacagggagagggacaggtgagcccacacccacaccagtcctgtccaggctccccaggaccagccctcctgggcagctgtgtgtcaggtcagcatgggcaccttccctcggagctgctggggcatcatctgttccacttcctgttgggtccagagttcatttccagtgcagtttgagggagattagaggagagagccagcctgggaagccgcatttccacttgggaggcacaggagatatggagccaaccaaaggcggatggttcctgagggtttgtttcaggcagggtgggctggcctgggggcaggtgccgggaagaggaaggagaggtctgcagacatcctggagctagatttgatgtggccatagcaaagctttcagcctcatcatgtttgtgatttccaaagtgtgtgtgtgtgtgtgtgtgtgtgtgtgcacgtgcatgtgtgcacaagaggaggagagggctccagccctgagcgctggctgccttgggctggttaatggagacaggtagctgcatgtggatatccaagaatgcttctcttgcatacctgtgtgaacgtgtggacccaggaccagctgtggggctgcccaggaatgtagacacccatgggggaacagtgggggtctgtgtgtcaccaaatgcctggacttgggctgtagtgtgtgtgccccatggagcccgtgtccgagcccaggaaggagtgcttccgtcaccacacatgtgtttgtatgatactttacatgtttactgccataaaaaggccacaaaccagggttataagctgaaaacaacacttgtttcctgagtacctactatgtgctgggacctgtgccagactctggagacacagagagaagtgaaactcaggccagcccttcaggagcccacagggcagagggaaggtggcagagcaacaaatcatttatggcacaggctgtaggtcccaagggctgctcttcatgtccttcctcagggatcctataatatcacaattgcagggatgatctgttttcactgccgtctccccctccaggctataagccccttggggatggacacttaggaggtacacgatgctctgtaaggatgtataatgcaaaggtgtctgtgagtcaggctgtgcctgggcagttctgagccagccatggccaatcatgagccatagccagtactgacagtaccgctgggctagggctgggctcaattcctgcctccactacagctggcccacctacacctgctacgtcagctctcccagcctctgttttttcatctgtgcaatggagttatgattgtcccagcctcccagagggcttgaggctttagtgagattgtgagccaggcccggcacatgtgtgcacgtgcacacacacacacacacagagcttggtacacaggagctgctgtggaattattattattagcaagaaggagctattatctgggcagttctatgcagccttattggccaaaaagatagaagcagaactctgaagcctccatgggcaagctggaaggcaccccagcagacagaaacctggtacagttctaacatcaggaggagggaacccaagggtggggccacgccattggctggcaaggattcaagagcatccatctaaatattttcctcgtgtttctcactctccagccactgatgtctccatcgagtcttgggtgcttcttccagtctttgattcataggcttacccatcagacatcaacatgtaactttcatgaaattttgaaaaggtgtcactttgggagaatgtgccctgccttctccatgcacaagcatgcttatgtgtgcttaggggcatgagaacaggaggagcagctgggcagcctgagctgaacccactccatcctcacctgcctagggggtgtggctggggcctggtggggtctgtctgccaccccagtccatggctcttccttctctctgactcacactggtccagctcaggcccctcatcctctagcttctgtgatcgtggttcaaaatcttaccagtgatatgctggagctgggtccagctggcctgcagggctagctgtgcacatctcttcctaactccagtgatcagaaacgatgccacattggtggcatgaagtcagccatgatgggaatatttaaggcacagagatcaacagatgatacaaatcagaccaccatcaaccctccttgagaaccagttgtaaacaccatcacaccccagtcctgcctgcaggtataacgatcactgatattaggtgccggcacctgctaggcatttaatatctttttttttttgttttgagatggagtcccattctattgcccaggccagagtgcaatggcgtgatttcggctcactgcaacctccacctcccaggttcaagcgattctcttgtctcagcctcctgagtagctgggattacaggcatgcactgccacacccggctaatgtctttgtatttttaggagagacagggttttgccatgttggccaggctggtctcgaattcctgacctcaggtgatcctctcacctcggcctcccaaagtgctgggattacaggcatgagccaacgtgcctggccagcatttaacatcttacctgcacaaaaatcctgttagatatttctcatcatccatatttcatatggggctcataacttacatgatttgactccaggtctctgcacattacattgggccatgtggcctcaataagtagaaccatgggatttgatagggctggcagagctgttaggaatcatcagatcatgtaatcactgcgctcatttgacagagaaactgagctcaaagaggctcaaagaggtgggggcttcctctgttaatgccacctaacacggtagccaccatcttcccaacacctccctcaacacctctctcagccccctaccatgctggtgtccactgaaaagccaaggtcgcagtcacttgatgttccctatgcatggctgattttttggaaactttacatgcagatcttgacattcattgcaagttatattttgttttgcttgatttgaccccgtgttcgagactctcaaaaacattttaaatctcacttgggtcattggttgtatgtctcctttctagacaggtaccacgcgccgctttgatctctgcaccttcgcagcagaaattggggttaaactttaaaaaataataagcaaaacagaactttggggcccaacacttgaagttcccaccctatctaccagagattctggcatctacacaccttggaaagtgggtccctcctcccgcagggctctgtctgccccactgtccactttggatttctgcgctggggaacatcagcagcattttgtcaaaagcccacggaggcccacgctgcgcgcctcgccggtaacagtcactctcccgtttaaaaacagagcgccctttcctctctcccctctgcccaagactctttgcctggcaacagggtcccctgagccattggacatgcatttcccccgcttccagagagcggttctgcaccaggacccggccctgccctgagtctgcgggctgcggcgaagagaccgcacttgcccggcaggagggcggacaatgacccgggttttccaccgactccagatgcgtccctcctcctacccctccaccttctctacctcggagaagccattgcgcttgcctccgccccatcccggagaggcagaatctcctccgtccccgcctcgtaccctcctccccgcctctccaggcccggggggcttcacgttcagccaccgcgaccccgggcgggcgcggcgccaggtgagcgctcacctggggccggagggcggggcaatgggggaggggcgggggcggtccaggggcggctgccccacccgcgacggggcggggcgagggcggtggggccaatggggcggggggctcgccgcccggggctggggagcctcccaatctcctcctttcccagcgccgcctgccccgccccacccgggtttaaagtcccgcgggcgggtggtggcggagctgcgagcttgagcggcgcgaggagatgctagagggcgcagcgccgccagcaccatgcgccccccgcccgcgctggccctggccgggctctgcctgctggcgctgcccgccgccgccgcctcctacttcgggtcagtgcccgccgcgccccccgcccgctccccggcctgcctgtctctccctcctgcgctacagctgggccaatttttccctcccgctgtccttggccccgccgaggtctcgaactcagaccctagcccggcgcgacccaacccacttcgcagtcggagttcgcgccctgagttcggtctccagcttccccggctccgaatccatcgccctgttcagtgtccgagtctctggtcgccccccagccgccgctctcctcatcccgccgggtctcggactctgcgcacgcctcggaccctggccccgtccgccccggccccgcccgttcaggcgtcagtcccgctctctgatgccctctcgggatcctcacgccggtgccctgtctgccgccatcctggcctccggcgagccgtccttgcctcggactccttccccaccctccgccttcgccctgcggagcggagaccgagagggctgggtggatgggtgggacgggctgttcccggtctcggggcagaggatcgtgcgcgtccagggagaatgggggaaacctcggacggtgagagcgccagctggagacgcaggaaggaaccgtgcgctggggaaatgcgaccacatctcagacctggcatggggtgatttctcaggagaacactggaaagagtgagagggcccagtgtgtgtgtgtgtgtgtgtgtgtgtgtgtgtgtgtgtgtgtgtgtgtgtgtacatggttggaaaaggaggatcacagtggggggtgacacctgggggacagtggggtaggtgacactggggagagagccggacaggaactatgtggggaatgtttggagcaaaagttatagggcaattgtttccagtcccttcttctctgaccctgaattgcagggatttggtgagggatgggggcgggtatcatgggtaagaaggcaccttcccaccatccacccaaagccaactccaatatgtacagcctgttactttaagccttgcctccttttaaaatcttcaccccaaatcaataggaggcttacagtctgagtatatacagcaaaggcaagaaaacaccaagcaagtgacctgctagaggctgctttgaagaagtagccagggagaggtatgtaaaggtctgagaagttctgcacaggttggagtaagggctgtgggctaatttccaggtcatgacccctggtggaaacatgtctgggctgtggaggagggtatcatcccagaccctagctctgggcttagcttgctaatgatatgggaagaccactcagtctctgggcctcactttctccttttgtacaaagaaggggttgaacttgatatgactgatccttttgcgatccaccccaacagcagtgcacaacttgtttgtttccgaagatttcaggcttgaaggaatggttgttccctcggcaggcaggatgtcatcatcactagggcacagactctggggtcagtcttgccacttgctaggtgtgctcttggccaagtcacttaacttaacctctctgtctctcagtctctcaatctgtaaaatgaagattatactgcctattttataagaagattgagctagtacatgtaaagcacttaggacagtgtctagcatgcagtaagtgctcaactaatgctagtgacttttttttttttttttttttttttttaagacggagtctccctctgtcacccaggctggagtgcagtgatgtgatcttgggtcactgcaacctccatctcatgggttcaagcgattctcctgcctcagcctcctgaatagctgggactataggcgcgtgccaccatgcccagctaatttttgtatttttagtagagacagtgtttcaccatgttggccaggctggtctcgaactcctgatctcaatctgcccaactcagcctcccaaagtgctgggattacaggcatgagccaccaggcctggctagtttttttcattaaggaaaccagttatagaatcttgatgtcctggccctaacagttttctgagctggaatggaaagggatgggacaaatggtacctatatcctcttacacactggctcatttccacgattcatttgtttgcttggtttttatggttagagatggggcaagagtcaggtgagatgagaggagaggggttccaggaggaccaccctagctgctgtattggaagggaaaggtgttctcagcagtgcatggggttagaattttgagggaactgagcatggagcagccttgaaaatgacatgtgagatggtcaaataggcctgggttagggctgagagggatgagtatcggagccacctcttccaggtcaggagcccagctggaaagagctgacaaaagacacaaaagccaccaccaccccaatctggggagcaggacagatgctcagagaatcagctaaaactggggcctcatgatgttaagtgtttggtctcagggaacagacaggattcagcctgagctctcagttaagaaaccctctggtgactcagaccaggtttcccagcttcccatctgcattcgctgtctgggaggaatctggtatcagtcatctacactgtagtgggaaagtgaggcaaagcgcttcttcctccgcagtcatttgcatttgattataacacaaagtgctttggcatcctgataagagaatatgcaaacatcaggagggcaggtgaggccgatcttcttgggctctttgaaatcatagaatcgtagacttcagagttggaagtgaccccagaaggatctctggtccaaaactcactgcttcaagcaggatgtattattatcccaatttttcagatgaggcaacccccaaaccccaaaccacagtgagccagctgttggttctgctgcttttgagtgagcctagagcctaattctgttaatggtgataaaaaaaaacataactagtattgcagtttacaaatctcttttttctttttttgagatggagtcttgctgtgtcacccaggctgggtgcagtgtcatgatctcggctcactgcaaccgccacctcctgggctcaagcaattttcctgcctcagctttccgagagctaggattactggtgccccccatcacaccccactaatttttgtatttttaatagagatggggtttcaccatgttgggcaggctggtcttgaactcctgacctcaggtgatccacttgcctgggcctcctaaagtgctgggattacaggcatgagctaccatgcccagcccatcactttctcatacagccatctctctcatctgatcctcagagccatttctccagagccatgtaggatgggtgtaaatagttcccacaaggaatctgaaggtcagaaaggttcagtcagtcacccagtgttacacagtgaatcggtgggggaggttgaatagaaaccctgcttccagtctgggcccttcaacctacaggaacagcctccagtgctaagacagtatgattcccccagggcagcagtggctgcagagaggccgaagggggtgagggtggagggagcctcccttccctgcttaattgactcttttagactctcttggctgtagtgagatggataaggccgcacattcttttctgtcctcagtagtgagacgggttgcactgacccctgctagactgtcagtttggctcacagaacagcatgatggcagtgggacaggaggcggaccagaggtgagggtccaagctagtcctggctctgggacactctctgtgttgtccctgatcaagtcactcatctccaaggtcagtagcacctggaggtgctaaggttccctaatgctaacagggctggtcctggctctggaagtctaggattgctgaagagtttttattttggctttgaatgcctaggaattccacaaatgttaacttctgtgatgttgtataaatgaaaatgcactgcattatgtgatgagctgggcacaagacaggcccagttacccaatccagtctatttatttatttatttagagacggagtctcgctctgtcacccaggctagagtgcaatggtgtgatctcggctcattgcaacctccacctcccaagttcaacagattctcctgcctcagcttccccagtagctgagattgcaggcatgtgccaccatgcctggctaatttttgtatttttagtagagaccatgttgatcaggctggtctggaactcctgacctcaaatgatccacccacctcagcctcccaaactgctgggcttataggtgtgtgccaccatgcccggcccccagtccagtctgtaagttatccgagtggctttgtaactagaaatagtttctgtggatgcaagtttttaaatcataattaactttggtgatgtttcttcagtgtgtgacctctgcactggttgagtttctttcctctctagggatagtacagagaagtttatgaaagcccaagacagtgaatcccagctttgcctgttgctaactgtgtgactttagacaaatgtcttaaccttgctgagctttgggttatgagaatacctatctgagaggtgagggtgaggcttaattgaaacaatgaatgaaagggctggatagggtgtctggcacatatgtgctaagtgctcagtccaggctcactctcagtggatgctggggttctaaacatcatcccaggtggtggaagtgtcattactataattccattggagaaacaaaacataatctttattttccccccaaatcgttgttatatacaatgaaatgcatgctttttctttcttttttttttttttgagatggagtctcactatgtcgcccaggctggaatgcagtggtgcaatctcggctcactgcagcctccgcctcccggttcaagtgattctcctgcctcagcctctcaagtagatgggatgacaagtgtgcgccaccatgcccagctaatttttgtatttttagtgaagacacggtttcaccatgttggccaagcaggtctcaaactcctgacctcaggtgatccacccacctcagcctcccaaagtgctagaattatgggcgtgcaccaccacggccagccaatgcatgcattttaaattgcacagtttgggttttaacaaattatacacctgtgtaacacatttgtggtgactccaatgactacatagaacatttctaccatcctaaaggatcctttgttcctctttgcaatcaaccctctcccaccagcccatggctactccacttctccgctttcagtcactatgtgttagttttgcctattctggaagtttatatcatgaaattgtgagtatatagcctcttttgcttggattattttgctcagcataaagcttttgagattcatccatgtcgttgaatatagcaatagcgaattcctttttatggctgagtattcctttgtatggctataccacaaattatttatccattccccacttgatagacatttgggttattttggctgggcgtggtggctcatgcctgtaatcccagcactttgggaggccgagacgggcagatcacttgaggtctggagttcgagaccagcctggccaacatggtgaaaacccatctctactaaaattacaagaatcagctgggtgtgatggtggtggtgcatgcctctaatcccagctactcaggaggctgaggcaggagaatcacttgaacccaggaggcagaggttgcagtgagccaagactgtgccactgctctccagcctgggcaacagagcaagactctgtctcaaaaaaaaaaaaaaaaaaaaaagatatttgggttatttgcagttttggactattccaaataaagctggtataaacatccatgtacatctctttttgtgggtgtatgttttcatttctcttggataactgtctaggagtggattgttggatcagatggttgatatatgcataacttatagaattggcatttttcagagtggttttaccattttacacagtaatgtatgagagttccagttgctccatattctatggtcagctatcatcagttttaacttgtggctattttcgtaagtatgtagtagtatctcattgtggttttaatttgtatttccccattgatgaatggtgtgttgaacattttcccatgtgtatattggtcatttgaatatcatttcattgggttatttgtcttcttattgaattgtaagagttctttatgtattttgttgttgttgttgttgctgttgtttgagatggagtctcactctgtatcccaggctggagtacaatggcatgatcttggctaactgcaacctccacctcctggattcaagcaattcttgtggctcagcctcccaagtagctgggactacaggcatgcgccaccatgctcggctaatttttgtatttgtagtagagataaggtttcatcatgttggcctggctggtcttgaactcctgacctcatgtgatccacccacctcggcctcccaaagtgctgggattacaggcgtgagccacttggcctaagagttctttatatattttggatacaagtctttgtcacaagtactggtaatattttattcctgcccgtgacttgccgtttcattttcttattgatgtcttatgaagaacagatgtttttaattttgatgaagtccagtgtatcaaccttttcttgtatggtttgtgctttgttggtgttctacccaagaaatctctgcctacccaaaagttgcaaagatttcttcctacgttttctcctttttattttattttattttattttattttattttttggagaaatgatatctttcggtcctccaggctagagttgcttctgctgcttttgagtaagcctggagcctaattctgttggtggtgataaaaacataataactagtattgcagtttacaaatcactttctcatacagccccttctctcacctgatcctcagggccattcctccagaaccatgtaggatgggtgtaaatagttctcacaaggaaactaaatgtgttacacaatcacagctcactacagcctcgaccttctggactcaagtgatcctcctgccttagcctcctgagtagctggggccacaggcatgcgccatcacgcccagctaattttttatttttttgtagagatggggttttgctatgttgctcaggctggtctcaaactcctgggctcaagcaattctcctgcctcggcctctcaaactgctgggattattggcatgagccacagctagaaacttataattttagctttttttttttttttttgacagaatttcactcttgttacccaggctggagtgcagtggcatgatctcggctcactgcaacctccacctcccgggttcaagtgattcttctgactcagcctcctgagtagctggaagtacagatgcccgccactgtgcctagctaattttgtatttttagtggagatggggtttcaccatgttgggcaggctggtcttgaactcctgacctcaggtgatccacctgcctcggcctcccaaagtgctggcattacaggcgtgagccaccacacccagccaatcttagcttttacccttaagtctatggttcattttgagttaactagtgtgtacagcatggagtaaggggcaagcttattattttgcatatgaatgtccacgtgtttcagtgccatttgttgaaatgatgatgttttctccactgtcatctttgttgctcatcaattgattcaatatgtgtgggcctatttctggacactctactctgtttcatttatctatatgcctatccttatgccaatactatacagccttgattacagtagctttaaaaaaaatttttccccaataagccttttatattcctagattactatagctttatgttaagtcttgaaactaagtactataagttctctaactgtgcactattttttcgaaattgcatgggctattcagggtcattgtatttcggcatagattttagtagtatctcgtcaatatccacatgaaagcctcctaggattttgactgggattgcattgaatctatacatcagttcatggaagattgacgttctaacaatattgagtctgctgatttgcacacaggccatatctttctatttagagcttttgtaatttctctcagcagtgttttctagttttcagtgtgcaggcattgaaaatttaaaaaaagaaattcttccaatgtgctctatgtatttagatagtattgtttttatttttaataaaaacacatttttagaaattgaattggggcctgagaaaaacatagttggagggaaggaaaggtaaaagaaattttactgctttgggggtggtggactgaaagccaaacatcgctgataagaatcactgtgttttgggaaggaatttaggccagcttgtctctggctgagctgtaacccctgaggagctgggctccagagttgggctgagagtcatcctagcctcttcagtggatgatggtggactttctgtggctgaggacgggaaggaggagaggagggaagcggggccggcagactcccgggctggaatctcctaaggaagagaggtcctggtgcctttgggattatgtgctcaggtggaagttgggctcaggaggaggtgggccaggtgctgtgagggtgactcccatcctggcatcagcatgagcaggatcggacatggcccaaggccctgttatagtgtaaggggcactgggcttggggtcacacagatcagagttcaaatctccatctaccacttactgactgacccagggcaagtcagataaccattctgaccccagttttctcatctgtaaaatgggataatcttgatctcttaggcttgttgtaagagttaaatgaatgtatatataggtattcaaatgctatctctatataaggattccaagaaatctagtgatctgccttacagcgtcccacgtttagaagagtctttggtggtgacatctgttccttcttctctgtgcctgtatcccagccactgtacaattcagaacaaacccagccttttctgtgctcagcactttatgtgcattacttcacctcacattgtggcaacccaggaggtaggtgctgatataattctcatttattttaaaatttcactttttttttatttttagagagataggttcctgctctgtcacccagactagagtgcaatggcttgatcatagctcatggcagccttgaactcctgacctcaagcagtcctcctgcctctgccttctgagtagctgggattacaggcccaaggcatcatacctggccagttatcctcatttataggtgtgcgtgttggggggaaactgtcagaatccaagccaacctcttcatctctgccatatgttggcagtggaaccccaactggaggcctgtccccttagggcagctctgtccctctgagccccgaccctgtggcccaggccctgcacttggtgcatgtcctgggcatctgttgtcctgtgtgtctcaaactcttggctcattagctaatttttcaggtgctcaggtcttcaattcacttgtagtttcctttagtagagacctcggggccctgctgttggctgagtcccacagtctctagcagtgctccctggtctgcagtgaatatcttggtgggcagcgtcctctccctttcactggcccttcctttcccctggaatctccctctgtgccctgtcccattcactccttcatcttctgcctccatgggctctctggggcacatactacctcacctaggcctggccaactgggagccatggcctggcttctgtcaggataggaactggacacaaagcagagagcagagacttatccccatcggactccagaaatcagccacacccaccacctcatggcatgctggtagcagcagacatgagctgggggcatagggtggcctcttctacacccaagcccctcattggagagatgaaggctgaagaggagggtgaagagtcttagagccagaaagaccaactaccaagctctggtcagtcctggaaacttccaagaggctggttttagggcaagaccaaagggtttgtttttcctggtgttacaatccctttgaggccagatgctgtcagaattcaacatttctctttgaattttagaaaagtaggccgggtgcagtggctcatgcctgtaatcccagcactttgggaggctgaggcaggtggatcacctgaggtcaggagtttgagaacagcctggccaacatggtgaaaccccatctctactaaaaatacaaaaatagctgggcgtggtgacagccgcttgtaatcccagctacttgggaggctgaggcaagagaattgcttgaacctgggaggcggagtttgcagtgagccgagattgtgccattgcactgaagcctgggcaacaagagtgaaactccgtctcaaaaaaaaaaaaaaaagaaaaagaaaaagaaaagggaaagaaaagtaatataggaggtaggggaggcagaacaaataaacttaaaaaataaaaattaaaaaattaaaagtacagaaaggtaacgtatcgtatattccatggctaacagcacctctagcaagatctggggcagcacctgtaatcagactctattaattttgcaggtagacatctacaggttgggataaacaaagcccataatattctccctggtttgggtcagggcttgctaccgtatgagttcaccacaattgttaaaaaaacttgtagttttctgagtttcctggaatttggaattgtggataagggtttgtgaatctgtggcaaattctgagcccaagtcactgcgagaggttgtgcaagctgagttttttttgtttgttttgttttgtttttttgagacggagtcttgctctgtcgcccaggctggagtgcagtggcaggatcttagctcactacaacctctgcctcccaggttcaagggattctcctgcctcagcctcccgagtagctaggacaacaggcgtctaccaccacacctggctaattttttgtatctttagtagagatggggttttaccatgttggccaggctggtctcaaactcctgatctcaagtgatccgcccgcctcggcctcccagagtgctgggattacaagcgtgagccactgtgtaccaggcctaagctgagttttaaacaaagactcaggccagttgcttggctggtcctcgctgggtgtcaccaggctacccaagcacagatcttccccaggaactgaggttcagagggaacgggcctggctctcagaccccaaggtacagggccccacaggggctgaggaccatggcgggatggccccgagatctggcactggggagagcatacgccagcaatcagtcgtgggctagggagggcgtggcacaggcagcctcctccagagccacgccctcccaaagcccgcccagccccagcttgggaaggtttggcggtggggcgttaggtggtagcctctgcagccagagagcaagaccacagcgaagccagcagggtgggactgcagggaggctgagggacagccccgaactgcactccttgcgtggggttagacacctaaggggcataatatgcagccagcaggtgtctgtagagcatctgcttgggaggagcacgcatctggactgggaaagaatggatctcagggtatgaaaaaccatggcctctgccaaggagcttacaggatacagctttgaagaggaagaaaggagtgtctgccatgcggaactgatggtactatatatacaaaagtgggagaagacaaagaaagaggatggttagagggggatggggctggcaagtaaggagggcttcctggaggaggcaaacaaacatcacagcatactagagctgtctgggacctcggggtgatcaaatgttaaaaaaggacatggctataaaaggttccagggtatccatgagggcttttggactgggagaaggttacagcatgggggtcggaccgagttagacatggcagaggacaagggagagactagcctggctgaggggagggtcccctttctccagccctggctggctctggatttaggacagtcctagtggttctattcccaagggagccgctcacaactacatccatcccagggggtgtcctggactactctgggggtggatccttgatcaggcagggaggttcctgctgtccctacagctgggcgaagggtgtgggccatccgtggggcctgcaggagaacaagtggaatctgcagcatgggacatctctgcctagagcctgtgcaaacaatggcactgtcctcatcattgagggggtcacgcacaaggcattccccagaggcctggcccttccagggcccaagcccagcctgagcctgcctgtgcgtgggaagagggtgatcggagcccagggtgcattcaagaacctgtcaaggtagttagttggtcaatgcgtcatggttaaataacttggctgcagtcacccagccagagtcacccagtaccctggttgggtaggaacttgccaccaggagtgcggtttcagccatgatttgcctttccctgaacttcccacccactgcctccacatccccacaccaagctcccccaactccttctcttcacataccaggccctctcctttgaacttccctctatctagccaagtatgttctcaagcactggtattgtatcagactctcacactttagtatgaagaggtaggccacttctgtaagcctgattcctgactttttgctgaagagactgagtttcagaccagggaaagtagcctttaaacagagggtctttctctcccttcctgagggtccacccttgggccacccagggggtcagaggagtcctgaccaggtttccttccctcaaaacctagctgtcttgcatttccaccaccttagatgcttgctgtggtgatggctgatttggcttccctgatgtgctgggtctgcaagcagaaactgccaggcttggtggaagcaatcaagagacctgggccacagacccagccctgctaccaagccagtgggtcgccttggacgaccaatcttgcatgaatttgtggccaccggagacctgcacacttggcatgcccttgccctcctgcttccccgcacagcctccaggacaccttccaggagccagcagagcagaacttctgggccgggtgaccttaaagggtttctccagctctaacgtataatggtttgaatggtgtacatttggactcagcctaggaactggggtagatgtttacagtcacagactcatagaggtgatggatccttctttgcaggaatgactttggggaccctccgcagccactgtgacacctgatgcatacgtgccagggacaaaggcttcctctccttggcttcagcccgagcctgagtggagagggagagagacaggaggaagaagaaaaagcatttccttcacagatgttgaactagccacactctaaatgccggggattgttgagatgcaaagcatgcttgctgtgcgagctgctcactacccacttagcccctgagcacgtctccctgatgccatcccctgcaggcagcctggtctgcggctgtgagacaggaagtggggctgtgcttggagagacaaagcctacagctggacccggctctttcctctctgagtcagggatgggtgggggacgaggctgtggggtgggctccagcggggaagtgtggccagattcagtcctcagggtgggttcatggggatggagggtgagagctgggtagggaaggaaggctggatccaggagtaggggttggggagccagacaggaggaacgagtggttttgaggtctgtgggtggactgggcaaaaagctgatgcttagaaaagtcctttttggtgtgtgtgacagggtctcactctgtcacccaggctggagtgcggtggcgtgatcatggcccactgcagccttgacctcctgggctcaagcgatcctcctagcctgtagctggaaccacaggcacgtgccaccatgcccagctaattttttaatttttaattttgtagagacaacgtctcacttacgttgcccaggctggttttgaactcctaggctcaagtgattcacctgccttgacttcccaaagtgctggtactacaggtgcgcgccacaatgcctgaccaaaaaaatcctttatagttgtacttttgtttattgatactcagttaatagaggtataaatgaatgagcgagtaagtgaaaagagggggtggagagagttgggcataaaggtaggaaggttggaaatagtagcttccgaatttgcctggctgcaggacgtcatggaggaggtgcaaggtggcattgggtgctgtagaagagaaaggcacctggaaggtagaggggagggtgtgctcacagtaggggaaatctggggcctcccagtgtaacagcaggaggggagagaagcctggagttggtgttgagcagccaccctcaaaaaagggctgcccagagccatggtgccctctcttactgggccaggcactgcccctcactgaactccccgctactgggaagaggttgggagcggagagcacaggaggggctaggggtgtgtgagagtgtgtgtgtgagtgtgtatgtgcgtgagaatgtgtgtatgtgtgagagtgtgcatgagtgtatgtgcgagtataggtgtgtatgaatgtggatgtgtgtgtgagggagtgtgagtgtgtgtgtgtatttgtgtgtgtagggggatcagtgagggccaggagaggtagactgagacgtttgagatgaaagcacaaagggcgcactcaccatgcaaatggccttgcagcggaagcctgttatcaggagcatctgatggggtttttcagggtggaagccagcaccccgggcagcacaaggctttcccggttcccaggcagctgcctgtagttggcatggccctggcgtaatgcactactcctggaccctccagctaagagtccagacacactggcattacctggtgccctagaaaccacctgccttgtcctgtgccacccacccaccacatcctggggatagcctctgctgaaagcatcagaccctctcaagcagaaactaggatgggagtaggtggaagaacagggcttggggtcctcttaggtgatgagaaaagctctccaccaacctggtcttccccaaacagcctggagtgctccctgagagcttcctcttgcctcctcctcacccccaggcctcctacaggcaggatgggactggtcaagatcaagttctcacctgcatggtaccaggagttctgatctgggtccctaagcagctactggtgtttcctcaaggaggcaggccagtgcaaagctttctcttccttccccttcttggggccttgagagagtctggaggactcctgagtccaaccaacttccttccagactgtgagcttcttgagggcaggaccgtgtcccagcacagtacctggcacatggtagatgctcactaatgacaaatacttatctggagcttactgtgtgctcactgctctcagagcatagagaggtaaagcaccttgcctaaggtagcacaactaggaagaggtggaggtgggatttgaacccaggcagtctggctccagccatcccctctcatgagttaaggtgtatttgtttgatggaatgagctcagttggtgaggggacaaccctgaggtcacctcggagtgagtcagacctaggaccagactacctaggccagaacagccttggggcatgagatccttgggccccactctccaggcagggggtgggtgattactgaagggtgaggtccctggggtcctgctgacggtggacagagcagtctcctgggaggcttttgccaaaacctgggagagccatcttctgcttccttcaaggtcaccccagcggggcagctttagccacaattgtgggtggggtgtgtgttggagagtgtgaaaggaggtggggaaggaggttccaggaggatcagaagagatctgagggtgagagtgtgtgagatgaagccctgaggggcacccttgacttctcccactctagagaaagacaggctggtctgtcaagtggttgggggtgtcctggggtccaagccagaggtcatcgcatgtgtggaggtgggggctctggttttatgatgaacctgaccaccaaggaccatggggtgaaggtgcagagaacagaagggcacagactgggggcagcaaggggaggaggcggccgctgttcacctggggtcattgctttcttaatgggaaaagagaggctggaagttagcctggggagcctgagacagacaggaatagtggaggtagctgggccaaagcaggtgcagcctgatagagtggtggccccaggaggctcaggagcacctgagtcaggcagtagcccccagcccagaagagcaattagcaagttggcaaacaacccttcctctgccctttagttcagaaccctggttacttgtttaactgatctgatagcatctcattggccataaggcagcatcttcattaagacccccatatttggctgggcgtggtggctcatgcctgtaatcccagcactttgggaggccaaggtgggcggatcacatgaggtcaggagttcaagaccagcctagccaacatggcgaaaccccatctctactaaaaatacacaaaaaaaatagctgggcgtggtggcacgtgcccataatcccagctactcgggaggctgaggtaggagaattgcttgaacccgggaggcagaggttgcagtgagccgaaatctcagcactgcactccagcctgggtgatggagtgagactcgattaaaaaacaaaacaaaacaaaacaaaacaaaaacaccaaaataaacacatttttctgggttcataagactaaggaagcccacttgaatttctccagttgtccatcttacccccttggcactcagctaactgtgggtaattgagatttcacagagggacccagtgagtggtgtctgcagggctgggatgccaaacagtatgacttcttccaggggatgacgttgttcctgctgacctctgagcaggctgaagcctgccacacccagaattattctggggtctaggaagataccttcccagcagaagccatgggctgagcatgtgtcggataattcactgttgaggaaaatagatggtcattttctaaatatgatgtcatggtactatttcttcaaaggaaatacgatcccaaactgcaacacagaaaataaacagagggaaactgggtctttgaggcctcccaggctgtcttcatgggccctgtggggttcccgaggcagtgccagggagccttctttgagagcagccctgggcagaccagggcccggtgtggcctgaggcctctgtgcggttggctacctttcctggtcattaatcgctactaagtgtcattaccactaataaaattaaccgacttgatactggactctctgagccatcaatctcagggtccattagatgaaatttaaaaaacagatgcctctggggtggggcctgaggatttgcattccacagagctccaaggcaacactggccatgcagagctgggcaccgtttgagacccattgctccctccagggtctcttcccctgggcatcgcggacattgtggttggagtggagccgttctgggcactgcagagtgctgggcagcgtccctggtctccacccactccatgccagaagcaccaaaaacgaaaacaaaaatgaacaaaccaacaaaaaccagatgcctgttgaatgagtggaggggtttgctgggtctggctcccaagtgcagcctagggaattctggcactcttcacatgtcagaggtcataatcaaggatgatgcatttagttagacaaaccaactttgagccttcgctccacactacatgggagtcccagacaagaacacagcttgggcagggtgcagtggctcacgtctgtaattccagcactctgggaggctgaggcgggcaggtcacttgaagtcaggagttcgaaaccagcctggctaacatggtgaaaccccgtctctactaaaaatatgaaaattagccagggatggtggcgcacacctgtagtcccagctactcgggaggctgaggcaggagaattgcttgaacccgggaagtggaggttacagtgagctgagatcacaccactgcactctagcctggaccacatagcaagactgtctcaaaaaaaaaaatgttatatatcatgtcatatcatatgacatatactgtagctataatgatataataatcatagctattattcttaaaatggcatttgaggcaggtcttgaaggatatgcagcttcattggccaaaatttccatcactccctgcttgctctcccctctgtcaatcagttgctatcagggaggtccagtttctgaaacacaggaattgtgtgagcagaagtcgccactcacaccagccctcggtgtgagaaggaggacatttgagggcaaggtagctgcagcccccaagctgccctccacactggaagccagtcaaggcgtggcctcctcagctggagttgacatccagttcttctctggacctgccaagggtcaaactctgaggatttcctgccaggctgcagggaggggtttgggtgtagacctggtggactggaaaattacccatttgcccccagattaatgattaacgggtccctgccctcaccctgtctgggagaggagcccagggccaggctaggccaacgggagcccgatagcatctgtctctgctcggaggtttcggagatatgctccatgatgggttgactgcacctgatgggtgtggaatctacaggtgatttctgagggcacctggggcctggccaggccgcataccctctggtgaggcttccaacttctggggcatacagagagggcatggcctccagccagatgtcctggctaaggcaggtgactccaaagaggagagctgtgcccttggctcagaggaacatgggcttctctgaccactcctggcttgaccacaggacttaccttggccagtggcacatgagcaacagtggcaagtgccacatccaagcaggagctctaagagacattgcctgcttccacctttgcttttttttttttttttttttttttgagatagggtcttgctctgtttcccaggctggagtgcagtgatgcgatctcagctcactgcagcctccacctcccgagctcaagctatccttccacctcagcctcccaagtagctgggactacaggtgtgtgccaccatgcccacataatttttctatttttagtagagacagggttttgctgtcacacaggctgctctcaaactcctggactcaagcgatccacctgctcagcctcccaaagtgtggaattacaggtgtgagccactgtgcccagcccacctttgatcttttaccctggctatgaggccaggatatcccagaacagggttacttctcttgggctgggtcctggaatgatgtatattccacccacactgggggcaccaggatataggacagcaaacattttgaaccagcagagccatctcacagagagcttctgggaagagggaagacgaactctaattccaattcccaccctgctgctgatctgttgtatgaccagtccagtcactgccccctcgtaaatcctttgtttcctcatctggacaaaggggagactctgcttagctggagagtaaagcatcttgcaaaatgagggaagtttgggaagctccagctagcaggaaggtaggcctgcttgtcccaggcactgtggttagtccatttcatataatcctcccaccaaccctaggaggtagagaagatcactctgcccagtttccagaagggaaaaaaccaaggtgtcaagattgcatagctagaacatcagccttagaatttggtagcttggctccagaatcgatgaactttcaatctaggagaacaagaagtctgggattgatggcctgatgggaattcagctccttcaccttcatctaaccatccatcagtccttccttccttcccttctctttccttccatccccttctctccccaggcatctgtttgtaccaggcaccaggtggtcagatggttgaaggtctatctgggaattatggaaacatgttagattggtacaggattacttgggcagcagcataatgtaagggagagagggatgtcaggggaccttggctgggtgtccgctcaatgtccacatcccctctgcctgccccctctcaggaatgtggctctcttggccaggcagccaccaatactctgtgcattatttcccaaacttcccggatcacaaaagctgcctagggactgtggtaaatgtacagattcccaggcccaattccaaaccaatagacccagaattgcccagcatggatcctgggaaagcgtatttttaataagcaccccagatgatttttctaactgggccaatagggaaataggaaaatagggtggataagaagagcagagaccggaatctggaaaacaggtttaaggtcctgcagcaacctttgttacatgaaccttggtttcctaatctgtaaaatggggacgggacctccagcgggtcagcctgctgcccagaagggcagtaaatgaagcccctgaggaggccccttcccttcatttgcccctcaccaccatccccaaggctcacctgtctccctcctctcgctctctctagcctgaccgggcgggaagtcctgacgcccttcccaggattgggcactgcggcagccccggcacagggcggggcccacctgaagcagtgtgacctgctgaagctgtcccggcggcagaagcagctctgccggagggagcccggcctggctgagaccctgagggatgctgcgcacctcggcctgcttgagtgccagtttcagttccggcatgagcgctggaactgtagcctggagggcaggatgggcctgctcaagagaggtggggaggagggctaggggacggggagggctgggggaagaagccttcagggaggaggaggctgggagaggctgccctttcctttttcctggctcccgtgcccaggccacactgcccttcctgccctagcacggtcccaaatgagaagagtcacaagagttaatgaggggcagttgaaggccagctgtggcccagcctcaggtttgggggagcagaggagcaaggaagatccaagagaggaggagacacaagcctattcctggaggagctcacagataagatggggtcccccagttgtctccctctgcctcttcacacacacacacacacacacacacacacacacacacacacacacacgaaacaaggcacatgaagacgtgaggatgggcggcagctgattccaggcccgatgacacgagccaggcgatgcatttgttcactcctttatctgtccctttgtttgtcacatccatcgatccatcagtccctccttcccttccactcccattctacctccctccccactccacccacccactaagcatccatggaggcccatagtgagccaggcactgtgccagatcctggaggttcagagctgaaccagacccagctaccctcgggaagcatgcagtctggaagggagaacacaggtcaccatgtgactcccttgccaaggggaaagggcttttgacagggaaggatgagggaatgtggcttgaggacacagctccgggtgggtctccctgtcaattgccccttaaactctgactcaagttgccatttaaatggaacttctagcctgggcgcagtggcttgtgcctctaatcctagcactttgggaggccgaagcgggtggatcactttaggtcaggagttcaagaccagtctggccaatatgatgaaaccccgtctctactaaaaatacaaaaatttaaacactgcagttggccggttgccatggctcacacctgtaatcccagcactttgagaggccgaggtcaggagtttgtaaccagcgtggtcaaaatggtgaaaccccatctctactaaaaatacaaaaattagctggcatggtggcaggagcctgtaatcccagctacttgggaggctgaggcaggagaattgcttgaacccgggaggtggaggttgcagtgagccaagattgtgtcactgcactccagcctgggagacagaatgagactctgtctcaaaaaaaaaaaaaaaaaaatgcagtgatgctgtacagggcagccaggcccctcctaggccagctgctctccacggtctgcagccaagctaatggcctctctctgtgtctctctcgggacatcaccagcacccagatgcactggagggcaggcaggaagtagtgagctggtgggaggccaggtttgggccacacccagcagagaggagtgtcggtggttctggagtgggtgggatggtcagtctgaggcaagtcagccaggagactcaaggtcactgtatcattgggtctattccacagtgggtagcagagaatgacatttgagaaccatcatgtgtcataggaagcccatggggcttatctcaggggcctcagaaatgggcccatccaaatggtcatacaccgacctggagtcaaaatggcaggtttagccccaactgtgcctacgccaggtgtctgagtagcttctctttgcatctcagtgttcttctctgagaggtgaaggccgtagcccctggcctgctgccctctgggaatctgggaacatactccatagtgaatttgtaaattccatttatttatttatttataaattaaaaaaatttttttgagacaaggtctccctctgtcacccaggctggagtgcaatggcgcaatctcagctcactgcaacctccaccttccgggttcaagtgattctcctgcctcagcctcctgagtagctgggaatattggcatgtaccaccatgcccggctaatttttgtatttttagtagagacggggtttcaccatattggccagactggtcttgaactcctgacctcaaatgatccgcccgccttggcctcctaaagtgctgggattaggggcacgagccactgtgcccagcctggaagttccatttaaatggcaacttgcagtcagaatttaaggggcagttgacagggagacccacccggagctgtgtcctcaagccacattctcttgtcctgcccatcacagcgctgccaccaccgcctctggccctcagagggcggcaggcaacctctaagcttcctcctttcctctcttccccctttcctccctccctatgcccctgggtgcccgatccaggcttcaaagagacagctttcctgtacgcggtgtcctctgccgccctcacccacaccctggcccgggcctgcagcgctgggcgcatggagcgctgcacctgtgatgactctccggggctggagagccggcaggcctggcagtggggcgtgtgcggtgacaacctcaagtacagcaccaagtttctgagcaacttcctggggtccaagagaggaaacaaggacctgcgggcacgggcagacgcccacaatacccacgtgggcatcaaggtgagcatgtccctggctgcccgcagtgccttcccaccagggtacacagctggggagcatggcttgaaggaggccagcaccccactccccaaaatacatgaagagccgtgaacttcataaaggcaggatgaacttcacgtcttcaaccagcattcccttggcatctactctgggctgtgactgggtgccaggaacacagcggaagcatggaagggtcatgagtgtcattggtggaagcagtggtcaccagtgggagccaggcttaggactaggtctggtgaagcagggacatgtttggagaggggtctccattccaaggaccaggccttcctggaggtcctggaagcccaacattgtttgaaaacctccatctagagcaactgcccacttctccattttatgggtgggaagatggaagtggcccagagaagggaaggggctgaggttacacagtagtgggaggtctggagggtgaaaagtatcttggtctattgaggggaggaggctgggagacaccagtgctctagctgtttatgagattaagttctgagttgtcatcactgagttgtgaaccggggctgctgtgttcaatcattgagttggtgtgaaccggggctgctgtgttcagtcactgagttggtgtgaaccggggctgctgtgttcagtcactcagttggtgtgaactgggactgctgtgttcagtcgcgtaagttgtctattccacaagaactccaggccaaggggaggagctggggctgagaccctgggtctctttcccattctcctgcctctgccctgctggggttggtgctctgggggcaggctctggctgctgggcccaggcctctgaccacgcctctgttctgcctcccccacaggctgtgaagagtggcctcaggaccacgtgtaagtgccatggcgtatcaggctcctgtgccgtgcgcacctgctggaagcagctctccccgttccgtgagacgggccaggtgctgaaactgcgctatgactcggctgtcaaggtgtccagtgccaccaatgaggccttgggccgcctagagctgtgggcccctgccaggcagggcagcctcaccaaaggcctggccccaaggtctggggacctggtgtacatggaggactcacccagcttctgccggcccagcaagtactcacctggcacagcaggtagggtgtgctcccgggaggccagctgcagcagcctgtgctgcgggcggggctatgacacccagagccgcctggtggccttctcctgccactgccaggtgcagtggtgctgctacgtggagtgccagcaatgtgtgcaggaggagcttgtgtacacctgcaagcactaggcctactgcccagcaagccagtctggcactgccaggacctcctgtggcacccttcaagctgcccagccggccctctgggcagactgtcatcacatgcatgcataaaccggcatgtgtgccaatgcacacgagtgtgccactcaccaccattccttggccagccttttgcctccctcgatactcaacaaagagaagcaaagcctcctcccttaacccaagcatccccaaccttgttgaggacttggagaggagggcagagtgagaaagacatggagggaaataagggagaccaagagcacagcaggactgaaattttggacgggagagaggggctattccatcttgcttcctgggatgaatggcttggagccagcatgttcttgggaggtgaactgctgggctaggaatgccaaggcaggcagtgccagctggaagtgaaggcgggagcctggctgagatgggtcaatcgggtcctgtggccctgctcaggtgcagtgggctccaggtgtcacacacctccaccactcccctggttttgctgtgccagagatggggagaaagcacaggtggtagaagccatccgttcagagaaaggagagctttctgtgcttgagtggacccgagtgagatctgtgccctggagccctgtgtccttgatttggcttttcaaatatgcctccgctgaggcctcattcttgtctcgagagctgggttatgcacactcacccagccgtgctcaaaactaccaccagtgcaggtaagacaggtgggagaactagccaccaaggcgggactcagtgcacctgaggttgaacagggagacaacggcccctccctgtgttccctgctggccaaaggaatcttcactcccagcgcagaggaggagggcaacagcttcctggtgcctggcagtgacgtggcgagctcagtttctcagctggctcttgagtgagctttggtgacttcctgtggctggggcctgcctggtctgtgacacccccataccagctgagttcacaatactgaagaacagctggctcacgagctatgacttgaagttacatttctattcttgtggctgctcatctagttaaggcttttgccctggctggggttataggtgcttgagtccttgctaagcctggctcctgggtagcctccttcagttcctaatggcctctcacttggccctcactttggctcttacttgaggaggagacgtgactttgataatttcctcagatcctgtggacattttcagcagcacctgccaaggccctctgtgaaaggaggagagactggtacctccacacaggcacacatggatgcacagcccctggaccaggctgggggttcctgttgcacatgcctctcttgttcaggatgaagaccttgcaggggtccccttgctggaggcattgtacttccccagagtggggcccgatgccacccaggaggaagtgacttctttcgggaagcccttggccactttgctggccctgccacgcccatctgtcagcttcctttctccctaaacctagagttgctgacccttcaccaacacaggaaatttcagaatcagctgaatgctcagaaacctcgcctgtgccagctccaggacaaaggcccgctgactgtgccctggccaactccctgagacctccaagggcgaggaggagctgcccagtctccagtggatcagggcagtctgctggatgctggaaggatttttgactgcagaggcccggctgagaagccaaactgacctgagcccctctcgttaaaatgacattgctgacccaagcacctggcccacaccttggcagcaggagaaaaatggggagagggctggttttctcctttcttccacttccccacagcatggagattttctctgccttcccaatccatcttgctcctccgagaccccaactctgcctccacccaggctcagtgctgggcgtaaggcagcagggacctcactggcagagcagggggcctgggagcaacgtggaggccagagcaccctgatccaccaacatgccacctgcattctgacttcatggctggcagtgccagggtcgtgggagggcaaagggcaggctctaaggcatctaggcagtggctggctgctaacatggacaccccaagtcaatggcacagtgcaggttctgagggctccttggcttgtggggtcttctctgtctgtctctctccctctcttcttccttgctctcatccctttcttttccagttacccctgaagacccacctcggccctcttggggcccctggggactagagtgaccactgacccctcattctacagctttaagggaaatgctcacagggtatttttgtctacctcaaatatatagtttttagagcaaaggagaataatttatatagctaagatatatgagaaagtatttatattatttatatagttgctatatttcacagacagcacaggtggggtttgtgtattttcccggaaaccctctgtctggggagatacagcctgacctgaccgggtcccccactgagcaggaggccgggtcgctgggaaggaggacaaacctgtattccatgactgggtctgtctcggagctggtaagcacatgtccgctctgtgatgagccctggtgggctccatccagaccctccttgtgatgtttttgtagattttctgcccttctgggtccaggcccccttcttctgctctggcaaaagtgtcttactcataatgataatgacaacgagaattcccacacctggcatttgtaaagcactttgctatttagaaacaaaaacttttacccctttcatctcacttgatttctccgttatctctgtgaggtaggtggggccacattactgtggccattttatagatgaggtccagagatggagagctgtgctcaaagtcacacctaagagacttgttcaatgaatatttactgaacatctccatagaccaggcactacgggctgacctgctctgagcccaggagccccaaagcctggataccactgtgagcccaagaactcagggaagcagttccttcccaggctgtgatcccagccttttggatctggatggcatgttggcacttcccccaagtggagtcccatgtctcaggggctttggctgcctgagaaggctggagagaccaggaacccatggaggccactccaaggggtccttctgcccacactgcccaagaagcttgggctacaccactgggcccctcccaacctacagatgaattttgattgctctcatttgtgttttgcttgtaaaaatgaattgttttccactggatttctggctgcttttgcaaaagtcagctgcgctggcagactgggcctgcatgtcctcctgcaggcagctagagtgagggagtctaatggacaggatgccccaagtgcccccgttgctcatggatgcccctgcctgcctctcatgagcacatagtcctgtcccctggtctagataagcccagctttcctggtacccttcatcacctggcagacagacagccccatgccaaccctggacattacttgcttttgaacctttcctttctcaacaaccatgaacttcaaatgctttctgtctcaggacactttagaataacaatggaagccatcacttattgagcaccccttatgtccatttattcaaccaatgattatttagggatctcttattgagcaccaggcagcatcctgggtgcttggtgcagcaaggaacaggaccaagtctctgcctcatggggctgacatcctagtgggtgagaaagacaataaaccaataaatgacatgccagttatttgcatttactttgtctcaatttattgcaataactttgcacattggacatggtccccgtaatggataaggaaatggaggttgtgagatgagaagcctcctcattgcaactggcaggcagtggggccaggattggaacacagatctcctggcctccaaagtatgggatttttttcctctgtacactggtataggtcgggcagggatggatcgccccattttattgattctgggtaaactaaggcctagaggaaggaaataatccatcctggattacacaccaattcagacaggccagagcctgcatccttcctggagttgataagcatttctggagccctcatgctatggcaagcagcatggctcagggtggggcgggatgaagccaaccaggggccttcagggacctacagtctaataggagaaatgagaagcacagccatgcagtggtttgggtcatttacacacgaatcctgtgtcccttttctggccacagttccttcccaacatgctttgggaggcctcgcccaccaggatcctcctgggggtctgatgggagaggaggcctctttctgagccaagcacagcagagagtgcctgtctcctggctcaggcctgccctgccccagttcttcagccctgctggggtccacattgccttaactgggctccccagggcgggaggcagaggtgggcccacagtccagccctgcaggggcctacatttccaccagcatccccgtcctaacatgctccttctacccagtgttcctgggcctggagaccagctggctctgagtaatgacagacacgtccacatgcagcagcaggctccagtttatcaagggatttctcatctattttctctcttgaacctcacaaggtggacacccttcttctttttttacagataggggaattgagacacaaaatggttaagtgacttaccaaaggctatatcgctagcaagcggatccaggccttttgcctccaaaccccatattctctctaccatacaccatcctcacctcctcctgccctcatctgagccttactttgttcctgctcataatctagttcccaaacaggcccgcagacccctccacctccagctgctcaatgccaccatcttccaggaggaccggggcttgttgagacagtcactaggtgggtaccctacccgcaatatccctcctcctttaaaaacagccacatgtgctttctgtctttgcatttgcaatatctatcttgttgaatcacttgtgagacctttgcagacaccaagacacttacatactttatcatgtatctcctaaggacaagaacattctccaacagaaccacaaggccatcaccacatctaagagatgtaacattgacaaaaattatctactacatagtccatattcagacttccccaattgtccctcaaaatgtcctttataacattattttctggccaggcacaggttcacacccataatcccagcgattggagaggccgaggcaggaagatcgcttgagcccaggagttcgaggatatagtgagctgtgattgcaccactgccttccagcctgagcgacagagtgagaccctgtctctaaaaaattaaaattaaaaaatttttaaaacatgttttcctggcccaggatccactcaagaattaggcattgcacgttgttttcatgtctctccagctccctgtaatctagaacagtccccctctttctttgctttcataacagtgatagtttgaagagtccaggctgcatgtctcgtggaatacctctcaactgagatttgcctgatcgtttccttgtacttggattcaggttaaacattttggcaataagctgcttgggtgatgtgtatcctattctgtgcatgctgtaaggagccacaggatgttttgctcttgttgcccaggctggagtgcagtggtgcgatctcggctcacagcaacctccacctcctaggttcaagcgattctcctgcctcagcctctagagtagctgggattacaggctcacccatgatggggatggggacattctggagggagaggcactggcgggaagcatcctatgcctgcccccacccttcccatttctttccgattcttgacttcgctccatctctcacctggagttccttcttgcaaccgatcatgcagcaaacacggattggtggcctatggtgcacgaggcacgtgacagggtcctagatgccatggtaatgagactaggtccagccttcagggaggtcccagacaaggggagagacaagcaaagagatggctggcatgcacggtgtccagcactccaataggtggctctgtgcaggctccaccccacacaggcattcctgtgcaggccatttcctcatactcccctctgggcaaccccaggggtccatacaaccatgatccccatttttttttttgagacagagtctccctctgtctcccaggctggagtgcagtggcatgatctctgctcactgcaagctccgcctcccaggttcatgccattctcctgcctcagcctcccgagtagctgggactccaggtgcccgccaccacgcccggctaattttgtttttgtatttttagtagagacggggtttcaccacgttagccaggatggtcttgatctcctgacctcgtgatccgcccacctcagcctcccaaagtgctgggattacaggcgtgagctactgcgcccggcctttttttttttttcctttgtgagatggagtctcgcttttgtcacccaggctggagtgcaatggcgcaatcttggctcactacaacctccgcctcccgggttcaagtgagtctcctgcctcagcctatagagtagctgggattacaggcgcctaccccacgcccggccttatttttgtatttttagtagagacggggtttcaccatgttggccaggctggtcttgaactcctgacctcaggtgatccacccatcttggccttccaaagtgctgggattacaggcgtgagccactgtgcctggcctatgatccccattttatagatgaggaaactaaagctcagagaggttcccttgctacacaataagtagcagggctggaaatgaaacagcttcttcactgcctcttcccggggagtgctgggcacggcctggggacagagagacggggtatgagggagttgcaaggattcagggcgactggtggcatcttccagtcctgccacttggtcctccttgtcttctcctctctctctttctccccaccctgcataccgcaaagaggaggttaatgcctctcacgcgtcttatccccccactcccatccctcctcaagtccccaggggctgtggggcccatattcctccctggctctcttgggcccattagtgtgtttacgctggagccgtctcaggggagctgagcccctacccctgccccaccgtcctcccgccatggagagtgggcagtggagtggtggaggccgggcagaggcacgggagaacctgacccagcgtccgaattcctgcccccacgtctcaacaagtccagggtggccagaagcctggagagcaacggtagccccccgggacccccacctcttcccacacagccccaccagagcctgacaggctctaatctcagctgtcttcatgcagccagccctccgagcccggggtcacctgacgctgacacattttaattcagaagctgatttctgcttgttggcaacatgtcatttctgaaattgctttctctgcccagaggcgggagatgtcagagctgcgcaggtgttgcagtggtgccgcccccgccccacacccagccccctctccaagttcaggaaggattaaggggcgtgagggggcacacaggagatcctcaagctctgcttctcatgtttccccaagtgctgggggccagggatgggggactcctggaatggcctctgctttcctttccagcctgatgacagaggcccagggtttggtaaatgaagttgctgctctgccagtgctgacaacagccacagtagttgttttgcgcaggcttcatacaggtaccaagtgctctgcagagtgcctctcgtgtgcattgttgtatttgaatcttatgacaacgctccaagttggtgtcatccctcctttgcagctgagaaaaccggggctcagaggggttagaccacttgcctgaggtcacacagcaagtatgaggcggggccagctttcagacccagtgaaggcgacagctggactgggattgggaggtctgggaagggagaggccgtggagctggggaggactatggcctggcttctcctatatttgcttcctgacttggttcaaatatctccagtgaaatttgtgaactcccccaacttccccactcctgcaacccatcaaatagttatttgctccctcttttatatttccttagcttttttttttagacgaagtcttgttcttgttgcgcaggttggagtgcagtggcaagatctcagctcatcacaacctccacctcccggattcaagcgattctcccgtctcagctgcctgagtaactgggattacaggcatgcaccaccacgcctgactaattttgtatttttggctaattttgtatttttagtagagatgaggtttctccatgttggtcaggctggtctcgaactcccgacctcaggtgatccacccgcctcggcctcccaaagtgctgggattaccggtgtgagccactgcgcctggccagcatttttttttttgagacagagtctcgctctgtcacccaggctggagtgcactggcatgatctctgctcactgcaacctccacctcccaggttcaagtgactctcttggctcagcctcccaagtagctgggactacaggcgtgcaccaccacgctcagctaatttttgtattttcagtagagatggacttttatcatgttggccaggctggtctcgaactcctggtctcaagtgatctgccagcctcagtctcccagggtgctgggattacaggtatgagccactgtgcccggccgccttagcattttgtgtatgttttgagtgacagccatctgtcaatattggcatcttttgttttattggatgaatgaatgaacaaatgaatttataaatcttgttctccatactgtttacccatcctcatttccctcacttggcagtgtcttgccatagcaggcttcctggtgtagctggcaccacatccctccctgacacacggcctccttattgcccctgctacttgcctttttctctcctccctttccttcccttcattccccctggcttccccttcccaactctcagaatccctggctgcctcaaccacaagaacaaagctgtgcagaagcctgaacctggagcttctgcaagatgaggtggggaatgagctaacccagctggaaagcagcctgctgatccctgggagagacggcgcttgggccaacccaccctccccaaggtggtcccctgcctcagctccacccgcttccccagatgaacttctttctctccctccagcgcttcagaggatgcacagctgtgtgtacttgaccctgagcctgggctagtgctggggacatagccagtctggctgatacccatatcagtacagaaagctgtcctcacccacttcatgcactagttgcattggtatgaagcattagctttataactatcccatttactgcaggcataaacctatatcaattggtggggatggaggttaaatgagagaagacatcaaagatgcatagaactattgggcccctttcaattaataaataaaatttgtaggaggccattagtttgtactgtgctcctgtaatggacccaacagaccaaacaaatatggagtcactcatgctaaatgcaattaacttgggagtatactcctaagttgcaaaaagtggtaacaaatagctgagttttggggcagttacagcagctgagcatctgtcaatgtaggtggccaggtgattcaattaaggatgctgtaaccaattaagctgtatctacacctcacttctgttttctatctacaaatactgcgtgatcatgttgctggttggagttctttgaataagctgtggttcggagggatgcccaattctagaatcatgaataaaagcctattaagatctttaaacaaaatttattgtcattttgtcttttgacattttacagatgggcaaagtgaggccaggtgagcaacagcatctgttttttttgtttgtttgtttgttttttgagactgagtctcactctgtcacccaggctggagtgcagtggtgcgatatcagctcactgcaaactccacctcctaggttcaagcaattctcctgcctcagcctcccgagtagctgggattacaggcgtgcaccactatacctggctaatttttgtgtttttagtagagacggggtttcaccatgttgcccaagctggtctcgaactcctgggctcaagcaatccacctgccttggcctcccaaagtgctgggattacaggcatgagccactgtgcccggccagcaagaacatccttaacacaaagttggagtcatggtaaaatgaggtcaggattgggcaggcactaacaggactttggaagtatagcattgctctatctcctgataattaatgagggatactgtttatgttcccatttaaaaattaagcctaaaaaattgaaattgggatccatttcacagaggatggtcaaatgtccaagaagaagggacaggtggtcattaaaattcagataaacagagttcccagtgagcactgtcttgggagtagaactaagcaagcaaagtcacctttcttctctgagcctcattcattaaaaaaaaaaaatctctatatagatatctttctatagcaatctctcagagagggccaggcgtggtggctcaagcctgtaatcccagcattttggaaggctgaggtgggtggatcatctgaggtcaggagtttgagaccagcttggccaacatggtgaaaccccatctctactaaatacaagaaattagccgggcatggtggcatatgcctgtaacaccagacacttgggaggctgaggcaggagaatcgcttgaacccaggaggtgaaggtttcagtgagccaagatcactccactgcactccagcctgggcgacatagcgagactccctgtccaaaagaaagaaagaaagaaagaaagaaatctctgagagagatagataacacatgtagcactcctactatgtgccaaacactgtgctgggccccagggatgaagcaattagtgagacaggcggagtccctgctcttaaaacacagaagacagataaacaagtcatcactattcaatgtgatgaaactgacaaccctactcaccctgggcagccaaactcagtggctgggagctagagatagggagagcagggagactttttactccatttcttgttgcttttgaattctgaaccatgtgaatgtattcctgatccaaaataaataaaaataaaatgtgatgagttttcacaagcgggagtgtgcttatgggaacatcagcagggagaagggataccgacctggcctagaggatgtcagagaaagcttcccagagaagtgagagcccagctacagcctgaagcttagggaggtgtgggtcaggtggggagttggagggagagggatgcaggtgtcaatggaagtttatggtgctgggtgataaacaccaacgttgcagggtcactgggaggattaaaagtgtccccagaaagtgcctggcacacaggatgtgcttactgtatggtagctattattattcctcaattatggttgctgtcattggcagaggctagggagaggggaccctaaggctgccactgactctactgatatattcctgggcctctgaaaggccttggtgacaggaactcataacactgctgcggcattttacagtttacactaatccaatcctgggtacaggagggcagaaagaagtttgaagctcagggtggcccactaaggggggttcttggctcttctagaatcagctgtctgtcaagcacaggaccaaaacaaccccacactgtctggttgctcatcttatgtcacagaccaagaaatttccccatgctaggaagggacagaactctctccctgccccagacccaaggcagcagcataccgttcatagcagtgaaaaccagtgtttctgagcaccaccaatgcacctggtgctgtgcaaaatgcttcacttggatttgattaaatccttgacctcacaaccaccctaccaggagcaagctactgtaatcactacccccattttacagatgaagaaactgaggcatgcaaaggttaagtaacctgcatgagttcacattgtcaagctttgactccaggtgcctcttagccccttactgaccctaaagcagagctctcatgtctaaaatttcctctgcttgcctgctcagctcttccctgcagcaggaagagaaccatttcttctgactctgcagagcctactaagtgcaactcaacctttattcgtatcctagacttagaacccatggaggcatgaataagattttgaaaatctgatttccaggggggccagatggtcaggagttgactatatctagatgcaggatggggaggcaatgaaccactcactcagagatgtccccttcagaatcaggacctctgggtatgactgccttagccaggcaggaagtgcctccctgggcgtggcgggggtggctcagcatgtctgacccccagagagctgtggggccagctagccacagggaagcagagctggagaccaagtcccctctgtcctttcttggaaggacatggaagtcacgtcttaacccatagcttcatcatggccttagtggagaccagccaactgtcaggggtcatggccatcagcccccagttggctaaatggacctctgagtcctaaaaggctaattaagacctctgacttctgtgttcttggtcccctgtcatccatacctgtgctgtgattattagagcatgccttttcttccctcccaaccctggatggagggggtccacatagccctccctcaccctccttgccacagacaccaagcccttgtttattctgaaagtgtcagttgcatttcatgaactcctaagcgggaccttggacttctgactcctagaaaacagaaggcagcttctactagcaaccagaccccagctttgcactcagggctgacattctttatcgatggacctctctgtgactttatttctacatcatctgtaaaatgaggatcgagatactaacacacctacatcgcaaggatcatgttcgttaaaacaaatgcttagaataatgcctggcatattgtcagctctaaacaagcattctctgcaattactattattaccgcaagtatcatcctgagcagcccctcccatgccaccatttcagcccggcctgcatctccacccctgaggccctgcctcattcttgggtctgctctatgtcttttgtccctcatccctcctcctcctcgctcctcttccctccctgtcagtcccccgctgctcctgcagtcttgtgccgactaatcatgctgctgtcagttcagattagagcccattacgttccttcatctcagcttaaaatttttgtggtttcccaactctgcctaaagtgctccacgagggacaagggccatccagctggagggtgcttcaggaggaagaattcgggtctgtgagtcccctggtgggctttcctccttcctgccaattcgataagaggctggatggtggggagtgggcaaaggagagcagtccctcctggactgccatcaggagctcaggccccgagaccagggagcgggaggtcttggcatcccaggaccctcgaggtagactcatactggtgtcgtgtgacagcactgctctgggaccacatttggtcactccatttgagaattcccagggctgtgaaattttgcaactgagagactcctggcaaaaccactgtgctcagcccctgaaccggggtctatctccttcagccacaggcatggcctgtctttgtgatggcgttgtccatagtaacccttggaccttgtcacaagcctgccttccaacagcccaagctccaaggatctcaccagccatggggtccctcaggagccctgggcaaagctctcaggaagagacaaaagcagaagcaagaggcacgggcgggggttggatgcaaggaaggaaggaagccaagaaccacccgttttaatgctcttgttcagtgggcctggtattgagccaggactttgcccgcctcatcctatttaatttccattaacagcccctgaggtaggtgcacctatcaccacttgacagttgaggaaactgaggcacagcgaaatgaaaagcccttgcctgaggctggaaaggggaagagcaggattttgaatttacgttgcaaagcacctgatggggagagacaggagggcgacccctggcagcctcagggctgtctggctagtctcagcctctagaaaagttgggtccagaccctgaaattctgtgtctgggtcttccttgtcctgtgacttgggtattacgtgttaataatcatatttaacctttgtgtagcgcattcctgtttacaaagtgtcttccgtggcctttctttttgagcctcgccatagcccacagggcaggcaggggtgccttatcatccctcttttgcagataaggaaactgaggctcagagagatgaagcctcttgccaaggtcacagatggaagatgacccaaccagaacccaaagcaaggtcgccagggcccagctgtgcagtgaggacaccacactctgacctctttgatggatggtctgcattcaccccaccatctgcaacgtcctcagttgggccaagatctgagaggcttccaaggggtacgcagccaggggctctcatctgggcccctcaaaccttctccctcccaaagctatcagttcagttgggaggatgtcagtttgtctgtacggaacaccagggagaaaattatcaccgccatgaaatgcttcccgttccacatgacctgacagccttccagccagaaatgtccttgcatgtggcccagtctcatcctctcactaggcctggtccttctttatcccctgaccagaggactcccctctgcaggggcttcaggaaccccagagctttcttggctccaaactaaatggtctctgtttctagtgaaggttaatggcagtccttagagtttccaagttcctccttttactctttttttcttttcttttcttttcttttctttttttttttttttttttgagatggagtcttgccctgtcacccagcctggagtgcagtggtgtgatctcagctcagtgcaacctccacctcatgggttcaagtgattctcctgcctcagctctggagtagctgggattacaggtgtccaccaccatgtccagctaatttttgtatttttagtagagatggggtttcaccacgttggccagactggtctcgaactcctgatctcaagtgatccacttgcctcggcctcccaaagtgctgggattacaggtgtgagccactgcacaggcctcctccctttatgcttggtggctggaaatgtcacacccctgcctaaaaaccccaggtaagtccctcagctcttccccaccatccagcttaccttcccagacccatacctccaatgcccctcaaggtacaccacagccccatcccctgagccaaatcacctgtctctgaatgctgaccacgtgttcccagctctgtgcctttgtatgtgccagtcctactgacaatgactttcctgcctttgtccatccaactcactcctgctcagccttaaagactcagccgtagaaagcacttcctcttctgagcttccaccatcggactgattttccctttatgcctgcactagcattgtaggtgtctgtccatctgtccatctctctccccacactggactgtgagcttctatgagcaagaactggctctcaagccacctcgattcctgaaaaaattcttccccttctttctttcctccctcctctcctctctccttcaataaatatttaaacagtcctgtgatgtgccaggccaggtactgggggctcaaggatggacaaaaaaaggcatggtcctagttttcatggttgttcaatctagtggctgatgtagatcatcaaatatacataaaattaatcaaaagattcatcaccactgtgtaagtgtctgttgaagaactgcagagtgctggcttatgcagtccaggactacctgacctttctttttcttttctttttttttttgagatggagtcttgctctgttgcccaggctggagtgcatggtgcgatcttggcacactgcaacctctgcctcctggttcaagaattcttatggctcagcctcctgggtagccgggattacagaagcataccaccatgcctggctaatttttgtattgttagtagagttgggttttcaccatgttggcgggactggtctcaaacttctgacatcaagtgatccacctgcctcggcctcccaaagtgctaggattacaggcatgagccaccgcgcttggctacctgaactttcttaagaagtacctggtgctgaggagtaggttcctgtattcaaatatttcatagcaatccagcaacatgttggctgccttcttggacagtggccactgtagtttcagcttggggtcctttatggacttctgatcctttttatctatctttgctcaaactcatttatcctcatgtggccagtgtagttacagcttggggtcctttatggacctcagaccctttttatctgtctttgcccagactctttcattctccccaccaggcatttatgggtctctcctagggtagtctagcccatatcatcttgggtggagggtgtctgcctgtgggacagtgtatatgagcagagtaggggagggcaggacccccttgacttgggtagctacatgtcacctgtagaatctcctcactatggggagatgtaagaacagccattgagttccaagctgaggttggaatcctgaaaaaaacaaactggaaggctctggcttctagaggagtctagaaagattgctgtaactgtcggcaaaagaaagaagcaaagagcccaattcattctcctgagctagggcagagcctggaaaaagccaaggtggccaggggctgagggtccctggtggggccagagcatggatgtcatgcttcaagtgggcgtggaggtgccttggtggacattttcatcaagacacaaacagtgatgctgagcacggcagggttagcacagctggctcacccatggcttggtttgtaactccagaccaggatactcatcctttatttacagccagtgaattcgcccccaagatttggagaatgcttactgtgaccacttaggtgccgccctgattgcagccaacaaacacctgtgaaacacctcgaacatacaaaacactgttgggttgcgatggtataacaaattcaccctggctttgttctgagctagtcgccctgttcctttaatgtcaataccttaggtacaaagtgctgaagatgcagccacgtcctcaatggactcgcaacctcatgggactaacttcacagcgggcaatgtgattgactgagtccctttccttctctgggccttgggctcttgctctgtaataacaaggggggtcagcctacccgaccttgggttttgccaggcctcataagattccaatgtaggtttacacagaaggtcactggctgatgtgcaggggtcattaagtccccctaagacaggtgccaggaaacctaccaattggataattaggcttgccccgaccctacagcccttgagggagcagacctggacttcagctgccctccccatggggcggaagtgccggcactgcgggggtcccctggtggaatgtggctgtggtgggtgctgggacagagggcttggctgacagatctaaggctgccgcctgccaccaggtctccgtggggccgccagccggcccccctcctgtggaatgacgagctcactccccccacctggcgtttaatctttaatgcagtcccagctgccctcgggcaggacccatcaacccacccgctctgataaaagcgataattagctctttttcaacttttcacttctcccccctccactctgatgtgtgagcattgggaggattccagctaatgggcctgcccacagccaattcccgggccatgcaagccggaatgcacggggtcattagcggggcctcccgggcaggggcctgtgctcgggacgggacgtgctcgcctgtccgctctggggcatcccagccactggagagccggccggatctcggcagagcagacctgcccagacaggctggatcccaccttccttggtggtggcccctgcctgcaccacagcagagaccacaggaaggtggccttaggccctcccagcgcccggctgagaggacacggggccatcagtccccaggcatcgccctgctcccagggcagacagcccagcctgggttcagccaccggtcagtgcggaggctgctagctgggatcccccaccctagccccacaagtgacttataataactaacttgtacatggagccttatgaagtgcttccagttctgaggtagccgcagcccaaggcttaaccatgcaggctcaggagctgggctgtacgagtcaaatcctaacttccccatttgtgttatgaggacggaacctctctgtgccacagctctcacccgtgaggtggggtcagtggccgtggtgcctaccatggaggctgatgtgaagattgagatgatgcagtgaagtgcttgacatggtgcctggcctgtctgagcattctgtccccgccattgtcactatttggttctctcaataggcctctagataattgctgttaccctgccatgcagaggttcagaaaggttgtgcctgggaatttcccaagttttattttcttaatgataattgatttaaccagtcctcacagcaacgttgcatggcaggtcctgttactcccattttgcagagaagcagcttccccacggctctgtgctggtacatggtgggtgcagaaatattttctgctactccaagaatcttgccttgtttggaaccatctgctgctgggcaagcccctggtcctactgcaggtgtctgaggatccaggagacaagtgggagcagggcctgatctgagcttgaggggtgggagcctggtgctgggcagggtcttgaaggggaagctggtgggggcagagggggttccatctggggattaagaaagaccaaggccaggctgggcgcagtggctcatgcctgtaatcccagcactttgggaggccaaggcgggcagatcatgaggtcaggagatcgagaccatcctggctaacatggtgaaaccccgtctctactaaaaaaaccaaaaagaaaaaacaaaaaaaattagctgggcctggtggcagatgcctgtaatcccagctactcgggaggctgaggcagcagaatcacttgaacccgggagacggaggttgcggtgaaccaagatcacaccattgcactgcagcctgggcaacagagtgagactctctctcaaaaaaagaaaaagaaagaaagaaagaaagagagaaagagagagagagaaagaaagaaagaaaaagaaagaaagagagagagagaagaaagaaagaaagagaaagaaagaaagaaagaaagaaagaaagaaagaaagaaagaaagaaagaaagaaagaaaaagaaagaaagaaagaaagaaagacagaccaaggccaggtactgtgtcagctcatgcctgtaatcccagaactttgggaggctgagacaggatgattgcttgagcccaggagtttgagatcagcctaggtgacagagtgagaccctgtttcaaacaaacacattaaaaaaagaccaaggttagcgcacaggtcatgaactggtcaagctccatcatggtcactctcaaggcaaagcgacagcttggccctgcctatttccctccatctgcagactatgtgctgctttctatgatgtccgtcccaccacaaggcagtccttgccactcactgtcccctattcctcctggattccagcgcccaagcaggaggggagtgtgtggggagaaagtcacacagcatgggcctgggaccctgagggcatctagggctggacaccccccaccagagtccaggccaaaagaagtccccaaatcaacactattgggtcttactagggctttccagcttcaagtcaaatgctacagactgtgactctcccacgttcctgaggggactacagaagacccacaagctaatgggtgtgcccctggaggaggtcgctagataaacagaaagagaggaacttcagaagagaaagaatctgctgcgaccgctcgagtaccaagaacgcttgagcagcagctcagcagcaccaggcagactctggcttggctcctcttcctttgtttctgaccagctgcggccaatgcctacaggcttgagacctagttccagaaggcggccagcacctggaactgtggagcctccatcagtaatgcccaggatcaccagcacccagatttcccagggctaccaaagtctagggccactgtctccaatagtcattagcaggaccactgatgcctagaatccgaggctaccattagccaaggtcaccttcccctggggttgttgacatctggaaccacttggaccacaggacataggacctagaaccctggaggagtccacccagagctgccataaactagaactctaggttaccatgagccagtattgggggccatagagtcactgatgtggagtccatccttggactcacactggattgagaagcttcctggggtgatggtgcttggtgaatggcttttcttgtgcaggctctgggtgtacctttttttattttattttttgttttttattttttatttttgtagagatggggtctcaccgtcatgttgcctaggctggtctcgaattccagggctcaagcaatcctcctaccccagcttccccaagtgctgggattgcaggtgtgagccaccacgctggctacctttctttattgactctgctccatagcaaaatatcatggagactcctgaaccccttgcttctctcctacctgggtcctgggttctggctgtgaactttccaaagaggaaacaagaggtgtcatgtgggtgggtcctgcacacccaggacccaggtgaggactgctcaaggagggagggggtacatggcctctaatgtggtctcctctttttccagaaaatacactgggaagtaggccaaagggtgtcctggaggaggttgtatgaatgttccggagacagagcagagcattactggggatggatcacggggcctggcccatcctaattgcatcccctccatcccattcacccaaaggccaacctttctccacatttttcagcgttaggcactaccgtgaccttgctgagataccccaaggaaaatgtgggaaagaacttttctctttccacctcccaccctcccccagccaacaaatagatggcctcagagcctcaaaaacatgcacagaaaaagttccaaactgttaacaactgaaatcttagcagtatcaacaaataaatgttgtacatgtaaaataattcccatgggatgccttggcctgctaccccaagggtttccattgccaagttcaaggttgtcccaggaagagggctgctcagctgttctctgcccaccctggccatggcctcttcttatgagacctggcctcatctctggactgacactgtatgtgaggagggcacaagtaagacctggagaaggaaactcaacttgggaatggaggagcattagagactagggccaggaggaaagataggaagcagaggatgaggaacgacacctgaacagaaaatggtgattcttgccttgggaatcctcgagtttccagtggaatccttgcctaatgtagccagattcaacagagagtcagacaattgcatatttcaacagtaataataaccagtcataataacagcacctagcctccctcatacattgaaacattcgtccattgctggtaggaatgtaaattggtgtaacttctctggaaaacggtctggcagttcctcaaaatgttaaacatagcgttaccatatgacccagcaattgcattcctaggtatttacccaagggaattcaaacaaatgtccatgcaaggacttccatgtgaatgttcatagcagcattattcataataaggaaaaggtggaaacaacccaaatgtccatccactggtgaatggataaacaaattgtggtatatccatacaatggaatattatttgaccataaaaaggaatgaagtactgacacacggctgggtgcagtggctcacactcataatcgcagcactatgggaggctgaggctggcggatcacttgagcttaggagttggagaccagcctggccagtgtggcgaaaaccctgcctctactaaaaatacaaaataataataataataatagccaggtatggtgtcatgtgcctgtggtcccagatacttaggaggctgaggtgggaggatggcttgagcccagcggggcagaggttgcagtgagccaatatgatgccactgcactccagccggggtgacagagcgagaccctgtctcaaaacaaacaaacaaacaaaccaacaaacaaaaacaaagtactgacattgacacacagacaacgtaaatgagcctcgagaacataatgctaagtgaaagaagccagacacaaaacactacatattgtatgattccatttatatgaaatgtccagaatagaaaaatccatagacacagaaaacagattagtggttgcctaggactaaggggaggagggaatgggagtgattgctagtaggtatgggttttgggaggaggtaatgaaaaatgctctggaattactggtgatggttgcacaactctgtgaatatacactgagtatatacaacccactgaattgtatattttaatagggtgaactttatgtgaattgtatccccatagaactgttatttagaatatgctaggagattgtgttaagcaggttgattgctgttgtatttcattcttacagtgaccccacctggaattaaggagatatatagtgggggtagttaagggcacagactcttcagtcaaactataggggtacaacctcagctcattcccctctagttcagggaccttggacaagtcactcaacccccgtgagtctcagagtcctcatctgtagaatgggcacaaggatctgtatcttatccacacagcacagtgcctggggtacagggagtgcacaggcatcggtactgttagatgtagtaggaattcaacaggagtacaatttcaccacctcctcccatccttttctatatatatacatatacatatatatatatatatatatatatatatatatatacacacacacacacacacatatatatatatatacacacatatatatatgtatatatatatttttttgagatggaatctcgctctgttgcccaggctggagtggagtcgcatgatcttggctcactgcagcctctgcctcccgggttcaagagattctcctgtctcagcctccctagtagctgggactagaggtgtgtgtcaccacacccagctaattttgtatttttagtagagatgaggtttcaccatgttggccaggctggtttccaactcttgacctcaggtgatgcacccgccttggcctcccaaagtgctgggattgcaggcgtaagccacggtgcctggccctttctatttcttgagccccctggaagtacaatcacccttaaaggatgaggatggtgaagagtttggagaaggagcagcatttaggaaagagtgtatacccgcttctcgcattcaactcactgcactgtgttcagcagtacagtacaaggtagggtggggagactataatactagctaatctttattaggcactttggcagcagttgtatgtgttttttttctttccatgtcatcccagaaaggtggtttggcctggagataccattaacttattcattactgaacaccatctacaagccaagctctgtgctctgggccataaaacaaagtggggatcaagacagccaggatctggtgctcagaggcttacattctagtggggaggggaggtggataagaaataaataaacgaaaagcaatgtctttcccaatcagctgtaatgcaatggaaattaatcagataaagggggaaggactgccctacataggcattaaaagaagatttatctgaaaaactggtttctgagctaagataggaggaagatgtttgaggtagagggaactgaagtgaaaataagcccagcacatttatttatttatttatttttattttattattattatttttttagatggagtctcactctgtcgcccaggctgaagtgcagtggtgcgatctcagctcactgcaacctctgcctcctgggttcaagtgattctcctgtctcagcctcccaagtagctgggattacagacttgcaccatcatgcccggctaatttttctatttttaatagagacggtgtttcaccatgttggccaggccggtctttaactcccgacctcaggtgatccgcctgcctcagcctcccaaagtgctgggattacggcatgagccaccacgcccagcccagcacgtttaaagaacagcaagagagccaatgcagctggagctggggcagccagggagagtgacacaagctaagacacatgagggagccagggccctgttacatagagcaagcaggtctgcgtgagggacttgatttttgtattcagtgtagtaggtggcataggaaagttctccagccttctaatgggaaagaagctgaagagaacatcagaatcccaagcaataggtctagtctgatatctcttcatgcttaaggcaattgagtcacctgcaacaaatcctttggtttcccccacaatgtcagctgccttgtactgtctctgggctaaatggagcaagaatttttttttttttttttttttgagacagagtctcactctgtcacccaggctggagcgcaatggcgcaatctcggctcactgcaacctccatctcccaggtttcagtgattctccctgcctcagcctaccgagtagttgggattacaggcgcccgccactgtgcccagctaatttttgtatttttagtagagacagggttttgccatgttggccaggctggtcttaaactcctgacctcaggtgatccacccaccttggcctcccaaagtgctgggattacaggtatgagccacggcactgggccgcaagatctttaccactgggattccttctggtgcctggtgttgacccaatgaggtgagcagcctccttcctcctccctagatgctgccctcctgaagcatcttccttctgggaagtccgggtggtgcacatgagtttaggtgttatttttcccgtgctttagatcaagcccagtcttcagctgtaaattgattgtgaagaaatggaggctcatagatccctacttgtgctaaccttgtcagaaatagatgaggaatgtctgtgatgcggagggtgcaatgtgctgaaacttactttccccataagatgagatattcagagtaattcatttgaaatctcgataagggaacagtgcgtgtgtgtgtgtgtgtgtgtgtgtgtgtaagatagagacagagagagagacaaaatgctatggcaggaagttttcactcggccaagttttaacaacaaacaaggagcagtttgtggccaagcagtcagtccagggggaaaaacaaacaggcagagtgggggcttgggtgggggttgctgagaaagccaggaatgagtttatcatgctgcttctggggtgaggaagaaacacaaaacatttagatctttcacctggttgcccacagataccgtgagtagccaaccctgtggtcagtttccccttcttcctgatagagagagccctggttttgatcagatacccgttctcccctggggaagggatcgccatcttcagctaagggataaatcatgactcacctaagccaggtgtggttattcctttttccttttcagagactaatttgcacatagatgcagtgctagccaatgacagttgaagggaagttctgcctgggactgcagaaaggtctcctttctcgaaaaaggattcaagaaggggccaggtgtggtggctcatgcctgtaaccccagcactttgggaggccaaggcaggcggatcacttgaggccaggagttcaagaccagactggccaccatggtgaaaccccatctctactaaaaatacaaaattatccaggtatggtggtgcatgcctgtaatcccagctacttgggaggctaaggcaggggaatcgcttgaacccgggaggtggaggttgcagtgagccaagattgcactattgcactccagcgtgggcaacaagagtgtgactctgtctcaaaaaaaaaaaaaatgcaagaagaaactgttcctcttatacttcagttattacaggaattgtctgcagtccccagatgtgtggtagccccttggcaccatgagctgaactggcaggcacttggagggagggtcaagcagaaaaacagaaaaaatctgaattttcaatgatgcctttgggcccctgaattgaccaatccagaggttccctacctctggccttcttatgtgaaataaattttccttcttatttcaggtagggcttccaggtacttgtatcctgattgatgctgtcactctcactggaaaacaattggaaggtaagaaccatggcttccacctctctggattccagtaccctacaccaaatctggcttattataggtgctcaacaggtgggcggatgtatgggtgggtggcttaatggatgtatgggtggcttggggagtagatggatggatgaatgggtgggtgagtggatggatgggtggggtggttggatgggtgggtggatggatggatgggtggggtggatagatgggtgggtgggtagatgagtggatgatggataggtgggtggatgtagggatgagtgggtgggtagatggatgaatgggtggctgtatgaatgtatgaatgggtggtcgggtagataggtgggtagatggatgaaagggttggatgtgtgtgtgggtggatggtggctggctggctaggtggatgagtggctggataaatgtatgggtgggtggatgggggttagatagatgagttggtggatgggtgagtgactgggtagatgaatgtatgggtggctagatggctggatggatggctgggtaggtggatgtgtagggtggctgggtggctgggcagatgaattagtgggtagatgggtggatgggtggctggttagctggatatatgggtgggtgggaaggtgggtagatggatgtatgggtgactggatgggtaggtgggtggatggatgggtggatgaatgggtgggtgggtaaatgagtgagtggatggataggtagatgggtggatggatggggtggatgggtggatggatgtggttggtgaatgggtgggtggctgactggctggctggataaatggatggatgggttggtgggtgcgtgggtggctgggtggctggctgactggatggatggatggatggatggatggatggatggatggatggatgggtggatgggtggctggacggatgatggatggatggatggatggatggatggatgaacgggtagctggctggctggttggatggataggtgatgggaagatgtgcaggtgagtgggtgggtagatggatgaatgaatgtgtggatggagctcaccatctctcatggcaaccttatcacagcatctgctcttctagttctcattgtattctcaattcaggttagagtggactgaagaggcataaagtttcaaactcaggagacttgcatgaagccttcacatgaacacaggcctgttctccacttggagatgacaggaaactttcccaacaaaggcctcagaaacagtgtccttgcctggggtttcctgcagaactctgcttctcccttgaagatggggcactcccatctctttggggcccctcccgggtctctgcctcccaacacacaaagcaggagttgtccacccccaccgtaaagaaaccagctgtgggatctttcagcaggtctccgcttgttccaaagcctcagtttctacattggataaaggggaatggcagcggccctagagaaaagacctttttttttcttttttttttgagatggggtttcgctctgttgcccaggctggagtgcaatggctccatctcggctcactgcaacctctgcctcccgggttcaagcgattctccctgcctcagcctctcaagtagctgggattaaaggtgcctaccaccacacctggctaatttttgtattttttaaagtagagacagggtttcatcatgttggccaggctggtctcgaactcctgacctcaggtaatccacctgcctcggcctcccaaagtgctgggattacagatgtgagccaccgtatccagctgggatgaccttcttagacagcctgtgtcacagaatttgtagttccctttaaagatgatgcttggaataacccacttccagcaagagtggacagcagcaagaagactttgtttcatccttcagctgagtcgtaagttgtttccttttgtacatgtcacacatgaagaagagagcaagccctggtgcaggatggcacctgtggctatgaaacagaagaaaatctatggccctactagggattgacccatgaccttgaccttttgggcaaggagcaccgacagctaagccatcatccccaacagcccagtgtgcatcagatggtatggacgtgcagcctggaacagccccctggaagacaaacagccaagtcattaatcagttgctttacccctgtactctgtgtgtttgtgtgtgtgtgtgtgtgtgtgtgtgtgtgtgtgcgtttgttgggggatggggtaagggtattgtgtgcctgtgagtatgtgcccagccctccagaccagggtcctcaaagggacctgccccagtgtgaaggaaagaccccgcccagcaatgagggagtggccaggacatctttccacagcatctgggaggaacgggcagggccggatatgggctgccgaccttctcccttcctcctgaagaggaagctcctcctgcgccacctttgtgctgaccgctgggtggttacgaatgtgttccctgcctgtcgttctcttcctgagcagtgaggagcagctcactcagcccagcccagcccccactcctgagatccagcccatgaaggagctctgtgtcctggcttctgaccaggctgatgggtggggtgggaggcaaggaccagaggctgagtcaaggccttcacccagcctcttctggagcatggctccctcacctctcccataaaaaatagacataaggtcggaaaggacttccctgaactaacaggacagggcctgcagaaggcctgaaccctggccagcagacaggtgatgagcatgtctacaccaggaaggtggggaataaattttattttaaaaattaaattaaatttatttaagagacatgatcttgctctatcacccaggctggactgcagtggtgagatcatagctcactgcagccttcaacacctggagtcaagccatcatcctcatgcctcagcctcctgagtagctgagactacaggtgcatgccaccatgcccagctaatttaattttatttaatataacactccaataccatgtatcatgtgccctttataattatgaactgatattatataagcctcataacaaccctatgagaaaggtgctctgattatgcccacttcatataggaagaggctgaggcacagagaggttaagcaacttacccaagatcacccatctagtaagcagcagagcccagatctgaattcaggctgcagagttgaagcttttacctaatatgcaatgccacctcccagaggcacaaaaataaaagcattgcttgaacaccagatgtgtgccaggcactgtcacagagtcctacctggagctcactaaccaggtactctcaaatacatgatttcatttagtcgtcacaaaaaactcataaggaaactgaaggtcagactagtataagttgtaaagagtaagttgtataaagatgcacagccagtcactggcccaacacaggtctctctgatggcaagacaagatggctttcctctccaccgggagtacgtatcctagaagcagttgccaatgaagggaagaggggcttagatcattcaagtagcctgccgaggtcaacagacagcagagggctgagccaggattcaaacacaggcctttctgatgcctctatgagccactgccaaggcttggggctcttccgggcccagctcttcccaggactgcaattccccaggcggggcttcctttggaggaagaagaagcggaaatgtcatgctctggacccacctggtaaagagaggttgaccgtggcagtgagtactcggggcacctggggccagctgacccttgtgcttcagacacaggtgttgggctcggtgggaaggtctgttggtcctctgctcttacctgagcatctcctctttctctccagccccagctcttggcataaacaacactttggagaccctcagtgcaatttagctcccttaactttttttttttttaaagggctcacacctgtagctccagcagattgggaggctgaggcaggaggatcggttgaattcaggagttcaataccagcctgggcaacatagtgaaacctccatctctacaaaaaaaaaaaaaacaaaaaacccaaaattaagtaggcatggtggtgtgtgcctgtggtcccagctactcagcggggggggtgaggcagaaggatcgcttgagcccaggagtttgaggttgcagtgagccatgatcgtgacactgtactccagcttgggagacagagtgagaccctgtcttaaaaaaaaaaagtgtgtgcgctattttctgaaaaacaggagcagacaaaaaggccccatcaatttctattttgccctgggccccttaaccacaactccatttgggaatggccggtagaagagttcagtctcggcactgtgggagagcaggctggggggcagctcagcctgggttaccgaccctctaatcccccaatggtggaatgtgcttgattccaggaggctaaggtttggagggtgggtgagctgcagaggctgctatggccctgctgtttgacgcttcatgatagatgagcccccagtcctcctgtctctgtgtcccccctcctcccccaccgcccccctcactctgtgaggtctggcttgtgcaaggaagcctgtcagtgtcaggacacgttggcctcatggcccgcagcgggaagggggcctctgagggatgcctgctgtctggccctctcctcaagaggggtcctctcaccctatgcctcagggtcctgggcgcttccctttcaaagctgcaaaatgatcgccattaatgcagcttgtctcctggaggcgctgaaaatagggtaagggaggaagggcccctgactgcctggcctccgagaaccggcatcggtctggcttagttgaggctggatgtggaagagagaagggcacaggctagcttggtggatgttgagtggggattttgcccgagggggtgggagccattaggaccaccctggggactgctgtgagttcagctgtggacttctgcagagatgtggccgccatctggctgccaatgaaagaaccatattgaagcctgccatgctgggagcaggggaagacaggccacatccccagggtcagcacctgcaccttccggagactcagtgcctcccaggggcctccgtgcctcactctggccctaacctgaaagtcccattcacctccaacagaaagctcacctgggactgccctcataccccactctgagatccactctttcgatctgagggacctcagaggagcccaaatggaggagctattcagtctggaaaactggggacccactttgtacatctgcatgaggaggccctgggctgtcaggctgggagaggtgggtctggtggaagaagtaccatccaaggcagctctgccttccaggagcctgcagtctcatcagaggccaaaggttacaatccagaccagccctgagccatagaaatgtagcatgagtctcactctgtcacccaggctggagtgcagtggcacatacatggctcactgcagcctccaactcccgggctcccaagtaactgggaccacaggtatgcaccaccacccctggctaatttttaaaattttttttgtagagatgaggtttcgctatgttgcccaggctggtcttgaactcctgggctcaagcaatcctcctgcattcgcttcccaaagtgccgggattgcaggagtgagccgctgtgcctgggaagatgcatgtatttaatatgagccatgtatttaattgtaaatttctagatggcacatttaaaatggaaaaaggagcagaggaaattaatacattttatttaatccaatacagatgaaaaatatcgtttcaacataaaacataaatgtaagcatattaatattttacctttttacctttttctgtactgtcttcgaaagccagtgtatgctttacagtgacatcacatctcgatttgctctagccacgtttcaagtactcaggagctgcatgtggctaacagctagcgtattggatggcacagctctagacgctgtggcttgggccatggcaacagcacctttattttttgtttaacttttcttttaagttcaggggtacatgtgcaggtttgttatatacgtaaacttgtgtcagatattaagcctagtatttattagttatttttcctgatcctctccctcctcctcccacccagcaccttcctttcaacagaagaaaattccagatggaatgcacaaggtacagtgggtttggaggcatggagaagccggtagaacttcctccttggaggctttcagtctggactgggctgctcctcctcctggcaggctgaaggcaatctagctgagagtatggctcctgagcactggtcccaggcctgggttctagaatgtctctgtctgcagggctcacttgctgctgtgtgtgtcacccgagaggcagcatagagtaggaaggggggcactggatggggggtcaggacattcaggttccagctgggctctgaattctgcacaatcgggcagatcacatccctttctgggcctcagtttccctgtgggcaaatgagcaggaaggcaattactcaatacccccatctcccactctccccttgaaaccccaaggactcattgagtggcatgggtcgggatgatacaggatctcctgcatgctcagggcaagtcctgtggcgctctcctgggttggcactctttgccacctgccaaaaacaacctccgcttccacactggcctgacacagctggagtcaattcactgatatttactcagccctccagtgtgccagatcctccgagtgccgctgctctagtgactctcacggtggggtaaggcatcctcaccccacatggaaatggagtaattcctgaagatgtcctcttagccatcacctgtctagcttggagtagttgagcagattcatggaaagacatatgcacctctttgtcctcaagaagcatatgatccaacctggagactgattatgtgtggaaagtcaatactccagcaaggtgaatgccaagaacaatcaaggcaagggagtggaaaggctgccacaggctgagtggtcgggaaggctgctggaggaggagctgggatctgagccagcttggaagcggggacaaatcacttcagggagccagcaaaggcacacaggtgtgaaaacacacagtgtattagagcacccagcataggatccatgacttgagcccacggtcagctcatgcagtgcagggaagcagaggctccaactttgggaggtagaggtgggttggtctggggaaggcacgattccaagctaaggaagcaggagcagggagccactgatggttcctgagcaggagcatgacatgcatatggcggtgccaaggcaggtgaatgtgaaggcaggatgcttggagaggaaggtgggtgcagagggaaatggccaggagcacctgtgacaatcactgtgacaataacactcaaaatggaaagccctttcatgccccttctcatttaattctctttcaactcagtgaagtacatagaatgggtagtattgcttccttattaaagataaagaaaatgagtttcagaggaattaattgatgtgtccaaagggaccagcttggagaatcagactcaggctttgtgtctaaaaatactgaactctttctactatcccacatcttaatggtccaggaaaatggggtcccaaaaggagacagagataaccaaagaaggctccccagaggggtgaagtacattgagaggagagtagaactcagatgatccaagcatccctcagaactcttcacacttcaatactgacctggtgtatctgatccaactggtgcttacatgcccaaggtaggagtcagtgaggcctaaatttaggtctcagctggccatcagcctgctgcatagctttggatgttttacgtaacccggctgagtctcagtgttgtttctcatctgcaaattaagatagctgggcactgtggctcacgcctgtaatctcagcactttgggaggccaaggtgggtggatcacctgaggtcaggggttcaagaccagtctggccaacatggtaaaaccccgtctcaacttaaaaatataaaaattagccgggcatggtggcacacgcctgtagtcccagctactcaggaggctgaggcaggagaatcgcttgaactggtaggcagaggttgcagtaagccgagatcacgccactgcactctagcctgggtgacagaatgagactccgtctcaaaataaataaaataaataaatataaattaagatacctggatatgaggagctcgtaaggaatgaatgagatcattattagtgagagcccagagtgaccaatctctcagccagcccctcaagtctacactaggccaacccccatcgcttgatgtgacacacaagtctgttccacacccacgattgaccagaagaccaccatcctccccctgcagcttcccctagcctcatgccacctctgccttcctcacacctcctctcctgctgtcccaaggatgtgcacacctactccctgctccgtatggccccaaagagcagcgggtgcagaaggcatttctctagtctgggagggcttcctagaaatgctgctgagccctgcgaatgcctaatgaccatgggaatcatttagcaagagaaaaagccagacctttgccctggcccagctcacaggtgatggggttaatcgggaattctttccctcctcagggctgctggtaggggtccagctccccgatgacctggggacatattagtcagtgataagtggggctttccagccccttttatcctgtttacaatacactggttttccttagacaaaaccctccttccctgccttgctcctggctgttatggctacatgagacaatttgctgatggactctctagggaggacaacttccttggagtccccttcccacctcctgcagcacccggggcaacatcccctctacttggtgggtcctggagggggccacagatgcttgtttttctcagctcattgcagcctctgaattcagaagtgccaccctgtctgctcagctttaacccaagggggtgaggagaaatccagaggtgacaagatgatgtttccctggctttggggtgggagtgactggggtcattgttgctgtccagagtggaagccatcagaggtgtcctgtttatctgtgtgactcggccctctttgggtcacaaaggccagatgatccagcagctacctggagggtggtttatgacagcagcctggtcctagttcccttctgccaccaacaagcttggccagcttaggcaggtgagttaatttctctgaagtttagtgtccttgtctagaaaactggcatggtgatgcctgtcctgcctcccatgaggcggatgggagcacagaacgagccacggctgtcccagtgcctaaaggggaggcactgtatttggcactttgcactgattccaggtgacggctcttccagcaagaatggctccaccgctaagggcagtttttaatcgcctaaaagccgacttccaaataattctagatttctgaaatgccaagcaggtaggatacttaggcgaataagttaatgaaacggagtccatttccaggcaacagaagtttcacaagcacctacctcacaccgggcactgagctggataccaggaaatgcagggatgtaagacacatcttccaccctcgggctagtgaatggacaactgggacccctgtgacgagtgctgagagggagcaccagtgctaaggaagcatggggaaggggttctagcccagcctagaggttggggccatgccccaaggaaggtgaattcagaatgggacttgaagaatgaacagtaatagcttaggcctgagacagagggaagggtgtttgaagcacagggaacagtgcatacaaaggccagaagacacaaagaccttgtgaggagagctgcaattattctagttaggatggcggaaatgaccaggatgaggccagtaccgagggctctgtctgccacgatgaggatattactgtgttctctagacaccagggtgccatcaaaaggcttagcatggcaaggcaccaactgtgtttcattttttacttttttatttttatttattttgacagagtctcactctgtcgcccatgctggagtgcagtggcacgatctcggctcactgcagcctctgcctcttgggttcaagtgattctcctgcctcagcctcccgagtagttgggactacagacatgtgccaccatgcccggctaatttttgtatttttagtagagatgggtttcaccatgttggctagactggtcgcaaactcctgactttgggtgatccgcttgcctcggcctcccaaagtgctgggattacaggtgtgagccaccgcacccagcctactctgtgttttagaaagatcttttggggaactttgaaaaggatgattgaaagtgcagggggtggctgaagaatgatgtgggcatctcgatgcactctcatattttagtaagggaagtgggacatagtcacagctggccccaacggtgcaaggtggcatgtgagcattggcacaggtgggacacaatagcggggcggccaggaggaaaaataatccgaaagtgcgctgggaaggggagtgaccaggccaggagagtaggggggccactaatagtttaagagaagggataatagaattatcctatttcggctgggcgcagtggctcacgcctgtaatcccggcactttgggaggccgaggcaagtggatcacctgaggtcaggagttcgagaccagcctgaccaacatggtgcaaccctgtctctactaaaaatacaaaaaaattagccaggcgtagtggtgcatgcctgtagtcccagctactcgggaggctgaggcaggaaaatctcttgaacccggaaggcggaggttgcagtgagcttagatcatgccactgtactccagcctgtggggcagagcgagactccacctcaaaaaaaaaaaaaaaaaaaaaaaggaaaagaaaaaggaaagaaaagaaactctttgccttagccaagagaaaccacacagattgcctcctgggtctacctatacccattccaactttatctcactgcctgccaggaatgccctgtgcctgcctttccatacatccttgtagttcaaggtccagctgaaatcacatctactctagaaagtcttcctttgtcataataattcaaagggatctttctttcctgcattctgatagaacttaattgtccttactactcattacacactcgtacactgtcttgcactgttatattttcataagccctgtaccctctcatcccaactacatgagaaactctttgaggttggttatctattgctgcataacaaactagcccaaaagtcagtggcttaaaattcatccattttactatatctcttgattttgtgggacaggaattcaaccagaggctcagctgggcaattctatttcagatggagtctacagaggtcacacagtaggattcagctgacagatagacacagagggtacgatatggctttgcccacatgtatgatgccttggtgggaatggctggaagactggactcagctgggaatggtaacgggagcccctacacgtggcctttccagcatggtggcctcaggttgctgggcttcttccatgatggctggggctcccagagtaagtgctgcaagaagctgagtggaagctgcagggcttcttataacctggccttgaaaatcccagaatttcacttctttcatattctgttggtccaggaagtcattaagaccagcgcaggtttagagggaataaaactagactccacctctcaatggtagcagtagcaaagaatatgagatcatctctattttattacacaatttgccctaagacctaggcaagcagggtccctagctcaggccccaggccagattctcaggggaccccacacttttgagtgctcttcttgaaatattctaagttctcttcagtggctgggatcatcccagttggtttctcttcagagtactctgtgacccacctcttgatctgtgtggttggccaaatgccctgaggcggttcagggctcatgcctatggggttgtccagggcaacctgacaagtagattgcttctgctgaccagcacagtatttattttatggcattgaacaatactgggccactagaatggtactgattggctaatttggggtgattcacattggatatatgagttcagaactctgggctactaacagttcaccaccaacccttgaggttgagccacctgtgtgggtcaatgccctggctctcaccacatttatgaccacagtgccacctctgacatgacacaataatgagagtggatgcatcctttaacctgactgctggggtaccccacctccagctggtacaaggtgttcacccctctccaaggctttgcaacacatgtcaggcaatcctccagaagtggccacgcctatcttctccattcaagaccattatgctgtaaggccaaccagcttttacaatcaatgtcctctcttgcctctgatcaatatagtgatctcatgagatactgggttggttttaagctgttccaggtgagggccagatgttccttacatgaatggaacttctcttcttgctccacccatgggccctgagcctatccactccctcccctgacaactgatttcagtgtgtggaaggcaggggtgcagtcaacactgaaagaaatcaccttctaggaattcagtgattaaggcctaaagaactcaagagaagatgtggttggatgatatattgttgtaaacatacatataaaactctgatcggcgaaattttattcacatttttctgcatactctaagcaaaacttgccattggtgtcatcactaaagaagcacaggaacaaactttgagttatgaagccagtatttgtacgtagagtgaagaattgtgcagcatcatgagtaatgatgtaaccagcattaaataaatggcattatcaacacaaccagctgtcttagtctattttctgctgccataatagaataccacacactgggtaatgtttaaagaaaagacgtttattcagctcacagttctggaggttggtaagtccaagagcatggcaccgtcatctggtgaagttcatcccatgatggaaaagtgaaaggcagaagttagtacatgaaacagacagacaatggcagccaaacttatccttttatcaggagtccactcctgtagtaacaacatcaatccattcatgaaggctctgtccttgtgacccaattgcctcccaaaggccccacctttcagtactgccacaatggcagccaagtttccaacatatgaatttgggggggacacattcaaagcataaaattctccccctgccccccagccaaatttatgtccttctcacttgcaaaatgtattcattccatcccaatagtcccaaaagtcttaactcaatccagcatcaactcaaaagcctgaagtccaaagtctcatctaaatcagatataggtgagactcaaggcatgattcatcccaaggcaaattcctccagctgtgagcctgtgaaatcaaaacaagttatctttttccaaactacaatggtggtacaggcataggatagacattcccattccaaaagtgagaactaggcaagaaaagaagggtaactggtcccaagtaagtccaaaacccaacagggaaaacaacattaagtcttaaagctagagaataatctctgattcatgtcccactcctggacatgctgggaggctggttccccaaagctttgggcagtcccacctctacagcctttctaggctcggtccatgcagcagctctgatggattgagtctcctgcctacagttcccaggctggagttgcatactggtaggactacagttttgtggtcttggagatggctccattcccgctgcttcactaggcactgccctactgcagactatgtggtggctccaatcccacatttccgcttggcgttgccctagtggggactctctgcagtaccagctttaaataaatagcattaggaactggaggggcaaagaaagctacataggccaatacaaacaggttctgaagagtcatggtatttgaataacaatgttgttccccttttctcatgtagccagaaactagtgagaaatagcacatttgacaataacataaagagatagttcctggacccagacagaaagcgatggtgcctgaacactgtaaagaatattcacatgcacttattagacaataaacaaatatctaagtacttttctctactaattattctaaatctttgttgttaaatcactattcttcacgagtccatgaattttataacacagttttgtttgtttgtttgttttttgatacggaatctcgctctgtcgcccaggctagagtgcagcggcgcgatctcagctcaccgcaacctccgcctcccgggttcaagcaattctcctgcctcagcctcccgagtagctgggactacaggcacgtgccaccatgcccagctagtttttgtatttttagtagagaagaggtttcaccatgttggccaggaaggtcttgatctcttgacctcgtgatccgcccaccttggcctcactaagtgctgggattacaggcgtgaaccgccgcccccggcctataacacagtttttaatcaaattgcatatacagactgggcccacaaaaacatttgcttggggctccacaaaacctagatacagtcctgtcaacgtgatagataaataggtaggtatgtaggtattaggttggtgcaaaagtaattatggtttgccattaaaagtaattgcaaaaccacaattatttttgcaccaacctgatagagatatagcaggcagacacacacacacacacacacacacacacacacacacacacacatacaatttcccagagcactactcaccaatgaagtactaatgaaatagctccccctgaaccacaagggtcattggactgcagctccctccctcctacagaatgaagtccaagctccttagactgacttggccacaagctacctttctggccttgtcctttgtctttttgtgcattatgttctagtaacttcaaactgcttgtagtttcccctgcacatcatatatctttgcttttgtgtacgctgtttcctcttcctgggatgttttccccactggccttatcttccaagattcagtttaggtatcatctcctctttgaatctctcttgagtcaccaaactgggctaagtgttccctccttgtcatcccacagttcccaattactgtaccccacactcaccacataggattctaattatctgtatagatgtttacctcccagtatattaaagagcttctatggtaaggtggtgtcttactcatctttgtatatcagcccttgcattgtgcttgacacacagttatcagctcaatgaatctataatgtaggatgatttatggaaggagaccaatggactaagtcaagtggactctggtgagcctagaaaacgttctagtaaaatgaaggagaggctggagggtaagtcatgccaagagaatatcagcagtatatatcaattatccaagtggtttagccatacaagaaaaagaaaaaatgggatataagttaaaaatgcagtaagctggagagtggcattttcttctatttagaggaaggcctaaatacgtataaagacttaagagactgagaggcagaagggagatcttctggacttcaatttccttatctgccttatccacctcccagggatgccatgagacccaaaggaaaacaagacataggcatgaaaattatttgagaaattttttacattactatcctctgatagatttttctgatagcttccaactacccgcagaataaaaatctataaagaaaaacccaatctgacatttaagatttcctggccaggcgcagtggctcacgcctgtaaccccagcactttggaggccaaagcgggtggatcatctgaggtcgggagttcgagaccagcctgaccaacatggtgaaaccctgtctctactaaaaatacaaaaattagctgggcgtggtggtgggtgcctgtaatcctagctactcgggaggctgaggcaggagaattgcttgaacccaggaggcggaggttgcagtgaaccaagattgcaccattgcattccagcctgagcaacagagcgagactccatctcaaaaaaaagaaagaaagaaagaaaaaaaaattcctatgatctcgttctaacctttcttcgactactattattgccccaaacaccctgaatccagccagaggagattcatgttctttccttctgtttgcctttgctcaagctattccctcagcctcaaatgccctcctcttcatctctaccaggcagacacaataaacattttcagagtggttagtatatacaagacactgttaaaattctattgattcttgaaggtcttattcatatgctattttgtccatgaaccgttcttgcccttcccacggaaatggtactttgtatcaattgtagcatgtattctacttaataatgtagcttgagggtatgattagttctcccaacagaccatgagagatatgggaggttttagggctgtgtcttgcttgtgttcctatctccagtatctgtgcatggtacattgtagatgctcaattatagaaaaagtgaaaaaaataattttaggaaaagaatgtacatgggtggacagtctcttgggacacaaaactgggtgggatccaggatccaggaaaagagaagtatcaacttgtccaagaaaagaatgtctcctgccttgggaggaatagtagataagcttggaggatggaaacgggatagcctatgtggagacagagaagtgtccaaacccagtcccagctcaaatgccaccccttcattaagtctctcctaaatctcctcctagagacgacccccagctcagctcaatctctttggattttctaccttctagaatgtttgtcttgataaataaaattcatagaaagccattggtttggactgagctcctgcactaggcgcaacaggccaaaccaaaatagagtcactcatgctaaagttccaagccacaaagccaaaattaagctgctcatctgaccttaggagaaatcagaagagagggaaaatagccatatccccatgataaaggaagtcccttctgccttaaccaatacaagtaaaataactttgaaacttgttctttgtttctgcttttttttttcagcccttttctgtctataaagataatctcctctgctcagctcatcagaatactcattctattttatagaataaggtgttgcctggtgctagaatcgcaaatagccagttaagatctgtaactgtgttgtattaaaggagagaaggttagcactccctttgacaaggatggaagaggcccttgggcctgacaacacgcatacggttaaggcattaccacctacttcgtgggatctaaccatcgtttttgaaatggtgctgggaaaactagctagccatatgtagaaagctgaaactggatcccttccttacaccttatacaaaaatcaattcaagatggattaaagacttacatgttagacctaaaaccataaaaaccctagaagaaaacctaggcaataccattcaggacataggcatgggcaaggacttcatgtctaaaacaccaaaagcaatgacaacgaaagccaaaattgacaaatgggatctaattaaactaaagagcttctgcacagcaaaagaaactaccatcagagtgaacaggcaacctacagaatgggagaaaatttttgcaatctactcatctgacaaagagctaatatccagaatctacaatgaactcaaacaaatttacaagaaaaaaacaaacaaccccatcaacaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcgaccattaaaaagtcaggaaacaacagctgctggagaggatgtggagaaataagaacacttttacactgttggtgggactgttaactggttcaaccattgtggaagacagtgtggagatttctcagggatctagaactagaaataccatttgacccagccatcccattactgggtatatacccaaaggattataaatcatgctgctataaagacacatttacatgtatgtttattgcagcactattcacaatagcaaagacctggaaccaacccaaatgtccaacaatgacagactggattaagaaaatgtggcatatatacaccatggaatactatgcagccataaaaaatgatgagttcatgtcctttgtagggacacggatgaagctggaaaccaacattctcagcaaactatcgcaaggacaaaaaaacaaacattacatgttctcactcataggtgggaactgaacgatgagaacacttggacacaggaagggggacatcacacttcggggcctgttgtggggtggggagagggggaagggatagcattaggagatatacctaatgtaaatgacgagttaatgggtgcagcacaccaacatggcacatgtatacatatgtaacaaccctgcacgttgtgcacatgtaccctagaacttaaagtataataataaaaaataataaaataaagaaaaaaaatctataactacatttcttgtaattttgtcttttgagagtatacatatcttatttcctttcccagaccagaacctctttgagggcaggaggaacccggttttccctactttacacatgacacataataaccactcattcaatgtaggtttactggatggataaataggaatggggggtagataggcgggagagtgagtagacaaatgcgaaacaggaaaagcttgcgccaggaaaaacagtgaagagcgaaatctccagacccccgattaaatggtttaaagtgaagccaagcaagaacctccagtcctctctgcggcagagaacagcagatgatagcggctcgccttcaactttgctctgaggacctctcgttagtatcccgcgattgtccttcctaacgcctgactgaatcctgaggctagccttcagcgaacatgtacaccgccttgcccttcacgtgaagccgagcctgtgactacacttatccttccgtcgccggcctcatttctccttccccttctccgatctcgcaaccactgctagtaaggcgcgcgtgcgggcagccctggccggcaggggagggagggtcctgcgaccggaagccggaaaccggaaggggggctgtgaggacgtgttccgaggaagccagagccggagccgtggcctgcggggccggcgacatggatcccctgttccagcaaacgcacaagtgagggccggtcggggagcgggcaggggctagacgaggcgaggccaggtgagcctggcttctggggctgaggcctcggacgtcagccagggtagaggccgagtttttccgccagggcactgctggggatgcctccgaagtgcttaatccttggcgggactcccaggtcagccacagacagtgggttcaggctggggcctggagacgtggggcagatgactcctggggtctgcaagttcgtgactacctgctgggtagactgggtgacgggaaactggcacctgcaggttataaaactttgtccagcacttgtcaactcggtgctcctggttggtagacctcgagaggagacacggagtaggagacacggcccctggccgtaggagtgtactgtttaattggagagtcagggcacgtacgggaaagtatttgtattcttattcgatttatactaaagaccacatttttatggtacaaagaaattgctgtccacgtagcattcactattattacttgttaatcgtatctggttacaggttatcgctaagaaaatcaaattgtaatttagtttctcataacttaaattccttggtagtgtcctttattcgcatcgtcctgcactttcggaattgctgagatacgtagttgagtattaatggggccatacttaccctatttttgggggcggggggcagaattatgatttttaccctgttttggagggacggaattttatgatttttattttttattgtaaaatatacacaacataagatttactgttttaacaatttttaagtgtacaattcagtgacattgagtacattcacaacttacatcactacgatccatttccagaactttttcatcatcccagtgtgcctgttaatcagtagcacttcatttcttccttccagaacacctagtaacctctgttttacttctctctatgagtttacctattctagatacttaatataagtggagtcatacagaatttgtccttttgtatctggcttatttcacttaatgttttcagggttcatctatattgtagcctgttaccagaatttcattctgttttatgacggaataatattccgttttatgtgtctaccacattttgttatccattcatctgttgatggacacttgagttgtttccaccattgggctgttgagaataatactgctatgaactctggtgtagaagtatctgttttagtttctcttctcaattttttgaggtatatacctatcctattgagaactttcaaacttatgctgtagttttgttgattaaaacacttaaaatcacactcccaaggcctggaaatgaaatgccctgaagcatgaggaataagagggtgatgatcctctttctctttcattttctaagtttatgggtttcttttattttggcgatgaggtgtttcatttggacaggcgaaaatacagaacctactttgtaatgacagaattttcttttacactggggagccctattctcacataaacgttataggaagggacttaaaactagtctgtgagtaatttagagaaagaatgaaacgaaattatgttcatgttactaagaaagggcctatctttcacaatagcagggcacaatgggcatagtagtgccttgaagttaatctgttatgtatggtcttatctagttaatttagttaaaggatgttgccaagaaggccatgacccattttatattcaagaataactttatttagagagtcttagactacctgttttcagtgcagctaatcacagagaaaactgcatggctcagaagaggaattctaaatggtaccccaaacaaggtgtgtggagtgtagatgctctgtaggcctccaacaatgcacccttggactctagcagcttgccagttttttctattaagggccagatagtaaatattttaggctctgtgggctatacggtctctgtagttactactctgctgttatattgggaaaacagccatagacaatatgtaaactaattgatgtacctgtgttccagtacaattttatttatcaaaacaagcagtgggccagctttgccccacaactattaggccctctgctaccccgacactcattaattcattgaatatttattgagcacctactatgtgctgtgcaccattctcagtgctggcagcacagccctgccctcgaggagtttaccttcttttatgctgcagtatcttgtctatctttcctctccagtgctgaaccaggagtgggagttctggttctagacctccttactttatttttcctcatctgtagaatgatattataatttgggctggttaaactgtaaggctcctttcagttccatgataacagaactgatgactgaatgactttcacaagaaacacgtggagtccagtgagcaccagcaatgaactttcgcaactgcagaaattagtgattgtagctgagttgacacaacagtagctgaacttattaattttactggaactttgaacccagtttgtgattatctcttgccgtgtcactgaatacattgagtacattggaattagattgacatattaaagttacttgaaaactcctgaacctacctgaacaatgaatgaatgaaaataatgaatgaatgaaaacaataaacattttacacttaaatgtttaatttagatgaactttatagaggagctaatagccaggcttctatttttgagatcccaatggttgtaaaggtgaccacatttgtcccctatgtagtccaagatcagtctcctgtcctggaccttatcgtatgtccaggacacaagaagcactacatttaacaagctccctaggtggttttgatgagcaggtaggcttaagaactgttaccttatctcaagaccattttttttcctgaacagcggagcttaagaactattaccttatctcaagaccatgtttttcctttatagattttgccctttaatgagcgaaatgtaaaggcaaagtgagtgaaatgaaaatgaccagattgttgccactacttttaagtaaagttaacaacaaacttacatgatgctgtgtaggttacacagcgttttcatgttcatcatggtcagaggcagcctggatgcaaagtggatgttatggggtggtggggggcggtgagtagtttcatgaacttttaaaaagcacttccattaaaaaattcttcctagatcttctgtaaaccttttttaaagacggctacaatgaccctggcttatttgctactatttctctgctttgttatattatcacccaagcccaccatggaccccatgctagagagggctaagacttctttttcctcatgtccacgctcccaagtcatgcttgtgtatcacctgtttcttatggacttccagtgtgttatgttgtgttagaattcccagttcagtttgagacagattttgcacttggcatattagtagttcccaccttgccattcatacttgctttgttgtttcatatttatgttttcttagcatgaaatgtagccgctggaattgtattattggccacattgtctctgattggttcaaagcaaatagagatttgatgggaaaagtcagtggattatgggcctgtacaaaagtgctttgatgaacgtcctgccatgtacatctcctcagggtatgccagaacctctctaggacacattcctcaaactgctgggtcatagcatggacacatgctttattctactagttattgtcagaaagcatttaaagtgttttaccaatttataatcctaccagctgggtatgagagttctagtttccctgtttccttattaatgcatatgtccccaaactttaaaatatttgtcagtttgatgggctgaagaaatgtgatctcattgcttttcatttgtgttttcctagttgagtgtcattttgtatattgattgaccatttgggttttcttttctgtcatttgcccttttttcatttaaaaaaaatgccttgtttgactttttgtattgatttgtaacaattctttatatattttctgcacgtcaatcctttgttatctgctgcagataccctccagtctgtgccattcatttgtttattttgtggctttggtgtacagaagttttttgttttcatgttgtcagatgtatccatctttttctttgtggtttgtgggttttgtgggggtgggtagtttttggattttgtcttatttaagaaatcttctgtaacccgaggtcatttatgcacacctgtattttcttcagaaagtttgaaagctgctctgctttttccatttgggttttaagtgagcttgagtttatttttatgtgttacctgaggtggcctttttctgtacgggtaacaaaccggagctgttggcatttattgtagtcccttctttcaaaagctcccaaataacgtggggctgtgtctaggctgtttctttcctcttgggccagctgtagggtttgcctttccttgtctgtctgcacctgcactgccgccatattgtttccattgttactgctttgtaagtcataatggcaggtgggacaagtcattcctccccctccttcttcagagtggtcttggctattctttacctcccccctttttattatgtcactgttcgtgttgatcatattaccaactttcagatttttctgttaaatcagcattgaaaatttacctcacagcctgcgtcaggacttccttagagtcctaattctcctttctgtccccgttaccctccggtcccctgtacctgttcccttggttgccctgcttcaggtgtcggctacctcaggctgcattcctacatcagcccccatacctccacacccccgcatcatcccacaatatcccagacttactttccggaagcaacggcctggtctcggactctagcagtgatttctagttgcttctcagggccacaggtcttgcctaggagcaccctggggagtcatttgacagctcacccagcttcttttggtgcccgagggcatatctggaggccatagggaagccctggaaaagactgggcacaagctgaagccaaagttgggtgcctggctggcattggtagatttggggtcctggtttgcattgctcacgatgcagaatggttgctgacctttcctccagcgttggggatgatgtgagagtccagcaggcccccttcatgtgggccctaacttggggaaatctccaccgtgagcaccgggaagtggatggtggggccagcataagcagtatcccgaggactgatcatggaggaccattaggaagggggtcttaaggatgaccttggccagaccgtgggaagcctccagagagtgttacccagatccagggtacagtgttgcatttccaaatgagatggcagttccttcgttccttgatattgtcggagaaggatgtttaccaaacagaaggtccctgtctcagggtcttcctctgaatggtttcctccagtgagtcacttcagcatcctctcccccaacccgattccctttcaagcagcccaccctacttgtaatccacatgtcttgaatgaatttttgcatatcattttcttctatcttccttcaccaaatgatgtctcccttcttcacagcgatgctcagaactctttccatccacataacttacctggtttctctttctcagccccacccctctgtctgcttgcctgtgacaccactgtgcagagctgcccctctttctgtttgtttatacttatgtgtattgcttttctcgtgaatcttcccagggcttgttcatgtctgtttagcctgtcattcctcattatgttgtttctcaaggacaaggattatatctccctcgccctttgactcttcctggtacaggccagtgcttagcacattaggtcgtagaacagaaagtaggattggccgggttcagtttgaggtttatcacttgctgtgtgatcttgaacaagttacataacctttctgggcttcagtttttataaaatgaggatgataatggtactttcctcatagggttattgatttggcagagtatcttggatatggtaagcacccataatctgcctatcagtgttattgttagtagttaagatattagaaaccatgccaaaacgtgggacctaaagtgccacatacaaattttacagttcagtgatgctgtcgatttaaatcagttacatgttggcatcagaaaaattgtctttcctgactgaagcgctgttgattactcctgtctcactcatttcctccctcttcctttgataggcaggtccacgagatccagtcttgcatgggacgcctggagacggcagacaagcagtctgtgcacagtgagtaattaactgtggagaccagagtcctttctctgatgacagggtgctaatgggctgggcttcctgactgcactctgccttgggggcttaatgattcagcgtggaatgagttttgttgttagggtggacagaaaaaccctatggcaaagtcactgatttccctgagtgtgccctttggaatcccacaagtcttatcccccattacccctccactcaacctgacatggccctatgggaatggaagcgcttgcctccatctatcttaatctaattacctagtccttagaggaatgtactccataaaaattcagagatgtttaactggaattggccatttcttctgagctgagaactgtggctttttaggaggattattcagaaacgaacagcaatattaattagtttagttcccacagcatggtttcttttgagaagcatgctggttttttgttttttttcattttttttttttttttctattctgaggaaaggtcctttttctgagttggtcatatggacaccacctgcgggggctgcctacccaccccactgctgggctccctcaggacccattcctcctgttctctcatgtctcctttcgcagcttcaaaagcagctctgttcttggttctgtgccccaccttgttctaatctcaactgtctttgttcactgtgggcacaaagggctaggaaggggcagtgtcactgctgtcacttctttatggggcaagaagcagtctggatgctttcttttgtgcacagtttagcttctttgttcatcggactttgtttgccttctcagcaatctcattgttacatgattagaaatggaaagaggtcattttgactgtcttatcgaaagggatagggaaaatgaccgtatttatcgtatctctttacctctgtggattctttcctgggcctttcctattgatatttggtttattttggggacgtcaacattgctcagcccacccattcttacagaaagctttaagggaagaaagccttaagggaactcttctctgtatgtttcacatactaatcttccccttcctttatgcttttttttttttaaataaaaaaaaaaaaactcattactatagggaattcaattggcagcctttttctaggtatttataatccacgtctgagaatcccaaaggaaaagagacctatatcagaaaatttagcttaaagtatttatttggacaacctttgcatgtttattttctaaaggtaggaaatttatttctacagatttaccttcagcttttttaaaaaattggcattgttatgtcattaacagctatatacatgtacttttttcaaaacaacatttacggcctaacttgaattttttctgttattcattagtgtatacatttttctccttttgaaatatgtagttctagtttattggatattgaaaaaaaaatctgtgatttatcattgtaatttaagttcactatctcttttccagcaattattcttttttcttttttgtacagtagtagaaaacgaaatccaagcaagcatagaccagatattcagccgtctagaacgtctggagattttgtccagcaaggagccccctaacaaaaggcaaaatgccagactgtaagtgctgacctctgacatggctctgatactccaggcccatcaagacaggcttttctccctgggggaggtgatagaatattctgaaaaccaacgtacatgttgaaaaactatgactatgcaaagaaaaagccccctcaaagggcacaattctatctgagtgatgccgctcaaaataaatagcctgtgaggtttgtgactcagaaaccttgtgaccccttacctctttggtgtcattttgaaattttgcctccagttctgttttttgactagatccatagccacctgaagcctaatgttgccatggagttttgttctgctctttggttcctgctgggttcttcttgggttgaaatgaaaaatcacttcaatcagtccacccataatgaaatgctgatctaatgtttgatactccagcatgaaattaaaatgaaaccacccttgccacctccacccccagcgcctgtttccaaaagttttatgaaactttgtggatgctttacctcaaagatgcccttgggcttcttccaggagagccatataatccatagaaggtcaagaagaggtcagtgagcctgcttcctgtcccctgttctctgtcatgcatccagaatcagagcaacagattctgaagtcaagctgctggaatcttgtgtgctaccatctcactttaaccacaagtttcttcttgactttcaacatcgttgatcaaaattagatcttgtggtgagggggtatagtgtggggtggtgtagggagaagtaaggaaacgccgtctttcctcagtacaaagcctggccccctcagattctgctgccctgagttcctggaatttaatctctctctccatcaattccagtcgggttgaccagttaaagtatgatgtccagcacctgcagactgcgctcagaaacttccagcatcggcgccatgcaagggagcagcaggagagacagcgagaagagcttctgtctcgaaccttcaccactaacgtaagccaggcccgtggtgagggtcggcctgcacttgacagatcgtgggggctggagttcagatctctgagcgccatctgttttgggggtgtctgaagaagactgatgatgaggaaaccaactggaaatgacaggaactttgtgcattgccacagagactagacctagacagagaatccctttttctaagacaaaaacctgaagaggaagcagttaaattgaaggggaataggcagaggtgaaaattacctggttgggctggtctgagacagaaaggtggaagttcacatggtggaaacgtttttctgatcagatagagacagatgattagaacttaggccatttgtagagaaggcagcatttcaaagctgcctgcgggcagttgccattgtgccgagtatgtgtgtggctccagtgtcaggtgcattaagatgtttttgcccctagtctgagcagcaatttggaggaatttgttaacagatgtttagggttagatggactgcttgcctgagtctgtctgaaagtgtgttggtttgcatgtttgatttttcagaacccattgtccctgccctttagtcttaaccagatcatttcctgcacatggctgtagaacatactggccttttctgtgtcctgcataatatattccactaaatgaagtgtgctttggctttttgtattttgtttttttacagaggattattttctaaagagatgttagctttctaagccagttgttaaaattcacatcatttcctgctttgtagatgtttaaccctcaatgctgcatccttgctttgcaataaattttcccaagtgtttcaggctgtgccaacatagtttttgcttccccagactaagcagtcaagttacagtgtttaacagttcaaaaatttaatgaactataagacacactaaaagatgtttggattttagatcgttataatgtagtattcaggccttttttaggccaaggatgatcgcttgggattattttgttttttgccagcctggcgtgatgctgtgcacaccgtcagttcttaataaacattgacttgccagatgaaacttcttcctggtcattctaccatatggagctataatacatttttctgagagataatggcccatcagccatactgttttagatgggagggtaagaaagatttgtatgtgaatggcatttcataagtgctagtcaaattactgaagagaagtctctgagtctttcaaacgccagcatcttctgacacactgggcattagctgcatgcagaaaactagttaattcaggcactaggagtaaagcacatgatgaaattaaaagacctgacgcctatctgtgaggagctcccctgttagcaggggcagttgaaaacacgtatgtgcaaaatgattccaaatctgagcagcaaagaaacagtggcataaccttttttttttttttggacaattgaaactggaatttaggtggtaaaaacagcactagtggagcagggcacaatgacacacgcctgtgatcccagcactttgggagaccaaggcagtggattgttcaggagttcaccatcctgggtgacatggtgagacattgtctctacaaaaaaatataaaaattagccgggcgtggtggcgtgagcctgtggtcccaactactctctggagcctgaggtgagaagatcacttaagcctggtaggtcaaggctgctctctatcctgggtgacagagtgagagcctgtctcaaaaaaaaaaaaaacacgaaacaaaccccagcactacttggcaggagagcttgtgattggcagaaaagagaagggaacgctctcacagctggcgaggacttggctcctgcctatagtccactttcagagcaaaagtagagccaccaggatgggcgttggtgtttccctctacagtgtgggtaacagggcaggccctgcgctcagtacccacattcccagctccactggacttccagctctgtgatcactggacacacttccagctgtgtgatcttggacaagttattctacctctctgggcattttttcatctataaaatggggaggcctgtggacagattccttgagcacaggagttggagaccagcctgagcaacatggtgaaaccctgtctctaccaaaaatacaaaaaagagaaagaaagaaagaaaaaagctgggcatggtagcatgcacctatggtcccagctactcagaaggctgaggtgggagaattgtttgagtccaggaggctaaggttgcagtgagctgagatcgcgccactgcactccaccctgggtgacagagggaaaccctgtctcaaaaaaaaagaaaatgcagaagcacagcctcctctatccttagttaactctcagtctacttggagaggtaaactatagataaaatagctaaaggacacgagcaaacatttaacactgcattaaggggaagccatggaaaggaacatttggaaccagctaggttagtgagtagtcagagaaagcctttaggagacacccaatgaggtcttgaaggaatagcttttcctaagaggagatcatgatacagagacaagtatcgttggaatgaacgatacttgtggagtggaactcatttggagagtgacagatctgaggaagttcctcttctgtgtggacagaggccaccccaggcctttgctttgctttttcttatccattagggtccgctgattctttcaccagcccctccggctgttctggcttggccttggccaaaagacagagcagtgagaccccaggaactgactgataagcaaagttaatcaagtgcctgtgtttctttcacaggactctgacaccaccataccaatggacgaatcactgcagtttaactcctccctccagaaagttcacaacggcatggatgacctcattttagatgggcacaatattttagatggactgaggacccagagactgaccttgaaggtggggtccctgctgggggacagagagaaggcctcttgttttagcctcatccaacagtttagtaactgtgtttatattttgattacgtgtcctcaaattgtgatattttgatgacaagacagagcccttgagtttgggatcctttctgttggagttgagttattgtgagcctgaaagtacccagttcctttgccagtgcttgaaacaaaccatgaagtggcctctcttaggatccaggtcttttcccatttactgaacttatcatgaaagtgagtgctactacgaggggtccaatcacaggctgagaaattgtgttacagaatctactcttggaagaatgaagacgtggctgtcctttggtacctcgctttaaggtggctttcccttaggacccctactgtggactgccttataactaaaaccttttgtattttagtaactgaatccccactgtgcagtgttagggctgcctggttgtttgcagtagattagagctttagaagcttctagagcttctaaagcccgtgctggtgatcccagcgactcttcactccctagccttaggtattcctagaagccctgaccagttggcactgctgagactccagcccctgggagtggtttacagaaacattacacagactctgatgtcagtcatgatgtttcagcctctgcccttttcctgtatcaaccctgatggataatagggcgtgggttctgtctgttatcagggtgtggtcccctgtgaatgaagcactcccagccactgagctgtgagaaacagtcactcggaagtgtgagctttatcttagtttttgttggatcatgttgagtctgtcagctccacaggacttcagtacgtttctgaacagtccctgccatctctacgggggagagggtcaggcaagctgcaagtgacactcacctcctgctgacagttgcagtgtctcagatggcctggaagggtggtctccagcagcctgctgggcgctcccctttcatgagagccacctgcagtgacctgaactgatacatgttgattagtctgccctttctttagaaaactgctactctccttttcatatctcagaaaaacagtagaggccttttaggaccaaactccatgtcacactgatgaagagccagtgggggttagagcgtcctgttaaggcacatgctaacttcccactcaagtctggcagcgctggggcatcagcacacctcttgccacccacactgataccagaggggaaggctgtgaggtggctgggggttgagacttgaggtttctaactttcctctgcacacctgtggctacctggtgtttgtctcttgattccctccacctgcctcacaccctgcctccgtcgggattttccacctacaccattcaaaaggaacataggagagggcatgaaggggctaggctgaagcactctgatgactggggccaatttgtggctgaaaatgaatacattttttgaaatttatggtcattttcaagtgatttagaaggttgatccttagcctcatacagtgatgaaataatctgtgtgttcagagccaagcaggactttagcaagagtctgattgtattgtcactatctcggggaaaaaaaaatacaaatacatttctctgatctctgatggcaatgaagtttgacttgtaatttctctggctgaggcttcttaattgctttctgggcagaatgtagattttggattcctgtccatgatgcctaatgttgatctcactttccttgtttctctcagttgctcattaatgtgtatttattaaaaaaaaaaaaaaaggatatggggcatgaggttagatgccatgcatataagttgcagtgggtgatatgtgctgagtgacttggggtctgccccggcattcacttatacttgtttcttactaagaaattgaatgtgctttaagctgaaaattagaaagcagtagggaaggacaggctggatggtttgggttgttggtttaggaataaaatgcccttttgttttggtggtgggtgatgccatctatagaagggttttaggtcattgtgttggtgtctttccgtctttcccacttgagaccctcttgtaaatatggacttgacccacccattgtactcagaagaaacctcaaagattgtactctacaaagtaaataggttggtatcaatgattattggaactagagagccgaggacaagttttttgatgttgccttctttttatagtataaaatattctaattttaagtatttttgttgagatataatttacagacagtaaggtatacagatcatatttttacaattcagtgaatttgggcaattgtatcagcctttgtaactcacactcccatcaaggcccggaccatttcacctctgaaagatccctcgtaccccttcccagtcagttgacccctctgccccaggcagccactgttgtgatttatttcaccatagatgaggttttcttgttattgaacttcatataaaggtattcatgctactcttttctatgtggcttcttcctcccagtatgtttccaaggttcattcatattgttacctatttaattccatgttggtagtcaggtactttttattgcaaagcagtattccattggtacaggtttaccatagtttgttcattcatcttgtgattagtgacaccattgttttcagtatgtatttatttatgtattttttgagacagggcctccttctgccacccaggctggagtgcagtggtgtgatcttggcttactgcagcctcgaactcctgggctcaagtggttctgtcaccttagcctcgcaagtagctagaaccacaggtgcacaccaccacacctggctaatttttttttgtagagaaggggtcttcactacgtgcccaggctgatctcgaaatcctggcctcaagtaatcctcccacccacccctcccagagtgctgggattacagggatgagtccctgcgcctggcctgtttgcagtttttagatattctcctgtgtttttttctagaagctttaattgtggctttagcttttatgtttaattctatgaaccatctcaaattaatttttatgtataatgtgaattgaggttcaatttttacacacatatctgtaagagagatacatatatataaaatacatacctgtgatattatatagtcagtcgttccagcaccatttgtggaaaagacttttctttccacttagcgttgctctggtaccttgatcaaaaatcagtcgacgacatgagagtggctctatttctggctgatattgctttctgtgtattctgggcatgaccaagagaatgtctgttggcaaagctccatctcctgatgccattcacccactcttggtaaagcgacttgatgtttgtttttttttctgttctcttctgccccaggggactcagaagaagatccttgacattgccaacatgctgggcttgtccaacacagtgatgcggctcatcgagaagcgggctttccaggacaagtactttatgataggtgggatgctgctgacctgtgtggtcatgttcctcgtggtgcagtacctgacatgagccagccacgctcagtggctgaacagcattcccacagcctgcaagtgtgtgtgtgtgtgaaagagagaggggggcccagaggccgccttttgaaatgtttgcctgtctgaactgtgaagacacttgggagtgattgtggtctaatttccaacctgctctgttttctgtgacatcttggagggggagctagtgccaccaccatgcgcggtgcttaggaaatgaaagaagtcccgggtctgtctctctcactctcgctctcactgggggagggaaagaatggctttggtggctttgttcacatagctgatgcgtgccctgggaaggtgtccacagtgagccctgtgtgcaggactgtccacacggttcacaccttgtcaccatcaggcctttctggctcctgatagggtggagcaaaagtggaaaggaaaggaaagaggccttttctcacagccattatattaaatagtaggtcgattcacatcctcgtgctcctggccaccctcccctgtgcctcagtgacatgtagatgactgactgccaatacttgtcaccattccctggaagcagctacctaggggaaacaagatgtagtgctattgccgataacaagtaagattttccacactacagctgggtgtttctcttttctaaagtgaggccagtgttatttcccgggagtgttcagtcttgaccctagtcactgattttttctagttgttaatagagtggttggcttttaaggttcagagactgtggcttggcacctgcgcccaggctttgtgggcctttgccccttagaaagtagctgtaggcaaagatttgtgattttccaattacagtctcagctctagttttagtatctctaattctttggttcccttctcttccctgaaatatattagcacctgccagccaggccctcattttgcccagccagtgtgggcagatcccaccgtggagacatctgtagtgtgtatgtccttgtaacactctgttttcagggactacaacctttttccttctgtgaccagccccggattcaggctgtactaataccaggtatattgtggaatttagtataaaggccaatctgtcctgaagtccatctaatgtggtgaatcactgaaagtctcagaaagacctggttagtgtatgttctcatttaccacaggcctaccagccctgggcacagcagcttcatggcaagacataaaatgacactcaaaatccttcagatctggaaaccggctcagtattaaccctacctttggttgtcctgccctacctgctctgttagtttcttgttgcttgaactgtcttctgtcttatttcccttcctttctgtgttcctcttcacctctcttgttcccctccccgctgctctgtagtcatgttggtcctttcaggcacctctgtggcatagctcccctttggtaagttttcttaattgtcatagattaactgagtttcctggatgctaatttcacactttcggttggaggagatctccattgttcctacccctccgggccaaatgggccccaggtttccaaggaaggagcaatctgtgactcctaaaatgggttggggccctgccagagttaaagcagtgactggagggtggactggggggttgcagcatctttagacctagatctgtctaactctggggaggcacattgacatttccattacacacagcactgctgcggtgccagggacctagcgcaggacttttggtaatccataaaatggattctgagactgcgacggcaaggctgtcctgtcccccaggcacccaaggatcctgccagacagcacactttggaggaaggtctgcagggagcagctgagccatttgttcttgaactctgggaggcagaagtccccgcacccatcatgcgtggactgataggacatcttttcgtggtgtgcaccagtgctttccacacttgacagtggttggctttgatgaaccctcatgctgcaccttcagagccagtcctctagtttggaataaaaattgcagaggtggtttttgggtctttaccacctgcggctggtggacagcagccagtgtgtctggacacccaggggcattgagactgcatgttgtcacatgaccacttctcttcacacatctgctttcagtgcctggtgaaaaatagaccttggcctaacagtgtgactctctccaccgcctcagtgtagggaagggtccaggccagggaaggagcaccctctagtggaggcgggggtgaattcttaggtcgagctgatgcaagaaactccggtagccagcctctgtgaccttgtacatgagtttggtgtgcctattgtgatttaaaacaggtgggttatcaagaggaacttgagatctctttattacatggacatttacttcagggggaccactgtaagaaaagccaaactccaagaccaagtaagttagaggagtcttgattttttagacttcactgcggagttctgtacaccctttgccctgatgaatttgaatgggtttgatttgcaaatttggatttacacccattgttttggaagcacatcagctgaataaagttgaggtttattttatttagaaaatcacattttgtaaaagaattcgatattcatttttataactaatggccccctttttttatgtttctaggccagagattctcaaacactgctccatggccaggggctgggctggctgcttcagaagcagtggggaagctttttaaaattacatattcctggggcctaccccagatctgaattagaaccttttttaaatctctaaggtgattttattttattttttatttttgagacagtctcgctctgtcacccaggctggagtgcagtggcgcaatcttggctcactgcatcctctgcctcctgggttcaggtgatcctcatacctcagcctcctgagtagctggaactacaagtgtgtgccaccatgtctggctaattttttttttttttttgtattttttagtagagacagggttttactatgttgaccagattggtcttaaactcctggcctcaagtgatctgcctgcttcggcctcccaaagttctagggttacaggtgttagccactgtacctggcctctaaggtgattctgatgtgtgtattttggaaccactgtctcctagacagaaagcttctgtctcaaagatgatcacattggtgtaaagagcaaaacttgttaagtccaaaataaattcttactgtttatatcctaccttagtccaaaaaagatttgaggagactttgaggaaataactgaaacagatacaaagaagtgaggcacaagaacaaatcaagtcagtgtagaatgtcgacatcaggacaaggaactcaaacgttgtaacaccctaagaaatgtttggggaaccctaatttgactttcagctccagtagccaaagcaaagaaagaaacgtcatctgttactgtctcaaccggggggtgacattttctcaagggaaagcctaggcccttcataaacagcttgcctgtaggcctcacggaggtcagacagggattttcctggctccatccctgccaatctgaaaccctctcacttatgttctccatcatttatcctcattatgcagacaaggggctgagctgtggtgactgtgaaggcctcacaggagtccgagaggagctggcccctcatccagcttggaaccatgggcccacttaatctcccacacttctcgtggggtgctctgctggggtctggggggattgagaggtgtgcaggggactgagatggtgcagcctgctggcatggactatagagctataaggtgtttgctgcagacccttcagatagtatagggcaagttccctgttgggaaataatttcctaactggaaggggagggaatctgaagtgaaagctgtcctcaggccttgcccctagggggcggcatagccctatctgtggctagtgggccctgaacacactgccttaggcctgctgtacttagaagctgagaaaggaaagtgtcattccttccccattttctgtgtccttttcatttcatatggaaggcacatgggagaggagtgttcaggggtgctgggcccccaagtgctgttggtaagttccccaccatggagcctctgtgagccatccctccccgcctcatccccatgtccctctagtacagggttcccaaccttggctctgcattggaattccctcgggagctttaaaaacccatgtgtgggtcttccattcaccctcttattaattggcctggagtgcagccggggcattgggagttgcccaaggcgattgtaatgcccaggggtagggagccgatggctctaatacaagaacatcaacccaaggctagcccgtcccccatgcacttcccctggccgcaccgtgggaaccacttgcagagaccaactaggggcagggatggaagcctgattctccctctggatcagaaggagccagatcccttgtggccattgggtgcccctcattaactgacacctctctgctgagtaaagcaccttgatgtgacaggccagctcttcgctgcccctgcagtgcagcccccagccctccccaccacccctgcctggtgttccgtcctccctggactgcttggtcttctcagaacatgccacacactcagtacagctgcacctttgcacaagatgtttcctctcagatgtgccacaaacacccccacaatcccatgaaacctccaagaagcctgcccctcccctccaaacaacctcatactgcacgcttcctgcggaatgggagttgctcctcaccgcaggggcctttgtgcatcccgggcacgtagtaggcgcaggcgccatcgggtaagcggctgcaggagagcacttgagcccatcccccatgcagggccagcaaagctgttgcagccaggccaggaggaagccagaaggttcaaggccactgatgctacgagccatgtgctcacagggcctcaacaacagcaatgactgcagtaaaagaggagaggcatggggccccgtgagggaaactgtcactcaggactggggagagagaagtagagtgaccaacttgtctgggttttaaagctgaaagtcctgaatcctggcgatccctcggtctgatggtcaccctagataagctaaaggctaggacaggcgtgactaatgcagggtatctaggaagagggggctctcggaggctgactcctggcttagcaattccattagtgtggttccactggcccttccttccaggcatctgtgacatggtggctcctggagagctggcagaggctgggccaggcccaggagggaagtattccaacctcctcagaagacagtggctgacagtacaagaggggacattcatctttattccgtcttccagagccctggcatgtgtccagtgccagtgttagctgtttcagggcagagggaaggagttggagacaagcagccctccgcagtttgcactggttacagcggccggaggctgtggtaagagcgctgagcccaggatgcagagcctggcttcaagtcccagccctgctggcagcaaccacgggccacacacctctcagcctcagctttctaagaatgggggtaacacctgtcccacgtccctttctggggtggacatgaggcccgagtcacgtagtgcttttggcagattccagaggtctgaggcagtgaccctcagcctgggctgcttcctggagtcccccagagagtttggaagtcccgattctgggcctcgctccccagagatgccgagctacctggtctacagtggggcctgggcttcagaatttttaattttcttttttttttttttcctctcattctgttgcccaggctggggtgcaatggtgcaatctcggctcactgcagcctctgcctcctgggttcaagcgattctcctgtttcagcctccggagtggctaggattacaggcacccactaccacgcccggctaatttttgtatttttagtagaaacggggtttctccatgttgggcaggctggtctcgaactcctgacttcaggtgatccacccacctcggcctcccaaagtgctgggattactggcataagccaccgcagccggccttaatttttaactttctaaggagtctcctgtgaggtcgagattgagaaccacggctgtcagtgcatcccaggtgcaatggagtatcattcctgttcagctggaaagacaggatctactcgtgaaacaaccgaggttgagaggtgatagtttagtgcggccattgtggtgggggcattaaccaggaagagctttctgtgagagggcgaggtgatgggtgtgtgaaggacaggagatgatgtgggagcagtcgaggggcaggagtggcctgggggagggaggaagctctaaccagccctggctgctgtgggctctgaggcctgatgtgctgtcttctgcacgacatcctccacgcactgtcctccgtgttccagctgggaaacttgctgctcagaggcctgagttcatgctgctgagatgctactgagagctggagaagctgtcaggctggtgtgggtgtggacaagccctactgtcctaggaagacctgcccatgatcttttgaggtgcaacgtagtgtgatgggggtggtgggatagtgtttgagatggggttggcagacatggcgtagaatcctgactttgctgtttattagcagcctaaccttgggcttaatcactccagcctcagtttcctgtctgtattcagctcaaaacagaattgcatctttgctgggtggtaactcatcagagaggaacaggcgtgggctatgcagaagggaagcagttctcccttctttccagcccgagcaacaggatccacattctttcaaccaagaccacttggccctgctcacctcctggcaacttctggcctcctctaagagtttcttgtgccccaggcatgtgcagggactgaggcagaagctcagggagtggggacctctataggaggggagaataatcactgctgcccccaggacctcaccaggtggttgtgaatgtcaaaaggtaaaaccctggagataaacccctgatcgctgccgggtgctgtccaaattattgttgctatgtgcatggagtgggtataaattccgtgtccatggtgatttcttccaggaaaccatttcttttttccccctgtggcaaagggcagcctctcttacctcaatccaggggccctgggagacccttggaaggcggggcctccagggctgaattccagaacagcagctgtggccacctccttaggccacctgggaatcaattctctgtcgtcactcacttggaggaaaccacatttaaattaaaaatgtaggctgggcgcggtgtctcatgcctgtaatcccagcactttgggaggccgaggtgggcagatctcctgaggtcaggagttcgagaccagcctgaccaacatggagaaaccctgtctctactaaaaataccaaaaaaaaaaaaaaaaaaaagaaaagaaaaatgccaggagtggtggcgcatgcctgtaatcccagctgctcgggaggctgaggcaggagaattgcttgaacctgggaggcggaggttgcagtgagccgagatcacgccattgcactccagcctaggcaagaagagcaaaactccgtctcaaaaaaaaaaaaaaaaaagtaggtggcctgggatattccctttgtggaaaaaaaaaaaagaaatagctcaagctcagtattgcagcccttaaacagaaaagtaattaataattatgagaggccaggcatggtggctcccacctttaatcccagcactttgggaggccaaagcaggtggattatctgaggccaggagttcgagaccagcctggccaacatggtgaaaccccgtctctactaaatatacaaaaactagccaggcaagttggtgtgcgcctgtagtcccagctacttgggaggctgagacatgagaattgtttgaacccaggaggcagaggttgcagtgagccgacattgtgccactgcactctagcctgggtgacgaaatgagactctgtttcaattttaaaaaaacaaaaattatgagatgtcgcggggcagcagtcaagtgccaagcaagtggggtagatatcagagggtggagagcccacccagcagtgagaggaggctgcaactgactgctgcccctggggaaggtgggacgggggccagattcacaggggagccatgtgagcttggttctcagcaggctgggtttggagtggattgtggaaagagtagggacgtattagggtgaagctggaggtgggtgtggaggaaggccaggggaccctgacatgaatgtggatgcaggaaccctcagctgtctctgaaaccaggagggctggggaaggaccctgtgcatgtcctagattctgtggccccaggagttactgctcaggaagcagggcagcctcctctttggtgtatgtgtgcaagagagaggtcgtggtgggctgtgggttgttagtctctctcccaggagcacctggcaacctgaactacccctgctccctccccaccctgccccagatctggtgaaaccaccaaccaggcggaggcagggcagaggctgtcactgccacacaccttcagagctccctacaacttacgttcatgctgctgagatactgatgagagctggagaagctgtcaggctggtgtgggtgtggacaagccccactgtcctaggaagacctggacatgatctttttaggtgcagtgtaatgtgatgggggtggtgggatgatgtttgagatggggatggcagacatggcttagaatcctgactttgctgtttattagcagcctgaccttgggctaatcacccaaacctcagcgtcctgtctgtatagtgagaataataataactacctcaagtggtagcaaaagtgcctgtatttgagagcttgtccgtcactagaaatagtttttttttctttttgagatggagtttcactcttgttgcccaggctggagtgcaatggcacaatctcggctcaccgtaacctccgcctcccgggttcaagcgactctcctgcctcagcctcctgagtagctgggattacaggcatgtgccaccacgcctggctaatttttcgtgtttttactagagacagagtttcaccatgttggccaggctggtctcgatctcctgacctcaggtgatccacctgccttggccttcccaaagtgctgggattacagacgtgagccaccgcgcccagcctagaagtgatttttgtcaggagacagaagacctttagtgattggagtcaagcaggtggagtgtgaagatcagctctgccctttagctgtggaaccttgagcaagccacctcacctctccacgcctctgttctgtcaccttttggagatgaataatgcccatctcacagggcagctgtggccagtgcatactgccatgcctgtaaagtgcctactgcacagcccaggacatagaaagatggtaactgaggttttgttgtggttgttcactagcattgcataggacccaggtctgatcccttcattcagctggtgtgattgtgagtcaaggatctgatatccccaaagaaaggactgcaagtatttgccagtcagactttatttgttacaagatacgatattgcacatgtattcctgtgttcttcatcagaagacctgaattcaaatctccagttcattacctattaggacttgctcactccctctttctctcccagcctcagtgtcctcgtaggggaaatgggaatgctaataatggcctacttcacagaactgtggtgaagacaaagccaatcaagcatgtggatcagtgagtatgcgcagggctgcaagggccagaaatcccaggatcttactgctggggttagatactgatctaaggagcttaagtagtaagaactgtggatgtggggcagcctgcagagctggttgatttagggctcggtgacatcatcaaggctgggcttgggactgcctgggttccctgagaggcgtggaaccatggtgggaagatgtaggaaagatgaggatgatgattgacagatcagtctggaattgttgcctgctaaagttcattcatccattctttcgatagctacgaactgagcacccaccaggtgccagtcacgggactgggccttggagaacagacgtgacccacctgcattgtgatccactgctgtgtaacaaatcaccacaaaacataggggctgacggcaatagctctcagttgctacacctcacagcctctgagcataagaactggggaccaggcgtggctgggatagctgtctctgctcagcgatgtctggggcctcagatggaagatttgaaggctgggaggagaatcatctgaaggttcactgatgtggctggcacacagtgtcgctgggcacacaatgtcgctgagccctggactggggctatcctctggaacacctgcacacggcttctccatgggaccagggcttcctcagggcatgatgactgagttccaagagtgagtatcccaagggagagagcaggtgggatctgtgtactttctatgaccaagcctcggaagtcatagggcctctgttctgccatactcctttggccgtggtgatcacaagccatatggtcacaagcccccagctgcctctcagtgggaagaatgtgggtcacattctaagaagagcaggtgggatggaattgacacggtgggtggccatctttggagagtacaatctgccacactccccttgaatgatgctcacgtctagctgggaagacatacatgagcatgcagcaataaagtgcacaaaccgtcacacaggtacaaggtgcttagggccatggcagaagtagtatctacttaccctggaaccctggaggaggcttttgagctgaatctcagatgagtcagactggagcaggtggagcctgggcggacggtctcagcagagggagtcatctagcaaaggggtgtgctctgggaagggcaggaggattctgtggctggagctcaggcttcaggttcagtgtggaggagggaagaaaggctgcagaggtaagttgaggccagacgcggggtgcctaagagcagactcattagtccctgccctcctccagtccctggtcctctgcacacagtaggcacttcataaatattgattgaaattggagtgagcagtgtgtgttgaagaggaaaccaaatcccaaagagaggccgtggggcctcctggagggagcatgggataaagacagggagaacccactttcatatcataggaacttgagattctctttctcagttgttgcctttccagtatttttcaatgtctctgcaagagttcacgggggctgagagcagcccctgagtcacttctcgttcctatccctcacccccagctggattcttgggtcttcttccctccatactggtccccagagagtgtggactctctgcctcttgtaggtgaggaggaggcggctggctgaggaggtggcagaggcaagtgaaagggccaggagggtgaggatggagagaaggggagggaaaagaaggagatggagggggagaagatgaagttgctaagtgtatgatcagtgccagagccaaaagcccatactacaaattgctttttccttcacacttgtcccagggaaaggcccaattaaaatagcacctattggaaatggaagggtaattggaccaggcagcttattaggcccatctccaagagcattcaggggcagccatgagcttcaggaatttccaccatgtgaacttagcgggggagatgaccccgagcagcaagggctgacaggatggggctgccccaccatcctgcctgcccggggccctgctcagtggcttgagagggcagggactggtctgtgtgggggcactcttctgtggtggggtagttcagtgggctgagacatggggctgatgagatcaaaactgtccagttccaaatcccagaacagaggaaaagcggggccagaagtggtcttggggaccaccaagccagactttctgggggagaatgacttgccaagggtgacccagtcggtgatgagagatctggagtcagagggggaagtcaccgactcccaatccagtgctgctgcccagggacagtctcaccatgccacgctgtcctaaactagcctgtggccctcgccccaactacacgcccatggcctgtcactgtaccatgttcatgccaggcacagctaagtcagggtggcaggagccacgccaaaggcttctccagcttgagggcatcatctctccacacccctcagttattgacagaaactggcacacgcactgccagaccacgctgtccctaggaggaggcagacagaggtggacgcagcccacaggcttggctggaacggcgggttccagaggtgcccgctggccgcccacagtgaagtctggtaggggtggcactctccccacaggttacccattggaccagagctcatccacccagagcccatttccatgacaacagcaagctccttacccatcaatttcatccttaaagattcccaccccagctttctgagcctgggctcctcgcccagctgccgcgccagcccacgtctccagatcacaggtttagcagtgacttgtcaagctgccagagagagcctcctgggaggtgccttttaactggcgtagcccttgaaaacgaccatataatcacctgctaattggattaggaacttgttcccagggactttcttttgcccccatgttgaggccaccctactccattcttccggaacttagcattggagagcttccccgttcccctctgcacaacctcccaggccagggtaatgctgacagggttgccccaaagtcagatagtgacacaagaggaaaaggaaacctctaattttctggggcccaggtacactcagagaggaaaaatggcccagggtgggagaacacacagggccctctcttcccccactctgcccgcctttcagccttgcaagaaaatctggcttttccctcggggtgtttgcctcgctgcttctcccccccagacatcacctccctcacagcccagctccatgttcacccccaccaggaagtcttcctttctaaaccgtttttctctgcatcctctcagagtggctatatttggttcctgcaatataacttcgtatatattgcatcagggagagggggagattcctgaagctgggttgttattttttgtgaagctatttttttggtgcattttctttctattccagaaaattcttatagtgggtggatgtcatttatctacccagcatctcgtctttggactacaaatccttatccccttctgctggtgccattgtctctccttcctgtggaaaacctgtgccacgggactcagcgagggctgcctcctccagcagggtcagcgcctgaagcaggcctggtccatgcaggactgggtcagcagcccaaagcagtcggtttggggtgaccacatgactgcgcggtgggccgatcagaatcttccctggaattcccatagacactgctggtttcctgaccaacatccattcctcccctattctcactagctacacgccacttttgttgatctagcaagaagtccagttgaagatatttgtgcctctagactttcttgcaggtaggggtcaggtcacccaattctggtcaataagatatgggcagaagttgctgggagagacttctgggaaagggtttcaaaaggaacatggctcctttagtccactcttaactgatggctgagatggagacatcttaacctgaaggcttttattccagctatgtgagaggccacctgagaataaagtgatccgagaagaaagcaaaacagagagagagacagagaaagagatggcaatatcagttaagtccctggattgagccatgcctgaagcctcagaacttcccaatttggagagccaatcaataaatccttttcctacttaagctggtttgcactggatctccatctctttcagtgaaagacccctcagtgcaaacctccacaaaaccaaacccatgtctttccctgcctctgttctctcctcccaagataccccacataagatgctcgatgcaaagctggcacacaatattcattcaaatgactctgagccccccaaattctttttgtttttaaattttattattattttttatttttttattttattattattttacgtaagttttagggtacatgtacacaatgtgcaggtttgttacatatgtatacatgtgccatgttggtgtgctgcacccattaactcgtcatttagcattaggtatatctcctaatgctatccctccccactccccccaccccacaacagtctccggtgtgtgatgttccccttcctgtgtccatgtgttctcattgttcaattcccacctatgagtgagaacatgcagtgtttggttttttgtccttgcaatagtttgctgagaatgatggtttccagcttcatccatgtccctacaaagaatatgagctcatcattttttatggctgcatagtattccgtggtgtatatgtgccacattttcctaatccagtctatcattgttggacatttgggttggttccaggtctttgctattgtgaatagtgccgcaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccgccaacagtgtaaaagtgttcctatttctctccagcagctgttgtttcctgactttttaatgatcgccattctaactggtgtgagatggtatctcattgtggttttgatttgcatttctctgatggccagtgatgatgagcattttttcatgtgtttcttggctgcataaatgtcttcttttgagaagtgtatgttcatatccttcgcccacttgttgatggggttgtttttttcttgtaaatttgtttgagttcattgtagattcttgatattagccctttgtcagatgagtagattgcaaaaattttctcccattctgtaggttgcctgttcacgctgatggtagtttcttttgctgtgcggaagctctttagtttgattagatcccatttgtcaattttggcttttgttgccatcgcttttggtgttttagacatgaagtccttgcccatgcctatgtcctgaatggtattgcctaggttttcttctagggtttttatggttttaggtctaacatgtaagtctttaatccatcttgaattaacttttgtataaggtgtaaggaagggatccagtttcagctttctacatatggctagccagttttctcagcaccatttattaaatagggaatccttttcccatttcttgtttttgtcaggtttgtcaaagatcagatagtagtagataagcggcattatttctgagggctctgttctgttccattggtctatatctctgtgttggtaccagtaccatgctgttttagttactgtagcgttgtagtatagtttgaaatcaggcagtgtgatgcctccagctttgttcttttggccttggcaatgcaggctcttttttggttccatatgaactttaaagtagttttttccaattctgtgaagaaagtcattggtagcttgatggggatgacattgaatctataaattaccttggtcagtatggccagtttcatgatattgattcttcctacccatgagcatggaatgttcttccatttgtttgtgtcctgttttatttcattgagcagtggtttgtagttctccttgaagacatccttcacatcccttgtaaattggattcctaggtattttattctctttgaagcaattgtgaatgggagttcactcatgatttggctgtctgttattggtgtataagaatgcttgtgatttttgcacattgattttgtatcctgagactttgctgaagttgcttatcagcttaaagagattttgggctgagacagtggggttttctagatatacaatcatgtcatctgcaaacagggacaatttgacttcctcttttcctaattgaataccctttatttccttctgcctgattgccctggccagaacttccaacactatgttgaataggagtggtgagagcgggcatccctgtcttgtgccagttttcaaagggaatgcttccagtttttgtccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacgtttattgattttcgtatgttgaaccagccttgcatcccagggatgaagcccacttgatcatggtggataagctttttgatgtgctgctggattcggtttgccagtattttattgaggatttttgcatcaatgttcatcaaggatattggtctaaaattctctttttttgttgtgtctctgccagagccccccaaattcttatctcaacaagagtcaaataaagacttgaaaagacttgacatctaaactacacttattaaggaaaaactcattaattccctatggagatctgaggccaagcacacctctgaagcagtgcatggcttggaatcctgtctgctcttcaccgaaccattccttctgcactcacctcctccagaaagccttccaaaccaggtcttaactccatcatcctaactaccttgtcagcactcacttttgttaacactttgattcagcagtacttgggttccatgagtatttgagcatagttgtgtgtgtgtctcatctctctcaccccaaacccactccaccccaccctaccctaccaactgactctcctgaactctctagagcaagagctgtgtctccatcagactagcaacttcctgagggcgaagactctaattccttatcccattgggatccagatgctgtctctcctcacatcagactgggaatggaaaatctttccatgccccatggagcctccttggcaagacaggaagatacggagtctgaaccccatagagatggagagtgggaggaagaaggtagccgggagcagttagcaggagggtccatcttaaccttcagggaaaaaccgattcacagcacataaagctagttctggatcagaatctgttattcaacaacacttgcaagggtttaactcagatcctgtcccctctggggtagaaatctctacccgcctaaggccaggattctgccttgccagtccttttttttttttttttttttttttttttttgagacagagtttcgcttttgttgcccaggctggagtgcaatgctgccatcttagctcactgcaacctccacctcccgggttcaagcgattctcctgcctcagcctcccgagtagctgggattacaggcatgcaccaccatgcctggctaaatttttttgtattttcttagtagaggcagggtttctgtctctactggttggccaggctagtctcaaactcctgacctcaggtgatccacccaccttggcctaccaaagtgctgggattacaggcgtgagccaccgcacccagcccttgccagtgtttcttatttctcttgtcccttgatgattgtgtaatgatgaatcccttcgttaggaagcttgtcaaatgcaagtagacgctgagggggcggccatgtgtctactgtctcgtggctcctgttggatgggagtagcctgcgtggctgccagtgctggctggagaggataccaccatctgctctcgtcagcatgctgccctgcctttgagtcccctcactcccgccccaagactaaatccttgaaagagcagctccacagcgagcatgtggcaagaaaggatgctaatggagggaagaaagtgatgaatccccaaaagagtcagggaaagccacacaagaaggaaaaatagctgcataaaggttgcgggggtgagctgggcgaggctgcccgctgacaggtgaatcaagactccagagagctgggtacggtggctcacacttgtagtcccagcactttgggaggcccaggcgggtggatcgtgtgaacccaggagttcaaaaccatcctgggtgacatggtgaaaccccgtctctacaaaaaatacaaaaattaggcacagtggcatgtgcctgtagtctcagctactttggaggctgaggtgggaggactgcttgagcccaggaggtggaggttgcagtgagctgagtttacatcactgtacaccagcctgggcaacagagtgagaccctgcctcaaaaagaaaacaaaaaaagaaacccaggctaagcgctgtggctcacgcctgtattcccagcaatttgggaggctgaggcaggtggatcacttgaggtcaggagtctgagaccagcctggccaacatggtgaaaccccatctctactaaaaatacaaaaactagccaggtgtggtggtgggtgcctgtagtcccagctacacaggaggctgaggcaggagaattgcttgaacctgggaggcagaggttgcagtgagctgagatcatgccactgcactccagcctaggtgacagagtgagacttggtctcaaaacaaacaaacaaacaaacaaacaaaacccagacagcaggaagcccaggtgaggagaaggggagaggcaaacaggacatgaaggaagatttgtttggtagagagaagggaattgatggcagccccaggatgcagtttgaacctgtatttggtagaagcagcgatggggaaatgggccagatatcggacaggagagagacatgatacaatcagtgctaatgatccagacatctccatggaggaggatgagcactcaggggaaacggaggcaaggcactcacccaggacgctgcagcagggatcagtgtgcctagcatggcaatggaagtgagagggagtcggagatctgactgagcgactcctaactttgagagttggtggctcattcccaccaaggggcttatggctgctgctttgggagtctttgctgccaaatgtcactggccgggggtcacctcacccgtaacccatggagagtgggtctcctctccccatttgtgcaggactttctttccattggcagcaactggccagggggcctcagaggagctgggaatggggagcaggctgccaagaaggtttggtcaggccaaccaacttggagggcagggaaagaagtggagccgtcaaccttcacattttacaggcatacaaatcacacaccaaataaggagaaatatgggacacatttgcacaataattcaagacaggatctccatggcaacaattacccaaaaatccactcctgacagttgcaacagcgggagctagcaaagaagactgggggtgggaaacgtgtgtgggggctcagagaatggcttccttttattctcgaactgaaggaagtgctgacggcaggaagcaaggtgtctcacagcctgactaagccaagagccactggaagtaggatctggaagaagccttagagacgtctgtgtgagctccttttgagctgcttagaggcctgggtgtgggataccacagtgagatgtgccagtgggatgtgccagctcaggggagggggccatcagggcatcgccctcccaccactccctctgatggacaagagttctccctagcctccagaggtcctcacaggggcacagtgagagatggagccaacttccggcgaagtcaaaggttctgggacatttaagtctgcctgaaaactgagtccagtccatagaaagctgacacatgacataggttaggagaacggagctctagcctgctctgctcccctcccagacttgctgtgtggcccctcagtttcctctacagtgaaatgtacaacctacctccaagaactattacaaggctgagtgaatagcatgagatgggaaatgcttttaccaaaatcactgccaatgcaaaaataagaggtttctgtgcagccatgaagagtggcctgagaaagatagctgcatgcaaggctgtccttaacaggcagaggagtttcctaggtcaggtgagagtcagtacaaagactgtggtgggaatctagaatgtggctaggcagcgatactgatgagatggtgggaagtaggaggttgggcgtagtggcagaagtgtcacctgtgtcctaccaccagacagatggacagactgactgtgagctcagagcaggcagtagagtgtgtaacctccaatttacaaacatttttaatcacacaccaaaaaggaaaagcattctgctttctttttggagtaacataaatccaaccccgttccccacccacatccttttaagtgtatttctttttgtctggtagtcctcaaaagccattggctatttttcagatcctagagctcagattgccttaaatcgcttgagaaaggagagttttttcatctttctttttggaactaagactttagagcaaaggaaaaggttcttctgggtttcatttgcatttggaagcccaggtttttgggaaaaaaacactctcaagagcttattactattataaatgtttagccatgtgatttttcctcaagagggcacccaaaacttttcataccaactcccatggatagcagtccccttatgctgaattatggtgggaaaggattaaggtaggacatttcttgagcatttttttcctattctgggctctctcctttgccatcccactctccactacaaaacttttcccttcccttttgtctcactaaccatggaaagtcctccaatccttggaggtcctcagaagccattcttcccaccactggagctgactttcttccctctcctggactgagcaggaagaccgattcatgagagagctcctctaaaggaattcaggctgggccctgagacaggacatcatggagtggactttggagtggccacaatagtccagatctggtcctcagcagtagagtccagaaacttggttgggccaggacatccaaaagttgtcagcctctcaggactgattcaggctaaccaaattcattgatgggcaaccagaatgccatttcctgaataatatatctaccaaaagactggtatccaaaatatggaaagagctctcaaagctcaacaataagaaaacaagcaacccaacttttaaaaagcaaaagacactttactaaagaagatatacagatggcacttaagaacatgaaaagatgctcaacatcatcattcaatagaagacaaattagacacacaatgaggtgtcactacacacttggcatacatacaaacaaacacaacacaaaatctgacaatatcaagtgctgacgaggacatagagcacctagaatgctcacacattgctggtggaaatgcaaaatggaacagccactatgaaaaacagtttggcagtgtcttacagagctaagcgtgtgcttcctatatgacccagcaatctcatttctaggtatttacccaagtgaaaggaaaacttttgttcacacatacataaaaaaactctacatgaggatttatttgcaatcaccaaaacaggatacaacccaaatatccttcaactgaagacagataaaaatttaaatttaaaaacctgtgatacatccatccaatggaatattactactaagcaagaaaaaggaacgaactactgaagtgtgaaacgatatggatgcattaagataagtgtgagaagccagatggaaaaggcagcttattgggtgattccatttatttgaaattcaggaaaagaaaaaccacagggacaaagaacagatcagtagttgtctgcattaagggaagaagagtttgtggatttggctacaaagtggcagcatgaaggagtatctcgattgtgttcatgatgacacaactctaagtatttgtcaaaatatatagtgctctacgtcaaaaaagtaaattttaccctaaatttgaaataaaaataaaaggcatttataatgactactttggggagagtttaaaaaaaacaaggtgggaataaaatactagacaaaaataacttggtagatgagagagataattagaatgtaaacatttaaagtcctgattttgccgaggataaaggtaaagatattgattaatttcagacttttggaacaaggatgcttttaaaaatggaagggtaaccactaaaaaaacagaaataatatgtataattttcaaactagtagagactatgaaagaagtaagagaagaaacaaatatctgtaattttagcactttgggaggctgaggcaggaggatctcttgaggcctagagttcgggactagccttggcaacatagtgagaccccatctctacaaaaaacaaaataactggaacatggtggtgtgcatctatcgtcccagctatttggaaggctgaggtgagaggattgcttaagctcaggagttcgaggctgcagtgagctatgatcacgccattgcactccagcctgggtgacaaattaagactctgcctctgttaaaaaaagaagcaaatgaaaagtgtagcaacagcaaatcagtaggtaagatgatagaaataatccaaatatattagtgatcacaataaatgaaaagatgaaatacgtctgtaaaaagattatattttttaaaaaaggtccagctgtatgatgtgtacctaaaatataacgacatagaaaatttgcaagcaatgagttgaagaagagatacacaaagaaactaaccaaaaataaagctagtatagaaatattaatatccaacaaaatgtacaccctttatctaatgcctactgtatgcagagccctgtctgaagcctgtgagatgacacaggagaaacagaaacatgactgctaccctaggggattatagttaggggctgaccaatgattccaaatcattttatttaatcaacaaatacttgttcaaaaactgtgcaaatccaaaaacatgatatttctaaaatgaggataagggagtggggcatagttggaattccaaaaataaaaataggggccaggcacagtggctcatgcctgtaatctcagcattttggccgaggcgggcagatcatgaagtcagaagctcgagaccagtctggccaacatggtgaaaccctgtctctactaaaaatacataaaaaattagccgggcgtgatggcatgcgcctgtaatcctagctactcaggaggctgaggcaggagaataatttgaacccgggaggtggaggttgcagtgagccgagattgcgccactgcactccaacctgggcaatagagtgagactccatctcaaaaaaaaaaaaaagtattgatcagtgtagtagttgattttcaaagatacccccaatgaaccatgcctcccagtgttcatgcccttgtttagtctcctcacacatcaaatctggactggccctgtgactcattttaataaacaggatgtggcagaagagaaagtatgctgattctgggccaattattgaggtctggaaactgcttttgcacttttgggaagaaagctgccatacatcaagtatagctatgctgctgtctagactgtgtggagaagccacatggaggaaatgccatgagttgataaggagaggaaagaggtccagccatctcagcagagcccagccttccagctgtccctgccaaggtgccagacactctagccagccaagtccttgaaggttgcagttcctgtcagtatcacgtgcagcaggactgagcagttgagcccagttaacctgcaggatcatgaaagataatgaagtggctaccataaaaccagaaatttctgggagtagttatgcagttatagataaccaaaagaatctctttcagtgtgtgctagaccctctgctaactcatcattttcatcaatgatgtgatttaatcctttcaaacatacttagaggtatgtataactaactcccattttataaatgaagaaactgaggcttggaaagaatgccacatggctaataaagaatagaagcagggcttgaatcaaggaagtcttgataagggacttcacactctcaaccactgcattatgtggccaagtgggagagctgagggatgaaaaacacaagacatttcacaataaatcatgatgtctatatgagcaccctttaagctttctattccttgtctttcttcatcctgtgctactgaccaggaaagtggattctataaagatgatcagttaagtaggcagatgacagccaggtgcagtggctcacgcctataatcccagcactttgggaggccaaggcgggtggatcacttgaggtcaagagtttgagaccagcctgaacaacatggtaaaatcccatctctactaaaaataaaaaaattagctgggtgtggtggtgggtgtctgtaatcccagctacttgggaggctgagttacaagaattgcttgaacctgggaggtggaggttacagtgagccaagatcacaccacgcactccagcctgggcgacagagtgaggctcggtctcaaaaaaaaaaaaaaaaataggcagatgatatagttggagattttattatagtttggacacacttcataacaagcactaatcatcctcagtgttcagttgtcacttgagaaaatgtaaatgctacatctgctcactgcctgtcttttcttccagacaaagaacatatgttcttgacaagggagtgtgccttgttccccacccacagtcaccactggagaagcttgagttttggagaggtggggactggctgaattctctttttttctctttttctcctttttgtttttaaagagaatagcatcttgctctgttgcccaggctggagtgcaatagcacaataagagctcactgcagtctcgaactcctggtctcaagtgatcctcctgcctcagcctcccaagtagctgagactacaggagcgtgccatcacacctgtgtaattgacttattttttgtagagggtctcactttgttgcccaggctgatctcaaactcctgacctcaagtgattctcccacctcagcctcccaaagtgccgggatgacaagtgtggctgagttggtatgggctctcctttccccatatccaaggcaagcttccaggattcttctgggacatcaggtgttagggaccatcttagtccctacctcagtttcacacatgagaaaattgaagtccacagaggaggtgtggcttcatcaaaaacccactgagaacgagtgttagaatcaggctaggacacattggactcctcctccagggctctctgacatccaaggccctttgaaatctctctccagctgcaaacagatttctagacttctgatggaggtgatctgagatgagcagcctctaaaagcagcctctgcgagcctctaagagcagccgggacctgctggagaacagaacatggcctaggagcgcaacagccaagtgttcagcaccacggacagcttcgctggcctattgctggggaggccagaggtggggaggctggttgtccagcaagacagagtgccatgggagagagaaaaaaacatgggaaagatctcagagaccatctagtccagcctcctcgatttggatgggaggagacccaggacaagagagaagtgacttgtccaaggtcacacaacaagtcagtagagagccagagatgggagctgacagcctacttcctcacacctcttcaaggccctcagatacctggtgtccatgacttattagtggcacagccagaccttgattaagggctccaaaattaaaattacctgtccttggaaatgacaagaaaagaaaaaaggagaaatcaaagaaatggaaagagcacccggccctgatgggaaggtctgtgatttggcctctaactgcaaggctttgacaggagcttcctactttccaaggtgatgtggcctttcagaaacaatttagttaccatggcaacctcattccaggtttcatctccatggcaattcactggagtttttcaccctccggtaagtacatgtgtgatggcccagacatgtatcccagaaacattaatataaaatcacatttttagaagtggagtatctcattatcctagtctgcagccagaggaataacaaggcatgttctcgggtgggcagggcccagggcatagtggaaggatgtctctgggggcagctctgccttctcactgcaattgcaaacctgtcccagtctttacagctagtgcatctcaacctcccatgggtacaaatgatttctccttttctgcatcctccctggtgccctgctcatgacaaagcctgagtgttgcctgtgctgacaagaagtgctgggacaaggagagagaaagctggtccttctgactatgacttctgtggcaccccagggctcctgcttccctgtccactgtgccccagattggggcaccctggagcagttcccagcttttgtgttggaccttgcttgtctgatctgtggactgtgggcttccccctcaacgtgacctaatctgccatccaatttccaggaaatcctcgtggtttctgctccacccagggcaccccttctgttttccagcaatgctatgccttctctttcttttttttctgagacacagttcactttgtcacctaggctggagtgcactggtgtgatcacggcacgctgcagcctcgacctcctgggctcaattgatcctcccaccttagcctcctgagtaaatgggactaccggcacacagcaccatgcccagctaatttttgtattttttttttttttgtagaggcggggtctcattatgttgcccaggttggtcttgaactcctggtctcaagtgatcctcttgccttggcctcccaaagtgctgggattacagacgtgagccactgtgcctggctgctatgacttttctttaatatgtcctgctgtttataatgatgcagggctggagtatttagcccaccatcttgacctaaccttctctttctttctccacttttaatgtctataaataaccatctactaatctacttataatatgtctaacgatggatcatttctctcctcctcatcttcttcatcatcgtcaccagtagcagtagtactatttcgtgattgagggatcaccacagagtaagaagtgctcacaaaaatgttccatcaacatctcaaataatgagacagaaaaatcaaggcatggcttcatttaaaaaatgtaattgagagtatgaaatgtactagctatgtaccttctcagaccactttttttgagacagggtcttgctgtgttgcccagggtgcagtgcagtggcacgatcatggcccattgtgtgacctcctcacacctcttcaaggccctcagatacctggtccttgtgacttatttagtggcacagccttgacctgctgggcttaagcaatcctcccatctcagcctccagggtagttggaactacaggtgcaccccaccacacccgattaattttttgtattttttgcagagacaaggtctcaccatgttgcccagaatggacccgaactcctgagctcaagagatcctcctgcatcagcctcccgaagtgctgggattataggtatgagccaccaccctgacctccaaataccttttgaactcaggcttggatttgaactctggttctatcaactattagctgtgatttcagatcagtgacttgagcaatttgtgccttgtttcattaagtggagatgacaatagcacctgccttgcaagaattatttgatgtggccgatgagaaaaatcagaattatgaaaagtgcttcacaccattcctggcatgtgaagagccctctctaaatggccattatgctaattagcaccttaaagggaaatcattttcatgaaattttatttgaatctggctagagaaaatgctcaccttcttccttgtgttttgcttatttgattaaatgtctttgatttctgtgatgtgtgaagtcccttgaaagcagggctgtgtgtccaacaaaggtttgtggccttcccgcagtgaattgtgtgggaaatacaaacacagggaagacagttctggtcctcaggggaagtgtagtggggaagacggacatgagaacctaaccataacaggatgcagagcgaggcatgtgccatgcactgtggccgtgttacctcctggtttggagtgtgagctcagacaccagtctgcctgggtttggatcccagctctgccacttattggctgcacaacctcaaacaagtctcttacccttgctgggcttcagtttcctcaaatgtaaagtaaaaatggtaacaggagagttaatacatgaacagaggctaacacatagaagggctcaatcaacattagctgtcattaccaagatatacgaagatagtatggaggggatatgtgagaagtgattataattctgtttcatgggtgaggttgtacttgagcttggtcttggagggtaagtagttctcaaagggcgaagagaaggagagaggcattttgggggaagcagagcagcaggaacagaggcatggagtgtgaactctgcagtgttctctgggtacagcatgggggctggatcacaggtgcatggagagaaatactgggaaatgggccggtgcagagggtttaggacagcccctaggaggtcttgaaaactggctcaagcattcagacagttctgtagacaacagagactgactacaggctactggagagaagcaacatggtgccacctgtgttctgggcaaatcaccttggtggcagtgaaggaaagataaagaggggggtagggggcccagagaccatttgggggctatagcacagcccaggcaaaaatgtcaagagcttaagcagggaggtggccaagagggagagccactgtgaacacagaatccgacaggcttggtgaaggagtgggcagagtcagacagggtttcctgctaggtggctgggaagatgacagtggtgatgctcttacagaatcaggaccctgggaagaggaccagcctgggatgggggccttcttcagcttggggcatatggcatggcccagtgcagacccttgtatgtccctcactgctgttccttctcttcagctccaacaagccccatagagcaccctgcaccagtcaggcactcagtgaatacctctgagtaaggaaccacagggaaggaggcgtccagagacctccctgctccaacttcctccattccagacccagcctcttcctctccctccgcactgtggacacccctgaacatctcctcctgtttctgaatctttagggaaaaaatgtcccaactctgtctctcagcactgcctcctttctctgccccaacccactgaatgtgtgactcattcccacgcttacatcctaaagccctgcctggggtgtccctccatgcggggaccgctggagcagagaccatcaccatcataacaccctccaccagccacccagcccctgccatgggaagagcaccatgccaagctcatcaatcaccatcagatcctctcgacaaacacagaggatgggctttctgattcccattttagtgtgtgactcagagaacttagttggcttgctcttgcgcacacagctggttctgtgtaatcatacagcttgaacaggtcccctgccctctgcctgccttccccaccagcacctctacaatggccatgcagatcttcaggacacaaacagaaagcaggggctacctgagactggaacatcagggcatctcttgggatcagcaccacctgcagtcattgaatgcagaagggccttctaatcctgggacctgtccagacccccaaggattctgatgtaattggtctggggtgcaaccccaaaagcaggacttttaaaagctcctccaggtaattctcatgaggttgaaaaatgattgttctaatgggtcctaccctgaaagcatccctgccgacacctgccccccaccacagtcaccgtggacctgctctgctgcctccgtactgagcttctcatgctggatgcagccgggccatggcacaggtcctcacagccaccggcctcccaggagaagcggaagccgatctcgctctggctcccctccactctggctcccttttctgactccagatacttctctccatccaccttcccaggtttccagagccttcttatggtccaaagctccccctctccacaaggggaacactctagctgcccttctggagaggactgaagaccccaagttgactccctggtccttgtgccccctggggggccactgagagccgggcagggaggctggctggtgtcagcaggaaggagggtggtgggccaggtggcagagtggccagaaaggaggcagccttcaaatgctggttccgccacctcctcccactgggctgtttcccctatgtcacagtgagagagctgcacaggaccccagccccaccctgcagaggggccagagttgctttcttatgcctggagaccctaaacaaccgtggaacgatcaggcttccctgctccaggctgggaccagcctctgtcctgatggccagaagctctgatgagcaggtatagacagcagacagtttccttattcagcaataaggacagtgtgcttggtggataaatgccttaaacacggaagagttcacgggaatcaaaacaatgaaagaggcttggcaaataacttcaaaccagtgagatgggtccccctctgtggggactcccaggcctggcctgaagatttgagtgtataggaaggcatgaggtcccccaactctcccattgcaagagaggtgcttgttacctttcgcgatccccttgccccctctctggtgcccactttctcactctgcatccctcaactcccacctctgccccagctgccctggtgatgtgcggggtgggggaacaaaaaacacaggctgtgcaagcagacaccgggggtcaaatctcctggctctagctgactacagctaacctctctgagcttccagtttctcatctgtaaaatgacgatcatccccagcatagagtggtgctggaggattaagtaatgagataatatctgtaaagcactgtgcttagtgatggagatcagtaaatgtggttccatcccacggctgtcctgcctcatctcccccatcatctcaaaacaggtacagcttccatcctaaagcattaagatgcttcctgcaaaaagatctcaagaaagaccagccgcggtggctcacgcctgtaatcccagcactttgggaggccgaggtgggtggatcacctgaggtcaggagttcaagaccagcctggccacaatggtgaaaccctgtctctactaaaaatgcaaaaattagctgggagtggtggtggacacctgttatcccagctacttgtgagctgaagtaggagaattgcttgaacctgggaggcacaggttgcagcaagccgagatcaagccacagcactctagcccaggcgacacagactccatctcaaaaaaaaaaaaaaaaaaaaaaaaactcaagacagcagaggagagacgctgcaacatgaggactccagccacaatcagtcgtcagctgagcttttgcatcaaagcctgtctgcgaggcaggggtgtgcactggagccgctccactcacgtggacgggggctcagagacccggaaacagcattatgccccataataggggatcagtgatgtttgcataaaagagaaccaggtacaagcctgagaaggatggcttatgtggatattagttactgacatgaacctttgtcatcatacactgataagtgaaaaacagtatcacggtatacgttcaaagtggtgcatatgctagaataacattttctggagaaaatctcaaacctaattctatcgatccctcaaaatatgaaaggctgcatgccaaaggattaatagtgattccttctaggttgcaggaatgtggctactgtttgccaacatttttcttttttttgttgctataaatgttaattacttgtatcatcgctttaaaacataggccggtgcggtggctcatgcctgtaatcccagcacttacagtggatcatttgaggtcaggagtttgagaccagcgtggccgacatggtgaaaacccatctctactaacatataaaaatgagccaggcatggtggtgggtgcctgtaatctcagctacttgggaggctgagggaggagaatcacttgaacttgggaggcagaggttgcagtgagctgagatcgcactactgcactccagcctgggcaacagagcgagactccttctcaaaattaattaattaattaattaaaaaggaaaaatataataaggacacactccatggcttctgcagtctcttctgagctgatagtcaaggtcctggcatggcttggctctcctccagtgctgggttaggggctctgtgacccagtgccccaccctagcctggcctaactatatcctttgctgaccttgaaccccacacagatcctggcaaagctgcatggctccatgaatacatgtatgtacatgtaggagcttttcatgcactttctcacttaaactttccaaccacctagagagctcagctagagtacctcactttacagatgaagaaacaggccttggaaggtgaagcgactttctctgatgactggaaagtgtggagggaagtcctgcaccccgacctgcctgtatcaaagacttgtctctcacgcctcaagctctgtggttctgtgcacacctcaccaggcccccactcacccatctaacatgtgtttgttctgtgtgcatgtttttcttctgtgttctgggccacacctgttgggcacctctccctccccggcaagggggaagctttaggaagtagagagaaaggcagggcacagggcctggctctgaggaagggtcacacttacagccaggcctggggctggtggggtaggcagagggcacagggcacgtgggggagaggggggaccttcccaagacagggaactgtctcaaccataatcaccctcagtgttgctgcttccccgctttatgttctatagagacacccggaggggacagcctgctgtggtgggcactgtgctgggcccaggctgtgtgctgacagaaccctggggctgggctggggcaggaggcgagaccctggcttcctgctttgcttctcccgccacccgcttcttcctcctctcttcccttctccttccatcccatcttctccctgctgtcctttcatatgcttcctcttcccccttctttctcctcctcctcctctcccttcttcatttctagtccagctatagtgggaagaagtccctgcaaggagctctggctcttggccaagagggaaggagaacctgggacaggaaaggattcccagcaaagggttgcacactgggcaccccgagcccttgctgaacctcagctttggagcacaaggtggaattcaggtttgtcagcctccccagctcagcagggaaccagcagtctgcacaatgtgaccgttggtgacggatgttggcctctgcccatctggctgcattgctgtcaacatacaggttccatgtcccgggctttctgcccaggcactcccctgcaaagtgagccccaggagaaacccgggtttacagctgctctgtagccccaaaccctgtaccccactggctgacgctggctacccaaaaagaaattattgaggcacagaggatggcagcactcaatctcccgtgtggacgagcgtctctgcagtcatattattagcatctcgagggcagagcctgagttgccttcacctctgcaacttccttagcacccagcattaggagagcgacataagacacacctaaaaaatactggcactgacatgcaaacctaggtcttgtacgtcaagtttattaggagtgtaaaacttcttgtagtattccctctaacttagccaggtgggaaagtgtcaaataaaaaggacttcagtgggatttctgagtagcatccttggaatctgcactcaagggatgctactcggaaatcccactgaagtccttttaattaaatgtgtgtgcatgtgtgcaacccacatgtgtacacgtataccttgcccccaaaactggaatgccggatgagggccatttctgctgtacccactgcctctgccactcattagctgagtgtgaccttgagcccattatctaaccacacaaccagatgacaatctcatatgacagctggcttgctcactctcactctgctgctgcttttttctttttcttttcttttttcttttttgccatatagatgggggtcccactgtgttgcccaggctggtctcgaactcgtgggctcaagtgattcgcccaccttagcctcccaaattactgggattacagggatgagccaccacacctagcctctgttgcttcgttgttgaaaattgttgagatctagcgttccccatgggttaaactctccttatccatggactggagtgcacttatcatgggatctcaagtctaagtaatagaactatgactgcaagggtgagcaggcgctgcctcagaacaccccgcaatgctgtcatctcagaggctgggacacctgccccgtctgccgagctggggtttgctgtcctggacaccccgtgtatctgctgtgatctttattgacaagaaagaatcttgctttcttgacaagaatctgcactcaagagatactactcggaaatcccacttaagtcctttttattaaatgtgtgtgcatgcgtgcgacacatgtgtacacgtatacctttcccccaaactggaatgctggatgggggccatttctgctgtacccgccacctcgcatgctccattctttgcctctgaagccacccccaaagctcaaggcttctttccatctactactgagttggggtctggggagggcgacccccagcagccacagccgtgcacccctctatgtgaacttggcttagacaagtaagtaagaaagtaagtggatgtggtgatgtaagccctccctacttcccccgttctaggggacatcttgctggtgaaggcacagctgaccccagaagtactatccccgactcagaggacaggatgtgggggatttgacctaggccctgagacgcatggaaccagctacctggggagcaaagcaagtgccagggtttctggggcgctggccagggccagacgctaggtctgccatccgttgctcacccagtgcctggcacagtgcctagcccacaggagatttacaatagacaccggtggaatgaatgagcttggacaagatcagtaaacagaatcttaatttcctctcctataaacaggaaattagaggagcatctgctcctcttaccaatgtgttgtggggagcaaaggaggtcatctccgccgggcgcggtggctcacgcctgtaatcccagcactttgggaggccgaggcgggtggatcacaaggtcaggagatcgagagcatcctggctaacacggtgaaaccccgtctctactaaaaatacaaaaaattagctgggcgtggtggcgggcgcctgtagtcccagctactcgggaggctgaggcaggaggatggcgtgaacccgggaggcagagcttgcagtgagcccagatcgcaccactgcactccagcctgggggacagagcaagactctctctcaaaaaaaaaaaaaaaaggtcatctcaagtgaaactgatttgaatcccagctctgcccctttctagctgcgctacctcaggcaacctcttggagcctcagtttcctcatctgtacaatgggaggagctacaaaaccttcttcgagggagtggaagctcagtgtttggcatattaggcattcgctactattttcgtcatgcttatgaaagtactctgaaaactgcaaatgcttttcaaatatgaattactattttcttttttttttttttttttttttttttatgtccagggaatccatttcagagaaccaaatgtactttagggaaagagttcatacgataaacaaaactaacaataaccctcattgtccttattgagcgtctattaaatgccaggcattgtgccggcttcttcaaacacatcatgtcgtgaaagctatgggtcccctatcgctcctattttgtaggtgaggaaaccgaggcacagagaggttgagctacttctccaaagttacagaactaggaagcagggcagccaggattttgaagaccaggatcccaggccttctctcttgtgaacccaaggccctctgagatttatcggtgcatcctgggaagagctctcaatggacagcagttgtgggtgagtggggctttctagaaccatcctccactcggatggctcaggattctgctctgtctggctctgccctggagcactgttcctcattcactcttaccttatgtaactcagtgttcccgccccctgccccaaggattatataaggcagcccagtaaacaccctgcaggcctcaggactcctggggagaactaagacggtctacaaatgtgacctcttgccctcaccccttctcaggaccccactcttgctggctgtcttcctcctgaggcacaaggctgcctgtgcctgtgtgtgtgcctgcttgtgtgagcatacactcacaccatgtgcccacgtgtgcagacttgtacaccacaggggacccaaacacacgttagtacacacgcgtcttcactatttttttaaacagtgggagaatcctgcaaagtgtccccactaaggctttccttttcagcaaattcagaacagttaactttgctttgacaaggaactatgaaagaaagaaagaagaaagataaaggaaggaaggaaagaaaatgataaaagttgttgttgttgttgttgttttggagacggagtctagcactgtcgcccaggctggagtgcagtagcgtaatctcggctcactgcaagctccgcctcccgggttcacgccattctcctgcctcagcctcccaagtagctgcgactacaggtgctcatcaccacgcccggctaattttttgtatttttagtagagaccgggtttcactgtgttagccaggatggtctcgatctcctgatctcgtgatctgcccgcctcggcctcccaaagtgctgggattacaggcgtgagccaccacgcctggcgataaaagtttttaaaaaagaaatttggctgggcgcagtggctgacacatgtaatcccagcactttgggaggccgaggcgggtggatcacctgaggtcaggagttcgacaccagcctggccaacatggtgaaacccggtctctactaaaaataataaataaataaataaataattagccaggcatggtggcgcgcgcccataatcccagctattccggaggctgaggcaggagaatcgcttgaacctgggaggcaggggtttcagcgagccaagattgcgccactgcactccagcctgggcgacagagtgagattccatctcaaacaaacaaacaaaaaaccaaaaaaacaaatttaactcttgactcgttctcttctcgccccagtcacatttagtagcagacctattttattagaggagagttctcgcagtgttcgccctaacttggcccggtggaaaagcgtgtaagcctgtgttctttctgaaaccattttctggtcatttgggattttacgcaaatgcctgtagctgtctgagctgcattccccaaaccactgagggcagcccagactccagataactgcaccacctacatgacgaagccacttatccaggttgcctgagtcactgaaggctgctgtccccagatcaggctggacttcctgcaagtcacaccaaaccatcaacagaacattctccacattcggggtttttcccccagagacactttacaaggagtgtcagttcctcccctcactggcctggcctgaattctcccaggtctgagattgggacgaccagggttgggggatggggcacatcctgatcatgataattctgaccacacaggagcacttgggagccaggacgactctggatccttcatagccagggaccatctgtgccttcgagaaactcccccaccccacctgtgccaagcctctccctaatgaaactagtgccaaatacacgggatcgcattcccttcgcttctcttagctaaaagcagctaagacttcagtcaccttcctcgttattcttcactcccacccacagcaaaagagagaagaaagggagaaatccagtctctccccgaccaagtcttccaagaaccgcttgagcggggttggcactaggactaagtgtagtgggggatacataggccagaaagcccagccttctctcctccagtgtccccaggtccccctgtccccaacttccagaaagcagagctgtcctctcgctgtccgctagggagtagccagttcttgctgctccacactgctgcaagggaagttagcacctgcaggaggcgtgggtttctgggcagctggggcatcctgtaatgggaggctccaagtcccctgcaggcaactgcgtttggaggccattttctccattgtataataaacatcctgggacttcctcaccacaaagccgccaacccccacccctatgggatgcaacaagggggtttcttccgtctactcatctgtccgctataagggtagggacaaagcaagcccttagaaggggctttggccttataattaaacttttaactagatctagttttcccctctgccaaattgaattttccttgttcacattttcttcgttttggacacagctgactgattttgtttcatctcatattagactcatatatccagtgatttaattaatctcaccagctgtctggctgtcccacaggacctgccttctccgctgttggcgttagaaaacgattccctttgcctttcctcgctctggcctccgcgtggagccccaggatccttgacctgacctgtgggctccccagccaggcgtccacgcaggggctagatgtctcccacggggctcaaagtgtccgccaggagggtacatgccctccgccccgcaacacacacacacacctcacaggcgcgggtgggaagctgcctgaagccctacggctgcagttttattacaagatttctttccaaacgcaagatcaggccaacaagctcagcgactctgacgcttcacatcttcacccactcgcaccgtgttccgaacccacccgcaccaacgtacacacaaaactcccacgcgagcgaccgcagtcccaaattgcatctccatacccactcccaccctgccccgaacgtcttaaaaaacaaacaaacaaaaaaaactggtaagaaccctcaccccacattctcccaccccgcaacgctgcagcgcacacaggacagagccgggcgtccaagtcccttcccgcgcccccgccgacagtctcgccgcgtccccgcccgggcgccccaggcacgtagctgcccgcccggaggcggcggcagagcgcagagagcggggcgagggtccgggtctccggggtccttcttgcagcagcgctggcgagggcggacccagatggcgctcagtacagccccaggatggctgcgcccacgtccttggagggccggcgctcctgcaccagaaagttgatcatgctctcggacttgatgagcaggttgcagcccaggaagaagacgccgaagaccacggtaagcgacagcacgcagagcacggcgatctgcgccacccgcgacacccacaggctgcgctcgtcgggcgccagccccgcggggaccccgtcgctggcggccagcggtgcgccccctggacagcagcccagccacgtgcccagcccgtgggtgcggtttcccagggcggccccggcgccgccgcccacgccgtccacctcctccaagccgctgtggttcaggaaggtcgcgttcatcgccgcgcggcgccgggggtctcggcgcgcagtcccgggtgcactgggctgctcgccggggtccgcgctctcagggacgctccggacccctcggaccggctcctgcggtacggggaggggacgaaggcgggaggctggctgcctgcgcgctctcgggccgcctacccctgggcaccgggcgggaagcgaccgcccggaggagcgagcaacaggcggcgcaggagctggagccggagaacctagtgtgcttagcggtcgcccgctgggttcctcgcgcgcctggccgcccctcccctagcaacggcccggccccgccccgccggtccccgcggcatctccgaggggcgggaatcccgccgcgggcgcagcctccccggagtcccggtgctggagggggtcgggagatccggcagcctctgtccgcgggccggcgaaactccaccccctcctggcacccgctgtccgttcttggctagaaaacctctccaaggtgcccattccaggatttgatacccttagcagtgaagttattccggaatctgccctgactctcttcgcttattatttaagccctcgtaagccttgctagacatcagatgagtcgccgggacccctggcgctgcccactccactggccccgggtctcctgggcggtcctgcctcacagctttcccggggtgaaagctgtcgcggcgaggcgggctctctgcctccttccctacaccctcctctcaacttggtcccatttaactttttttttaaattaaaaaataaattactgtttttttctttcttttttacacaaacatagtcattgtagactagtttagaaaacatgaattaccgaaattactctaaaactttataatctgcctcctagagagtgtcgatgttatcacctgggtataaactcctcccagactttttctatttgtgcctttctctagataacagatatggggatgcaccgttcctgcttactgcctcccaacctttcctcacttaacagcgtaactttccctagcgatggtcctctacagctatggctctgaattgccttggagggtttattaaaacccagattgcttccacctcccgcccccaacctccccaccccaaccaaccccaagagtttctgaatcagatgtgggatggggccccagaatgtgcatttctaacagttcccacgtgatgcacaaactactgagctacaacatcatttttagtgaaggaatggcattttaaggtatggactactacagtttatttaaccaagcttcctgctggatgtctgagtttttctttccttcttcttccttctccctttccttctctccttccttccttcttctttctttctcttcttctttctcttctttctttctcttctttcttctttctttctttctgtcttcttttttctttcatcagaaacaatattaccataaggagccttgtaacaaagtatttgtgccaaaactgatttttctttagattgtattttgaaaaatggacctgtagaatcaaaaagtaggccgggcgcggtggctcacgcctgtaatcccagcactttgagaggccgaggcgggtggatcacgaggtcaggagatcgagaccatcctggctaacaccgtgaaaccctgtctctactaaaaatacaaaaaaaaaaaaaaaaattagccgggcgtggtggcgggcgcctgtagtcccagctactcaggaggctgaggcaggagaatggcgtgaacccgggaggtgaagcttgcagtgagccgagatcacgccactgcactccagcctgggtgacagagcgagactccgtctcaaaaaaaataaaataaaataaaataaaaaaagaaaaaaagaatcaaaaagtacttcctactaaattgctttccagaaatataccagtgtacaatcatgccctgtggggaaagggggctccccacccccaacattgttatcattattttaaaagtctttgcctgagtagcgaaggggggtgggggcaggggtggtttctcacccgtatgttaatttgcatgctttgattgttgcaggagagtaaagaaagcactttgttattgcaataatgcaggcaaaagatgctgcctggagacttgaattccagtggtgacagtgaagtgggagacaaggggatggaaagggcatggcaaattggagtgaagggattcgggatgccccaacacacaggcatcacagagcctctgctccctgttatggtttgaatatgtctccccaagttcatctgttgaaaacttgacccccaatgtggaggtgttgggaggtggggtgagatgctgccattgtttgggtcaggggcaccaccctcatgaatagattagtgccattgtctcaggagtgggttctttataaaaggatgagttccacccctctttctctttctctctcttctctttctggcatgtgatgtcttctgccatgttttaatgcagaaagaaggcactcaccagatagatgctggccactcgatcttggacttcccagctcctagactgtgagaaattaatttctatttataaattgccctctttataacaagcatcctgttatagcagcataaagcagactaagacacccatacccatcctgatactcattattagaacattaagcatgtgtgtatatcctggtaagttattaaaattattattttatttatttatttttattttgagacaggatctcgctctgttgcccaggctggagtgcagtggtgcaatcacaactcactacagccctgatcacctggctcaagtgatccccttacctcaactttctgagtagctgagcccacaggcatgtgccaccataattttttattttattttttgttcagacagggtctcactatgttgcccaggatggtctcgaactcctgggctcagatgatctaccacctcagtctcccaaagtgttgggattacaggtgtgagccactgtgcctggcaaaattatcactttaaagatgaagaaactgaggcacacataggcaccccagattgggaaacaacctggctcaagctcctcagtcctgggaaagctggcctggcgcaaaggcatgcagttttcagggcaagagtctcccctgccctgatcaccccttggagccaggatagaacagggagtccagcaggtgtctggcccgaacattctgtcctctgctttggcccaattggatttctgtagagaaatgctcagttatatcctttgtctgaaaccaacccctggcttttgctataccctggacttggagtccgtaccttgattgcatccagctgaagtcagactgcctgatgtaaaggaaaggggtggggtgagtgaggatgcagaatggggccctgcccactccagcgagttgtgaggaggctgacatgatggctgacctttcctttattaagcatctattacatgcccagtgcattaaatacattacctccctgaattctctcacaccagcctttgggttctgctggactgtccccttgacatgaggaaacagcggcactgactgtttaattgacttacttaagatcacgcagctagttaagcatcagagccagaatttcagcccagatctgtcctgttccaaagccacgctcttcattatccccgtccccctctctcccatcatccctgggggaggtgctggggagggaaaaagacatctttgacctgggagcaggaagggggagagagaccttgggcttgtggatgtaaacaaagaccactcaaatgagagcaagcaaaggctgtttattcagagcttgttacagtaagggaggcagccactgtcacttgcttttcatggagactcaaaggcaggccgaggggaaggctttatagcggaaaaaggagaaggcttcaggtacgtcctgttggtggtgcaggaaagctacagttgggctcattagaagaggggcatcctaagtaattggttaggggagcatatttggctttctccggtttgtcctgcattgaaagtgggaacaaaattagggaagctgtcagttaccatcaagtcctggccatttggggctgattgctgcaggggttgttcgttggcttcctgggctggtgctgtaggtttgggggcagagttctattttaatatgtggtctggccattgtctatttgcatatttggtctcccagaaccatccacgtcaggagcaggaccccatctggcctggacctagctaaccactcctccttctgtggtttctgtctgccctttcttctttttttttttttttttttttttttgagacggagtctcgctatgtcacccaggctggagtgcggtggcatgatctctgctcacttcagcctccagctctcaggttcaagtgaggcctgcctcagcctcccgagtagctgggattacaggtgtccgccaccatgcctggctaatttttgtatttttagtagacacagggtttcaccatgttggccagctggtctcgaactcctgacctcagatgatccacctgcctcggcctcccaaagtattgggattacaggcatgagccactgcacccggccctgtctgccctttcttgagcctctggtcccagcaagtttggttgtagtttgatgtgtattaactcttaattctcataataaccctgaaaggtaagtgtgtttgttatttattgctacatcacaaatatctcaaattgagcaaacatttatgatctcatgtgatttctgagggccaggaacctataagcagcttaggtgggtggctctggctcaaggtctctcatgaggttgccgtcaggatgttggccaggactgcagtcatgtaaaagcctgaccagggaggggccattggcttccaaggtgaccccttacacggctgttggcaggaggcctgttcctcattggctgtcggcagggggatcctctgttcctcgccatcggacctctccatggtgctgcttgagtgtcctcatgacatggcggctggcttgcctcagagtaactcttgaagaatgtgctagaaggtgagcacctggctggaagggagagggacagaagagtgaggatacagagtgaaacacatcagttcttattgttatttaatcttcacagcaagacttgtagaaagaaacaagttgacagatgagaaaatagaggcctggaaaggaaaaggatcttgtcccaggtcacagagctggtaatagcacagccaggatttaaatccttagttaccctacaactaagctcaaagtctttccagcacttggcatatgtgtatgtgttgggggtggggttgggggtgggagtgcttcgttgttggggaaagactcccccgagccgggcttagaggggctcaggagcctaagggtgagtctgtcaactggctgcctccccctgctctagagaaaaggaagccagtgcctctgggccaagccaccacccacatgggactatttttaccctccacctcagggacaagtctgcatttcccagctctggaagggccatctgggcagtccggctgccccaggaagagctgccacccggagctttatgccctgctgtctctgcagctgtttctagatgaacctttagccctctggcatgcctgagccatccagagtcagtaagaagtccccctcctccagatctcaaggttaataaaagctcctaattagtatcacttgctggatggacccgccagaaggaaaatgcttaaatctgcagagattttaaattgttcacgtttgtcaataagtgttctttgtatgagccattttaatgaagagataagaatgattttatttgcatattcaactgtaaaccacccagacaccttcagaaacaagtaaatagatgaccactatatgagagtgtacttcagggaggcccaagagcctttggacatcatttattttctgaagtggttttaaacaacccccctaggacccggtttacactcttcatttgtttggcacgcttttcctggaatgggcaaaggtagcctgctgcctgtttgcccagttcctgtccaaatgatctcacgtttcaaattggcagagggaaagttaatgacattttactgcatctggtacggaattgaaataaacatggattgccctgttcagcctttgacccctaagagacttcgaggttggcccctgctcagtttacctacagaggttgaaggcagagggaagtacccaggcagttcaggccaaccatgcctgtaatcccagcactttgggaggctgaggcaggtggatcatgaggtcactagttcgagaccagcctgaccaacatggtgaaaccctgtctctactaaaatatacaaaaattagctgggcgtggtggtgcacgcctgtaatcccagctactcaggaggctgaggcaagagaattgcttgaacctgggaggcggaggttgcagtgagccaagatcgcaccattgcactccagcctgggagacaaagtgagattccatctcaaaaaaaaaaaaaaaagaaaatttaaagaaatgccttgcaggttgggtgtctatgcagtagcagacagggagcagtgcctggctaagttctacacagtggagaatgagacaggcatcccaggtgacatggagctcacaacccaacagaatacctggattttggacatctgtgatctacttctgcctctgcccctaattgactgtgtgacattggacaagtgaaccatcctctctgggcttccattggctcattcattaactatgggagcttaatcagaataccttcaataaagctttatttacaagaacaggtagtgggccagatgggccctcctctgtcttcttctgctctatgcttcttgtgggcttgaagacagtgaggagccaaaggtctgtacctcgtctaccccaaaagtactgcctgggcctctggtaccctaatctgtaaaatgagaaagttggttaatacctacgttctccaaactgtgctctttggataaatagttctgcgaggtctgcaacagagtagacattgacctaaacagatttcattgctataggacttctcaggacctttagtatgtggatgtacattgtgaatttccctgggggtggggcaagggggggatgcgggattcagcatttatcaatggaatccttttttgccaacaccgactaatattttgtgccactatgtaccatttagcacagtttaggaagtgccccgaagcctccccaagcctaagtttccttccctatagaccagggatgatgatgatggtaactgcctcctagaattgttgggaaggttaaatgaggtaatgcctggaaacgggcctggcgcagtgcctggcacagagtaagtgctcaataaatgctagtaactattatttataataaggtccttcctttacagctctgacattctgcgcttccaactgtagggtgtaattaagctctaaagcatctggcttcccgagtagaaaaaacaagcctggaggaaggaaaaaggaagagaaagctccttatgggttgcccatttgttcacaagcttcactgccagccgtcacaacaagggaatgtagcaagatgccaactcctaatgacggagcttgggtgggttggtggttccctatttagcttagacactgtggggactatctgagaccgcggagaagtgagaggtaaaaccagtgctgcttatggtcaatcagtgaaacctaactgcatcctatgtgcgtcttccttttccttctgtcctggacacagtgatcctggccactttcaggtatgtgtgacctgctggggggaacagtcacaaggagagctgagtcagagaaggtaagtgggacagatcagactggaagggcaggaagggcagtcccacagaggaatagcatgtgcagtggctcagaggctggcggagtgcataactatagttgcaggccagggggggtggctcacacctgtaatcccagcactttgggaggccgaggtgggcggatcatttgaggtcaggggttcaagaccagcctggctgacacggtggcccgtctctactaaaaatacaaaaattagccaagcgtggtggtgcatgcctataatcccagctactcaggaggctgaggaaggaaaatcgcttgaactcgggaggcggaggttgcagtgagccaatatggtgccactgcactccagcctgggcaacagagtgagactccatctcaaaaataacaataataataataataactgtagctgcaggggaacaggcatggggaggcggtgaggaagaacatcagaagagatggctaaagaggcatgtgggcgccaggacgctcaggacttcatccaaaacacaggggagacacacgatcagcctggcatttacatttccccagattaaaaataaaacaactcttttttcgcattaaaaaatttgacaatagagtttacaataagaaaaaaattatattttttgaaaaagaaaggaaaatggtgaagactcttgcaaccatatggaggacagagtgcactggctctaggaggccggtttgggggctactgcaatagacaaggcaaaaggccccgatgagtgaccccactctaagtatatacccaaagaactgaaaactggcactccagcaaatatacacacatgcatgtttatagcagcactattcacaacagccaaaaggtagaaacagcccagctatttatcactagatgaagggataagcaaaatgtggtttatccatacaatggaatattattcataggaaggagtgaagtatgtgtgcatgctataaaccttatagcatatacttacacatactttaataatgtggatgaacttcagaaacattacgttaagtccgggtgctgtggctcatgcctgtaatcccagcactttgggaggctgaggcaggcagatcacctgaggtcaggagtttgggaccagcctggccaacacagggaaaccgtgtctctactaaaaatacaaaaattagccaggcatggtggcacacgcctatagtcccagctactcgggaggctgaggtaggacaatcgcttgaacttgggaggtggatgttgcagtgagccgagattgcatcactgcactccagcctgggcaactagagcaagactgtctcaaaaaacaaacaaacaaacaaacaaatgcattatgttaagtgcaagaagccagactcaaaaaataacatatactgtatgattccatttgtatgaaatacccagaaaaggtaaatccaaagagagaaccaagattggtggttgctggggctggggagagaggtgagttggggagcaactgcttgatgggtacaaggtttccttttggagtgctgaaatgttttggaagtggtgatggacattgtgaatgcacaaattgccaaaattgccaagacattgttcactttcaaactgttaattttatgttatgtgtatttcatgtcatttttttaaaaaggcaatgatgcaggtgaacaaaggcagggaaagaggagatggaaagtgggaggggattctggagcctgtgaatctgaggaatggttcccagatttctggccttcactgggagtgaacaagtgggcggagtggtcaggccaaggtggagttgaggggctcagggttgaacatgatgagtctgaggtgaccgtgggatgtgcacgtgacagtgtcaggcagacagttggaggcatggccggggaacttaggcaccctggggctggagataaaggtttagaagtcatcagcttgttcacccattcactgaacacgtactgagcatcttctgtgtccagctaagtgctagggaatcacagtgaaagccagtccctgccttcaaggagctcagtctggagaggaagacaagtaaagaaactagataatgataaacggtgagaaggtgcgaatagaggaagacataacatgtggggggcacccagaggggacactgtggacgcaggtcaacagaacacaggaaatgagtgtttcactctgtccctcagcagtttagcaatgccaacccctgctcgagcataggaaatcattttcagactctgctagcatagccaaggactccatgcagattctgcaaggtggaggacttttgagtaggcatgctagtcagatgcctttccggtgaaggacagaacgtgttgtagggactcctgtcacctgcttcagggtctgtgaaggcaggaaatagaaacatattcaggtcaggacaactgctggggactacccccttcgaacagatcccacggcgggacacaagcacaaggcaggttggctctggctaagttgtgctcagaattgtaaagacatcttgccccttgttttgtctgctctaaacatcatctgctttcttttgaggaatcgctcttccccatcccaaccagttaaggtgggacctgccaattaggcttcccctgccccccagatataaggggatgcatgattgaggctgagccaatcttagtactcttctgcctgaccttgatgattagctcagggacagggatgtgacccacgacaggctggttggtggccaccagggtccctgaccccaggtatcatacccttgtatcgtcactcccacagtgatgctgggcttggctatgtgattggctttggccagtgggacaactgaaagcgtaatgtaagcagaggcttggtgagcgcttgcacaatggggctggtcctcttcaaacactcacttttgggacccagctgccatgccaagaagcccaagctggctatttagagacagcgtgtgaacagggcaagtttctagctttcagccatcctcgccacggtgcctgacatttagggaaactattttgggcactcctgtcccatgaatgacagagcgagaccagcagagctctgcagctgagcccaaaaccccacagaatcatgagaaataattaaatggttattgttaagccattccgttttggggttgttacaccataaggaataattaaaagataagccaaagtgggccaatctgaaatcttccctgagaatttctacacggaggtggtggaaaagagctctgttctgtccagtgacaaggctatagggacgcaggcctattatattcctctccacagtggaaagatagagaaaacctatctgcggcagaaagggtgaagtcccagacacagaagagtcaaaacaatagtgaaagaaagccccaacttttagaaccctggacgctcctgtagtctggtgacataaggtattaaattaaatccccctttatggcttcagctacctcaagataactttttatcagttacacaaagggtcctatgtaattcacctgataacatatcataaagatctttgccaatgtccttaagtcaagaataaagtgatcacactattgatgttgttgaaagctttgttgagcatgtacaatgtgagaatcttgaaggatcttcccccagtcgttgtaaggggtaagacaagggaaggacatggttcacaccacaccaggaaccagtgtccagggcattcacctgtcaaggccagctggatgcaggaaggtgttcacactcatttgagtattagaaacacgtttatttctctctttctgtaggacaatttgacaacacacacaaaatgctttttttttttcttaagatagagtcttgttatgtcgcccaggctagagtgcagtggcacgatctcggctcactgcaacctccacctcctggattcaagcaattctcatgcctcagcctcccaagaagctgagattacaggcatgcaccaccacacccagctaattttcatatatttggtagagacagggtttcaccatgttgtccaggctgatcttgaactcttggcctcaagcaatcctcccgccttggcctcccaaagtattgggattacaggtgtgagccaccacacctggccacagactgcttttaaaaggttcaggccctttgctccagcaattccacttccaggaatttatcccattgcaatggttttcaaattatgttcctggtggaaccgtggggttctacagaggtgctttgctagttctgcaaaactttgatttgaatgtcactggtactgaggctgatttaaaactatagtcatcatcttctgagatgtcatcttgagatgatgtctaactggtctagaagacccctaactggtcttctaaatactgcatatttgaatttataaaatatgccaacagaatgacttcttatctgttgcttacatgagccttattaagtttcatttaaagaagggtcctacttctaaaaagaaacagtataggccaggcacggtggttcacgcctgtaatcccaggactttgggaggccgaggtgggtggatcacctgaggtcaagagttcgagaccagcctggccaacatggtgaaaccccatctctatcaaaaatacaaaaaattagccgggtgtggtggtgcacccctgtaatcccagctactcaggacgctgaggcaggagaattgcttgaacccagtgggctgagattgcaccattgcactccagcttgggcaacaagagcaaaactccatctcaaaaaaataaaataaaataaaataaaataaaataaataaacagtataaaaccactgtcacaagaaaatgatcatttcatcctagaaggtttagcttcatgaagatgtactacacaatgtttatacagagttggttcagtgaaccgtggctcacaggctggatctggccaccacctgtttttctaaataaagtctgattgaaacacagctatgtgcattcatgtacacatgatctgtggctgcttttttgccataatggcagaattcagcagttgtaacagagaacttgtgacctgcaaaggccaaaacaaataccacctagctctttacagaaaaaagtttgctacttcctggtttataatgatataaaaattggaaccaagctaaatgtccaagaaagtggattgatcaaattacaacacataccttgcaaatggaatgcaaggcccttgttgaaaaataatgctggctgggcatggtggctcatgcctgtaatcccagcactttgggaggctgaggcgagtggatcacctgaagtcaggggtttgagaccagcctggccaacatggcaaaaaccccatctctactaaataaataaataaataaattagccaggtgtagtggtacacacctgtaatcccagctatgtgggaagccgaggcaggagaatcacttgaacccgggaagtggaggttgcagtgagccgagactgtgccactgcactccagcctgggcaacagagcaagactccgtctcgggaaaaaaaaatgttttagttcagcagctgttaggtttggctgcgtactgaaactatctggggggtttttaaaaattccaaagctcaggccactccagatgaattaaatttgactctaggggtggaacccaggcattgatatttttaaagcttccccaggggttctaatgcagtgccactgttgtagaagaatatttaatgaggccaggtgcggtggctcatgcctattatcctagcactttgggaggccgagctgggaggatcacctgaggtcaggagtttgagaccagcctggccaacatggtaaaaccccgtttatactaaaaatacaaaaattagccaggcattgtggtgggcacctgtaatctcagctacttaggaggctgaggcaggagaatcgtttgaacctgggagatagagtttgcagtgagctgaaattgtgccattgcactccagcctgggagacaagagtgaaactccatctcaaaaaaaaaaaaaaaaaaaaaaaagaatatgtagtgacacagaaagatggccactatatattattaactgaagacaaagaagattttctaacaatgtgtagcatgtgactcctttctggtaagtttctatacacacatgcaaacagactcacatgtatgaaaatatatgcccaaactgacagtggccatctctgtaggctgggactaggagagattttgattttttttttttttttgcttatctgtattttttagatgttctacaatgaacatggtatcttataataaatgcaaaaaataaagttgtcaatagcttaaaaagccatgtactttttgttttaggcaaaactacaaagaggagcatctaatcaaacaacacatccccaggtcactcatgtgtgcagcatgccttcaggcatgcatcccaacagaggcagatcccaggctcatgggacaacaggttttccttggtgaggaagtcaggcactgcagcctccaagcctcaggctcctcaactgttaaaaagggatcagtctgcctacccccaggatttaaggcaggcatgcatagtgtctggcacataggaggtgctcaacaaaagttgcttatttctccataagcagcttttagcgtcacagcctgcagccaatcagcttcttgctgttcttgccaaaggaggattggctttgccaaagctgggcctgcccaagttcatccgcagccactggtctctgatgctgtccaccttggcttggaatctctgttgctcttggaatttttctgtgttccctagaaggactgtgacctctcatcaacacaacctgtatcccctactcccagaatgggttccatctgcgtagagaaagtgagggcttcaagtcttcgtggggctgctcactcttaataaaaacaacagtggctgccatgtatcagaattgccctacatgtgcccgggctgacatcctctatctctcagccccaactctgcaggaatgtgagagtgttcccatttcccagatgaggctcagagagttgaaggaactccttgaaggtcacacagctggtccatggcaggtgccacactgccttcttagctatgttggttccatcttctacttcaaaagacagacattccccagtggattctaatgtgcagccaggtttgagaagcattgttatgaaagtagtggttctcaacattgactataccgtggaatcacctgcactgatttacaaaaatgctggtgggggctgggcgtggtggctcatgcccataatcccgggactttgggaggccgaggtaggtggatcacctgaggtcaggagtttgagaccagcctggccaacatagtgaaaccccgtctctactaaaaatacaataattagccaggtgtggtggggggcgcctgtaatcccagctactcaggaggctgaggcagaagaatcacttgagccccggaggcgaacgttgtagtgagctgagatcatgccattacactccagcctgggcaactacagtgaaactccatctcaaaaaaaaagaaaaatgctggtgggggttgggagttgaagagtggggagggtgggaagaggacaggaagaaaggaatgggggaggcttctgaagttctggataatgttctagttcttgatctgggtgctagctacttgggtgtgtttattttgtgaaaatcattgagctgtacatttatgatttatgtacttttctatatgaatgctagtctacagtaaaattttaaagaaaaaaagaagctgtcatcagccacatcactgcctcctgggaaaaggcagtccgtggccttgacccatattttgaggatgcttttctcagcatcaagcagttgtcggcctctgagtctgtgcctgtccctgccaatgagcagactaaccctactttcttgccattggggcttcttcctgggttaatgctgggttagctacaaaacaaaacaaaaaaaacacaaaagtccaggtacagtggctcattcctgtaatcccagcactttgggaggccaaagtgggtggattgcttgagtccaagagtttgagacccgcctgggcaacatggtgaaacctcgtctctactaaaaatacaaaaaattagccaggcatggtggtgtgcacctgtagtcccagctactggggaggctgaggtgggaaaattgcttgagcctgggaggtagaggttgcagtgagcagagatcaagccactgccctccagtctgggtgacagagtgagactgtccccccactcccccaaacaatacccactgttgctatggttgcaggtactcagacagccaggctaagctggttaagctccacggtccctccctcccacagtgggagtcatatgaccctatgctgtctaagccccaggacctagggcagcaggggtataaatggctacagccgagccccctgggcctgaactgtgagttccctggttgacctctgccttgtgtcataatttgagtcactagaggtatgttctcttgttcttcagctacaggttctgatttttagctaggcttatgaatatgttaaaggaaaacaacatttccaaccctcttttgcagctaggcatggccatgtaactcagttctggccaaaaaagtgtaaataaaacagtctgtgcaattctggggaaaaaaaggagagtactcttctccttcccatactccttcctgatgcctggaatatagcgtggaaaggctgagctccagcagccatattgtaccatggggtagaagtcatgtttgtggttagcagagcaataagacaggagcctagatcccttctccctttgcatcatggagcaccctgttggctctggaatgattccctcaggacagctaaacatgagagagaaactgagcttcaaacttgtttgagccagtgatatttgagggttttcattcttctcaacccaactgaatcctatctgatacagtaggatttgctccttggtcctgagttcccgccttggtcacctgcccagtgtaaggaggaggggcctggcctgctccatcctgcaactggagttctgtcctcggcccacctcagtggctggtccctgctacctgctggaaccccatccatgctgcctccccactcagcaggattctgttccttggctggccccttgccaggatggatggcaggcctcccactctgcttgctttcctggagtgaggtctgctgcttgcctcccactccctgcttcccacttacccctgtgcccttggcttctgccctgggcctgccagagtggctgctctctggatatcccaatgccaccagtatcttccccaggagcagcccattcctgacatacaggaacaacggctccttcattcattgactcatttaagcagatatttaccaagcatctgttatcagcattgagaacaccacaggaaataagatcaggtcgaatggtgggcctagtgcaagcacttacaagtacaggctttagagtgagaacatcaggcccaaccagccaagacactgaaacccatctcaaggaattttcaggagtttcctttaaggatatgcccatgacctgggttatgtgtccaagtctggatgagtcactacacctcccagtcctcagctgtcccatctgcacatggtgaggctgaactgcatgctcttgatgactctgtgcaggtctgacttcctgtgaaggtaggaaagggcccaggggcccctaggcctggttttgccacccatgggctgctgctggatttagggccttaaaacaaccactttattattaatttctttagagacagggtctcactctgttgcccaggctggagtgtagtggtgtgaccataggtcactgcagcctcaaactcctggcctcaagcaagcctcccgctcaggcctcccaaagcgctgggatgacaggcatgagccaccacatccagccctcactttctaattatttattatgattttgtcggttgactggggccagccaattcttctgctggtgacagttccttcagcccctctgacctctggcctaacatggaagtggggataatccatgtacccagaattctcccagaattgatgagataagactccaggtcatggaatagttaacgaggaggagtttctctttagaagtaatccagctaataaatgaagacaggatgatagaattagaatattaccatttctgggccaggcacagtggctcacgtcagtaatcctagcactttgggaggcggaggcagtctgattgcttgagctcaggagttcgagaccagcctgggtaacatggtgaaaccccatctgtactaaaaatacaaaaaattagccaagtgtggtggcacatgtctgtagtctcagctactcaggtggctgaggcacgagaatcgcttgaacccaggaggcggaggttgcagtgagtcaagatcctgccacttcactccagcctaagtgatagagtgagactctgtctccccacctcaccaaaaaaaaagaatatcaccatttctaacccccagtgaagtaactggtctagatatggaatgtcaatagctattaatgtcacaaaaaggaagtcactagacattctgtgccttctgtggaaaaacctaatacctactaagaacaagtcttgccaaaaactcaaaatcttaatctgatcaggcctctagatccaactatccacttataggaaatatagaagacagagaaatgtgtataaatgacatcatggatttgcaataatcaaaatccagaccgtgggtaatatctgcaggatgcatggtagggctggttcaagaataaaggaaggctaggtgtggtggctcacgcctataatcccagcactttggaagacctaggcaggtagatcatttgaggttagaagtttgagaccagcctggcccagatggtgaaaccccatctctatgaaaaatacaaaaatttgccgggcatggtggcaggtgcctgtaatcccagctactcgggaggctgaggcaggagaattgtttgaacccaggaggcagaggttgcagtgagctgagatcgcaccactgcactccagcctgggcaacaagagtgaaactccatctgaaaaaaaaaaaaaaaaagaataaacggaaaaagagaaagatggaagaggaatccatggattaaaagatttaagagacatcaactaatcatattgtgtgcatcttatttggatcttgatttaatcaaaatgttagaaaatgctttctgacataaaacagttggaaatttgaacacttactgaatatataacgatattaaagaataattgttttaagaaacacagagagaaataatgagtgaccaacacttgataaagaagaacccagcagcctatctcttattagagaaggctacggggtatgctgggagtcctaatcccggctcggccgtgagtgtgctgtgtatgtagccttggctgagcccctttccctgcctagaccttggttttcccatttatgaagtgaaggaggggacccaaggggcgtgtttaactctggcctgcttttgctttgtcttgtcacgtgcagccatggatcctttaactcggggcctgtatcaacaccaccatgcgtccacaagagtataaaatgggcagaagagtgcttgatgggcacaagcccagagctgtcggcttctgcagaacccagaacaggaagggtcacctccctgaggcacctgacctggagaaccaactgcataatcccaggtaggccaggtcaaagccaaggggaaggagaaactgctggaggacttccccccacaaaacatgggcacgtgttatctgctcaccaggatgcttcgaccttgttctgatgcctggggacttctggtgagttccctggccatccatcctggtctgttcaccttctcaggactccagttgagttgggctgcgtgtgacagacccctgtgagtgcaaatgaacaatgtcactgaattgctgcctcactggcccctcaattccttgttgctggcctctgcccacctgcacttcagatactgtcatcatggaagaatcatccttagcacagaaactcacacactgtaaatgctccatgtgaagaggtgaagaggtggagagggaacctccctcccagaccatcatggatgcttaacattctcttgaagcctgacgagttttctccagaaagctgaactacaatactcaccatctgctaccaacaccaacgagttcaacacatgaactaagtaatcgagaaggacacttccgtttaattaggtactatagagcagtagcaaggcccacacgttagtgtcaaatctggatgcaaatccttgcactgcctcctaccagctctgtgactttgggcgtttcttaacctctctgcagcttatttattaagaatgctgtgaagatgagatgacgcccttcatacagtgtttggcatcgtgcctgacccaccagaagggctcaatgtgtgtccacagttgctttttttctttgagactgggtgtccctctcatacccaggatgtagtgcaatcatagcttactgcagccttgaactcccaggctcaagggatcctcctgcctaaacctcccgagtagctgggactacaggcacacgccaccatgcctggctaatttttgtaattttttgtagagacggggtcttgccatattgcccaggctggccttgaactcctgggctcaagtgatccgcccaccttggcctcccaaagtgttgggattacaggcgtgagccaccatgccaggcctgttaggcgtttcttaacctctctgcatttagtttcttaaccactcttatttagtaagagtgctgtcagcctggaactatagctcacgcctataatcccagcactttgggaggctgaggcaggcagattacttgaggtcaggagtttgaaaccagcctggccaacatagtggaaccccttctctactaaaaatataaaaattagccgggtgtggtggcgtgtgtctgtaatcccagctactcaggaggctgaggcaggagaatcgcttgaacctgggaggtggaggttgcagtgggctgagatcacgccactgcactccagcctgggcaacagaggaagactccatctcaaaataaaataaaataaaataaaataaaataaaataaaataaaataaaataaaataaaataaaattaaaataaaataaaaaataaaataaaataaaataaaataaaataaaataaaataaaataaaataaaataaaatagtgctgtgaagatgagctggctccctgcacagagtgttcggcatcatgcctcacacactgtggtggctcaatgtatgttgacaattgcttgttttttgcttttttttttttttttgagacagagtcctgctctgccacccaggctggagtgcagtggttcgatcttggctcgctgcagcctccacctcccgggtttcagcgattctcctgcctcagcctcccaagtagctggggttacaggtgtgcgccaccatgcctggctaatttttgtatttttagtagggatggggttctgccatgttggtcaggctggtctcgaactcctgagctcaagtgatctgcccaccttggcctcccaaagtgctggattacaagcctgagccaccgtgcccggcccacgattacttttttgggggaagcttccattgcagcaccccatgggcactccaccatcatgtctctctactcctcaattgaaccttctctcctttccctctctcctataaaaatgacccttcagtaggtcattttctcactgacatgctaacttatgacttgcagcatctgatgatacaactttgacctgctttataatcgtgggtttcaggcaaggtgggaggccttccaaagtcaccttgagaaccacaactctttggtgccatctgcaatcctccatatcagccctgcagataacagggaactatggctgctgcctccctggagtaggacattcttttaaaaagatctgggagcactttaggaggttgaggcgggtggatcatgaggtcaggagtttgagaccagccagaccaatgtggtaaaaccccgtctctactaaaaatacaaaaattagccgggcggggtggtgggcacctgtcatcccagttacttgggagactgaggcagaagaaccgcttgaacctaggaggtggaggttgcagtgagccgagatggtgccacagaactccagtctgggcgaccttcctgcactcccggtgttcggggaccaacaaggcgtaataaggagccagagaccaaggcccaagtctcagctctaactgagtattatgggggtattaatgtccacctcccaggatagggagcacagagcaaggaatactaagtattgaagccctgaaacgcccacttcctgtacctgagtcgctgctgtcctctagtggccactggataaattgcacagcacgccggcctgaaaaagcggaagtgagagatgcttttccccacttctgaatctaccagatgctggggggttctcaaccatgctccactcatgacttcctttttataaaatgtattttgtgtaattacagtaatttttgaacattttaggcagatttattgaggtattgacatataataaactgcctagagattacaatttgataatatctgagccttagtatacagctgaaatcattatcacaatcaagatagtgaagaaagccatcctcccaaaaaatttccttgttgccccttggtgatcctgcttcctgccctttctacttccctctcacccccaagcaactactgatctgctttctttctcttctcttttttcctttttttttttttttttttttttgagatggagtttcactctgtcaccaggccggagtgcagtggtgagatctcggctcactgcaacctccgcctcccaggttcaacagattctcctgcctcagcctcccgagtagctgggactacaggcacctgccaccacgcccagctaatttgtgtatttttagtacaaatgttgtatttgtatttgtatttagtacaaatgttggccaggctggtcttgaactcctcgcctcaagtgatccgcccacctcggccccccaaagtgctgggattacgggtgtgagccaccacgcctggtcctgatctgctttctgtcatcataggttagtttatattttctagtgctttctagacacggaatcatacagtgtgtatttttttggtcaggtttctttcactcaccataattattttgagatgtatccatgttgctttgtgtgccaatagttcattactttttaaatgtttaattgtagtttttgtgggtacatagtaagggtatgtatttctggaatacctgagatgttttgatacaggaatgcaatgcataataatcacatcatggaaagtggggtatccagcccctcaagcatttatcctttgtgttacaaacaatccaattatacactcttaattatttttatttttattttttttttttagtttttgagacagcgtttcactcttcttgcccaggctggagtgcaatggcgctatcttggctcactgcaacctccgcctcctgggttcaagcatttctcctgcctcagcctcccaagtagttgagattacaggcacgtgccactaggcccagctaattttgtatttttagtagagacagggtttcaccagattggtcaggctggtctcaaactcctgacctcaggtgatccacctgcctcggcctcccaaagtgctgggattacaggcatgagccaccacgcctggccattagttatttttaaatatacaattaaattattattgattattgccagcctattgtgctctctaacactaggtcttattcattcttttttttttgtacccattaaccatccccacctccccacattactttttattgctgagttctgttccattgtatgaatgtaccacaatttgttattcattcagaatgatagtaattttaaaaatcaatataatgccctaactagaacatacaacagaaactaactcaaagacgagttctgtataaaagctcaaggaagctgggtgtgatggttcacaactgtaatcctagcaccaaggcaagtggatcacttgaggccaggagctcgagaccagcctgggcaacagagccccccgacccccccaacttctacaaatatttttaaaaattagccaggcttggtggtccaggtctgtagtcccagctactcaggaggctgaggcaggtagatcacttaaggccggaaggaaatttgaggcttcagtgagtcgtgatggtgccactgcactccagcctggacaatagagactcaaaaaaaaaaaaaaaaaaaaaagctcagccatgaccaccctgaccctgaccactctggaacatacaatgatacagtcgggcacttatatactatacatgtactagctgcgagtacagccaggcagaggtggggcagatgagcacatcaactactagcaccactgtcctggacatcacacaacaggggggcagggctgggctttgagcccaggtttgtttggctctgaagcccagtggctggccactccatgcaggagggtacagtgctctgtcgcccaatgcatggggactggtgttgagcagagaagatggacatgggcagattttagctggatggaaggatgcgtttctcacagggctgaccattggggtagcatgttctttttttaattacgtggatggcgtgtttgggctggctcaccctgggatttctcccatccagccatgacccagactcattcactaaggtctatatttgccttttttttttattatactttaagttctagggtacacgtgcacaatgtgcaggtttgttacatatgtatatatgtgccatgttggtgtgctgcacctattaacttgtcatttacattaggtatactgcctaatgctttcccttcccccttcctccaccccacaacaggccccggtgtgtgatattccccttcctgtgtccatgtgttctcgttgttcaattcccacctatgagtgagaacatgcagtgtttggttttttgttcttacgatagtttgctgagaatgatggtttccagcttcatccatgtccctacaaaggacatgaacttatccttttttatggctgcatagtattccatggcgtatatgtgccacattttcttaatccagtctatcattgataggcatttgggttggttccaagtctttgctattgtgaatagtgccacaataaacatacatgtgcatgcgcctttatagcagcatgatttataatcctttgggtatatacccagtaatgggatggctgtgtcaaatggtatttctagttctagatccttaaggaatcgccacagtgtcttccacaatggttgaactagtttacctttttaaaggtatgtttgtatttcactcactttgcatttcacggtaacccaatccaggggcttttccctggcacttcccacagcacagacatatgctccttccttgcctgctgccctcaggggccagcagcaggggtggcactgcacagtcccactgggggcctccctcagggcagaatataattttatggaagaaagtgtctagcaatgctttcttgagacagggtcttgctctgtcacccaggctggggagtgcagtggtgcaatcataggtcactgcagccttgacctcctgtgctcaagtgatcctcccacctcagccttccaggtagctggaactataggcacacaccactatgccccgctaatttactttattttttgtagagacagcgtctcactatgttgcccaggctggtcttgaactcttgtgctcaaggaatcctctcgcctcaacctcccaaagtgttgggattataggcgtgagccactgcacctggcccatagcaatgcttttgagacaacaagattttaaaacctgctactgtaagacaatcagtcatatttaccttctggggtaatttacctactgtgttattactgaaggagtctcttggttggtggtaaccccttagcttcagagtggcctgtccttgcaaggaaactttgaagaatttagtccaatattagtgttacagagaaggacccaaggtccataggaagtggaatgtaatacacaagttctccagtcacttcctaactctgtttttaacatctcaccccaacagtttcccctggatccaagtaaatgtgtaagtcacgcttttattcttaagctttgcttcttcctgttttccttggaaatgttttcctctgctccttataactttttgtgttgaatgctcagttcatttattttgttttatttattggatttttggttttggtttttagtcccctttcccctcctctgttgctcacagtgcagacaactttgtgcagtggaaacagtgcagtctttgaggcccgaaagtcttttgttttgattcttggttcagcttcccgtgagcaactgttaagtctgttttttcgtatgtaaaaggaaggcagtgatagccctctgcagtgttttttgagggttaaatgggatcgtggtatgtaaggaacattgcgcagtgcctgatacatggcagatgctcatcggattcctgtctcctgattgtttcccaccctccacatttacaatgcccacctagttaataaaacaagcaaaacctcatggtttcttttttcttttgtgtcatttatattagtacttcttgctgtaatgtcacagtgcacgagctgagaggtaagttgccaggaataagacggggacatagcatagaatagctattaaaatgggggattctggagtctggctgcttctttctgtcccaggcttctccacagaccagctggattaagaaaatagcatcaaagcctcaggatcctgctattttgttttattggaacaaaagcagttaagacaatgaatttacttctaagtatagctttggttaaattgtagacactgatatgtaatgctgtctttctcattgttttagaaacctgctatttaaaaatctttttaatttattttgtgagacaagatcttgctctgttgcaaaccctgtctctactaaaaatacaaaaattagccaggtgggtggcaggcgcctgtaatcccagctacttgggagcctgaggcaggagaattgcttgaacccgagagaaggaggttgtggtgggccaagattgcaccattgcactccagctctgcaacagagcgagactccatctcggaaaaaaaatttttttttccctctgttttctacagcagtttatttacagaagcatattttcccagtcctgtccttcgagctggcaagaggagcccctgactgggccctgaaatttagagaactctacatacaaaaaataaaataaattaattaattaaggactgcagggccgggtgcagtggctcatgtctgtaaatcctagcactttgggaggcagatcacctgaagtcaggagttcgagaccagcctcgccaacatgacaaaaccccgtctccactaaaaatacaaaaattagccaggtgtggtggtgcatgcctgtcatcccagctactcgggaggctgaggcatgagaattgtttgaatccgggaggcagaggttgcagtgagcagagatcgcaccactgcactccagcctgggtgacagagcaagactctgtctcaaataaataaataaaggccaacaggatgcctctgctagtctggatctggtgcctggcattggcgcagcaccacctaaccctatgcatcctctcttgactgacaatgttcaggccccagagacgtgcttcttcacaccttatcttcggtctatgggaaaaataactacatctaaatgttgaatggggcctctgccaggcactattttgaaagtacacagaagctgtgggcagaaaaggacttagataaaagacaagttaatgtatctaccagatctttcctctcagatagtgtgaatacaatcgattcaaacattatgaagtaccatttccgaatagtgctgagaatacaatttcttcttgtttttgtgctcctattcatggttccagaggttctcaagagttagcacagtatttgcctcagttgcatagaagctgaggaaaagtttgcagtattaacccttttcccatttaggaaaaaaagggcagctcactgccagtgctcatttaattttacagaaacctgctctttgaggctgaagcaaatctgattttctttcttttttttctttctcttttcttttccttcgacagagtcttgctctgttgccgaggctggagtgcggtgttgtgatcttggctcactgcaacctccgcctcctgggttcaagcaattctcctgcctcagcctcccaagtagctgggattacaggtgcctgccagcacagccagctaatttttgtattttttagtagagatgaggtttcaccatgttggccaggctggtctggaactctgacctcaggtgatccacctgcctctgcctcccaaagtgctgggattgcaggcgtgagccactgcgcctggccgcaaatatgaatggttttcagtttgaaaataaaatataaaaactgctattggaattatttctaaacagaactaacatcagaatcatctgaatcatcagaatagtctattctggaaaatcagatacatcaaatgaatctttggccaataactgttcgagaatgatgttagtatcacgtgtaggaatgctacattttctaggatttgatattttcagcttgaacaattaatgtattttgtaaatggaaatcccgccactaaaaacacaatgctataaatagaataatattttttgtttccaaagtggatatactagagtgatgcaaaaataataataaagcgagatattttgtggcaaagttaccttggggaaaacgccgcagctgcaggtgccaccagtgagtcttctctgggcaaatgagaaaaggattaaataaatcacattacacattactcttaaatttgtatctatgtctagccctcagacaaacagtgatgcttattctttgcattggcaatgaggtggtcattgaatgctagaattatgaattttaatttcataaaatttaattaagttttcaaaaatcaaaataaaatggatttatttcaatcattttgatgtacaaatttaattaatttttttttttttttttgagacagagtctcactctgttgcccaggctggagtgcaatggcgcaatctcggctcactgcaagctctgtctcctgggttcatgccattctcctgccttagcctcccgagtagctgggactacaggcacccaccaccatgcccggctaactttttgtattttttagtagagacggggtttcaccgtgttagccaggatggtcttgatctcctaacctcgtgatccgcccggcttggcctcccaaagtgctgggattacaggtgtgagccaccacgcctggcccaaatttgattaattccaatttgtatgttgcatattggtttaatagatacttatttttttttttttgagatggagtcttgctctgtcgctcaggctggagtgcagtagcacaatcttggctcactacagcctccacctcccgggttcaagcaattcttctgcctcagcttcccaagtagctgggactacaggcataccaccatgcctggctagtttttttttttgttttgttttgttttttgtatttttagtagagatggggtttcacaatattggccaggctggtctcaaactcctgatctcataatctgcctgccttggcctcccaaagtgctgggattataggcgtgagccactgtgcccagcaatagatacttttcaatatttgaaaagaatattgtttgagattctgacaaaattaaattttttacataaaaatatttttgattaaaatattaagatatttgtactttgaatatgactgttttaatccttacatgtattttaaatcttgacaataataacataattgattttgctgaaaggaagataagaaaaataaatttcatggaatactttcagtaatttataaattacacatttctttattttattactcgcttcaatatgaggaattgcttgaacctgggaggcagaggctgcagtgaactgagatcacatcactgcactccaactggggcaacagagtgatattccatctcaaaaaaaaaaaagcaaagaaattgtatgatctttgacattttgctaactttctgttatctacaaatcatagcttcatacacatctaaaaaattttatccttttaaaggaatatttgtcaggggctgaggctagaatatactttatttaacaccctgttagtttaatttataacttgcaaatatttagacagacggcctgtggcatccatctgtcctcttgccctgagccgcacatccagacttgactcatgggccccagcttggcttttccagttctttgaatggataggaatctacccagagctcatgtttgtcatagctggggagctgggggtggagggtccctctggtccccctttgaatgctgcagacaccatcttctctcagattttaagctgcagagaccaaatttccagcatgtggtcctgagctatggaaacttctcctcctgcccaggactctcactctacagagacgcattcattcaggtccctgaagcccctgtagagttttggccataaatggttcctcataaagtggtgcccccaggagctcagcctccgcccccacgccccggcaggcctcctgtcccagggcgccatgtgctgctgccctgctgggatgagaagtctggagggcacggggcagcattgcccacttagaagtcccttgtactttctttctgccagatgctgccgcgctgtttcggagggaagagtgggccagcagtaacaaaatgtttcctcccttgcacctttttcgctacagttggtagaaacttctcccagacttccttggtgactaatggtgttgggatgttgtggccttcgccgggaggggacaagttgtcagctcacagtttcacagatggttgaccgatgctgactgtagctggcaggtctcttttggctgcaagtgacagaaacccaactcaaacttgttcgcaagtagggacatttattgtttctcagaattgaaggaaggggaagggtgagtctgggtcccagaaggggtggaccgtgggattggaatcccatccagactccactccctcttcacagaagcttagcgcctcagatgggctgtgtcctctggccccgcacacatgggcttcctgttgggagctgagcagctccaccagcttccacttgcaaatgtagcgactggtgcacaagtgttcctatgcatatggggggtgacaggaggcagggccctgggactggcagcccctgcctaaaaccccatgagagaaggagttcccccaaaggtggtgctgttcccagaaaggaagggaacagcccgtgctctccaccctgtcctgcttggccattttcttcacagatgtcacctgtccttccaggcacagctgctatttctgcctgatgcttggccagtttgcatggttaaaaccagcatatttccaggagatggataatgtcacagaactggggttccagaaggctggggtggtccagcactcccaccttctttagaacatggagagctgttagttgggcagggctgaagcttaggtggcgaggaacaggaggctcctactgcagacagccttgttcttcggatcctcccagaaatccctaggccacctggaacccggggtcagagagggatgggagagaagtaggctatgaaagggggtgggaacacaccttctggaaccactgtcttccttgagaaaaccccgagagggggcgtaatgggcagggatggaccttcctccttcccgaggctcagtgacacttatctctgagggaccctcctgaggcagtgtggggtggattgttgtttgtccgaaattctgggatcttgtaaattttatttgctaaattttatcagctctaggggtaggaggatgagaggagcaaaagaatggtcccaagctcaggctggtgtggagtgagtcttagacagaaaaagagaccagagaggaaacaagcccacaagggtagccatcctgtccaaccggaagccgcctgacacttgaaggcgatggatggaagaactcagccctctgcctccttagcaacatacacctactttaaggggaaagacacaccttccctcagtgacagaaacagccccagattttcagatttatcaaaagtatattttttccaggatgggtgtagtggcttacacctgtaatcccagcactttgggaggcaaggtgggtagatcacttgagatcaggagtttgagaccagtctggccaacatggtgaaaccccatctctactaaaaatacaaaaattagccaggtgtggtggtgggtgcctgcaatctcagctacttgggaagctgtggcagcagaatcgcttgagcctgggaggtggtggagggtgaagtgagctgagattctaccactgtactccagcctgggtgacaaagctagactctgtttcaaaaaaaaaaaaaaagttgtttttttttttttaatgtggagatgaggtcttggtatgtttccaaggttggtctgaaactcctggccttaagcgatcctcccacctcaggctcccaaagtgctgggattacagacatgagccaccacgccaggccagcctttcagttttcatggcattggccattttgagcaatacagaccagtaattttaaagattttcagtgagttcaactctgatgtttcctcaggattagacacaggctatgcatccctggatagaatactacataaatgatgtgtcctccctgggaatcacatcttgggggcacacactctctctctgtccctcactggagatgttaattttgattgcaagatcaaaaaatgtctggttatccattgtatagttactgatttttttctatgcaatgaataaacaatctctggggagaccctataagatcgtggacatatccagttcttcagcaggcttcccaccacctcagatttagcatccgatgatgattcttgctgaaatcaatctatgatggttgaaaaatgattattattttccaacttcatgacttcttccacatttatcagtcaaccttttattgtcaggaagaggtttccaattcagctccacactatgtatctttttgtcaatttattattattatgggctcatgaattcctattccattcaatgtataatctgttactatcatctattttgatggtctaatagtcccagattaccttggaaaccattatgcaatgatttcttagatatgacaccaaaagcacatgcaacaaaaggaaaaatagataaattgcatatcatcaaaattaaaaactttggggcttcaaagaacaccaccaagaaagtgaaaggcaacccacagaatgggaaaaaatatctgccatatatctgctgctggtctagtatccagaatatataaagaacacttccaactcagtaataaaaagaaaactcaattttaaactgggcaaaagtttgggaaaatagctattttcccaaagatatacaatggccaataagcacatgaaagtaaaatcaacattcataaccatccaggaaatgcaaatcaaaaccacaaaatgataccagttcacacccactaggagaacttttgtcaagaagacagacaataacaaatattggtgaagatgtagagaagttagaaccttcatatactgttgatgggaatgcaaaatgatgcagtcactttggaaatctggtaggcctcaaaagcttaaacctagggttaccccatgacccagcaactctactccaaagaaatgaaaacatatatccacacaaaaacttatacgtgaatgtccatggcagcattattcacgatagccaaaaatagaaataacccagatgtccatcaactgatgaatggatagacaaaatatggtctattcatacaatggaatattattcaaccatagaaaggaataaagtatcattatgcgctccagcctgaatgaaccttgaaaacattaagtgaaagaagccagatacaaaatgccatgttttatgtaactccatgtatatgaaatgtccagagtaggcaaatccatagagacagaaagtagactagtggttgccaggcattgggaggagcggggtgggcagtaactgctaaatggggttttgttttagattggtgaaaatattctaaaactgagtgaggtggtagttgcataactctgcaaatatactaaaaaccattgaattgtacacgttaatggaattaattctatgatacatgaattatatctcaataaagctgttaccaaaaaatattgtccaagatctggccagtcagtgcctctttgagctagctcttgtgtccatttgacatgccccaatccatactttgagcatttttaaaatttctggtacaacaagaatccagactgatctcataaccctttcctgctacagcctgggaatcagccacattccctagagtcgtggttccctgttgtgtggaatgtgaaccaagatctggccattatttcatttaatcatcacatcttattttctgcttttagaaaccaaaagaatgtctcattgtggggtgcgaccagtatatgcaggaagttttagaatgaaaaagattctgaattgatccttgctaactttatttcagaaagtggtaaaatagctgtggagtatgacccagtgaagagattgtaaatatcagatgggaaaaagaactacacagtttaattcaagtatgtggagataaaaactcaagagtaacagggctgggcgcggtggctcacacctgtaatgccagtgctttgggaggccaaggcaggcagatcacctgaggtcgggagttcaagaccagcctgaccaacatggagaaatggtggcacatgcatcccagctactcaggaggctgaggcaggagaatcgcttgaacccgggaggcggaggttgcagtgagcccagatcatgccattgcactccagcctgggcaacaagagtgagactccatctcaaaaaacaaacaaacaggccaggtgcagtggctcatgcctgtaatcccagcactttgggaggccaaggtgggcggatcatgaggtcaggagttcaagaccagcctggccaacatggtgaaaccccgtctctactaaaaatacaaaaattagctgggtgtggtggcgggcacctgtaatcccagctacttgggaagctgaggcatgaaaatcgcttgaacccaggaggtggaggttgcagtgagccaagatcatgccactgcactccagcctggatgacagagcaagactccatctcgagaaaaaaaaaaaaaaaagaaaaaagaaaaacaactcaagggtcggataacatagccagtgtaaccataattcaaaacaagcagcagaatttggaggataatttgtttcattctcaggaaaatgtgaaactctgaaactgctttctgagtgcagggtatttctggggcttttcctaaagtcttgacccttggctctgaccccttatttgaagtttggagagcagaactgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagctttcaaaaactataatgcctttcaaatatggcttattgcttggatctcaatatctcccacgtatcttgggtggaatattttgccgaagatctttctgtcaatcatttacaatcatgtgctgcaaaatgaagtttgggtcaacagtagaccacatatatgatggtggttccgtaagcgtataatggagctatccctatataggtataccatttttatctttttttttttttttttttgagatggagtctcactccgttgtccaggctggagtgcagtggtacgatctcagctcattgcaacctccacctcccgggttcaagtgattctcctacctcagcctcctgagtagctgggattatagacacgcgtcaccacactcagctaatttttgtatttttagtagagatggggtttcaccacgttggccaggctggtcttgaactcctgagctcaagtgatccacccaccttggcgtcccaaagtgctgggattacaggcatgagccactgcgcccaggccccatttttgtcttttacacagtattttaactatatattttccatgtttacatacacaaatacctgccattgtgtgacagttgcctttagtattcagtacagtaacataaagtacaggtttgtagcctaggagtcctaagccataccgtgtaccctaggtatggtggctacaccacctaggtttgtgtaagtatatgctatgatgttagcacaatggtgaaatcacctagtgacgcatttctcaagctcctcacgtggcaagcaatgcatgactgcatatgaaagctcttaaatagggattgtttctaaattaatctcaaaacagtcattatttactatttatggaaacttttttaaaaaaaggagcaaaagtatcatttcagtgggaacttaacttggggctacagtgttttatttaacttttaccccaaagttgcaaagtgttttgaaatttttccctgtaaaataataattttaattcaatttaaataaaacccaccaaggagacttcaagctttaagaagtctagcttcctgtgaaatgtgagaggaagtcagcactcatttcagaaatctgattataacaatagctccatccctaaatgaggtgaatcttggaatctcttccattttatttattttattttatttttttgagatggagtttctctcttgttgcccaggctgaagtgcaatgttgcgatctcggctcactgcaacctctgcctcccaggttcaagcgattctcctgctttggcctcctgagtagctgggattgcaggtatgcaccaccacacatggctaatttttgtatttttagtagagatggagtttcaccatgttggtcaggctggtctcgaacttctgacctcagtgatccccccacctcggcctcccaaagttctgggattatgggtgtgagccaccacacccggccccccttcaattttaaagccatcactatgcaccctatgcctatgccaggcactggaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatttggagtcctcgcttattccctggcagcccctacctaatagggtggtgaattaattatcaaacatgcgacagtttagcgaaaatggcaacactttggaataaatgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccatcccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtggcataaatacaggtgtcataaagacagggcgggactcacgcttacaaggggcacgagtgtctcggagctgccagaatgacttccgctcagtgcccggcactagcgtgtgtcatgtcccggctgcgtttctggggcccatggcccctccttatgtggcaactattgtggctactagtcaaggaggctcagcctctggagtgggtcaaggacccgctccagctgacctctaaccccctggggccgcctgagccctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagctgcccctggagccagagcagttcttggcttcacagcaggatttaaaggacaagctgagtccacaggaaaggctccctgtttcacccaagaagctgaagaaagatccagctcagcgttggagccttgctgagattattggaattatacgccaattatccacacctcatagtcagaaacagaatttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccaacaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaaacccagcaggagaccccaattcagtttccagaggaggtggaaccttctgcaacccaacaggaggccccaattgagcctccagttcctcctatggagcatgaactttccatcagtgagcagcagcagccagttcagccttctgagtcttctggggaggtcgaatcttctctgacccagcaggagaccccaggtcagcctctagaacatcatgaagtcacagtttcacctccaggtcaccatcaaactcatcatttagattcacccagtgtctctgtgaagcctccagacgtgcagctcaccatagcagcagagcctagtgcagaggtgggaaattctttagtccaccagcaggctacagctcagctctcagggtcaggtaatgatgtagaacctcccaccatccagcacgggggcccacatctgcttccagagtcatcggaagaagctggacctttagcagttcaacaggagacttcatttcagtctccggaacctattaataatgagaacccctctccaacccagcaggaggctgcagctgagcatccacagaccgctgaggagggtgaatcttccctaacccatcaggaggccccagctcagactccagagtttcctaatgtagttgtagctcaacctccagagcattcacccctgactcaagccgcagttcaacctttggatctggggtttaccatcactccagaatccatgacagaggttgaactttctccaaccatgaaggagaccccaactcagcctcctaagaaagttgtaccccaacttcgaatatatcaaggggtaacaaatccaacaccaggtcaggatcaagctcagcatccagtgtcacccagcgttacagttcaacttttggacctgggacttaccatcactccagaacccactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaatacctactacagaggttaaaccatctccaaccacggaggagacctcaactcagcctccagacctagggcttgccataactccagagcccactacagagattggacattctacagccctggagaagactacagctcctcatccagatcagcttcagactctgcatcgaaaactgactgaagtcacaggtccacctactgtgctagaacctagtcaggattcattggtgcagtctgaaagttacatccaagataaggctttaactgcaccagaggaacagaaggcctccacaagcaccaacatatgtgagctctgtacctgcggagatgagatgttgtcatgtattgatctcaacccagagcagaggctccgc

SEQ ID NO: 36149 - DNA, 79371 bp, Homo sapiens
cgcgggtccccgcgcgtcctgcagcacttcccgcgccgcgcccccagcccagtgcgccggctctgtgccggggtgcccgggcggtcgggagaatgagccgcatctaccacgacggcgcgctccggaacaaggcggtgcagagcgtccggctgccaggggcctgggaccccgccgcccaccaggggtaggcctgggctcacggcctcgggtcggcctcccctgccccggctcgaaccccgcaacaggatcgggtgggggggtgggatgcgggtgggggaaaactggggttgccaaagccgcctctccgccttcagtccgcccctccagtccgccgctcccggcgcccctgccgccgcgcccgcccagcgaccccatgacacagatcggcttaaagctccccgcctgtccgcctgccctcgagagagggtcccgacccccagacaggtctccgaaggctgggcttcgcctcacgccgacctccggccccaccccacccgcgtaactataaactccagctacttgccgcgctgcttttgcacagactcatgccctgccccagaagggacagtggccgtgctgtggcgggaacagcgggcgggctggtccagagcagggcctgcctgggtgaggaggatttggagggccaggccctgtcgtcacagggttatgaggccgaagggaccattccatttacaactgcgctgaagaattgtgctaagtgaaataagccagatacagaaagacaaatactgtgtgatctcgtatatggaacctataaaagcgttgaaccatagaaacggcagaacagaccaggcgctgtggttcacgcctgtaatcccagcactttgggaggccgaggcgggtggatcacttgaggttaggagtttgagaccagcctaatggtgaaaccctgtctgtactaaaaatacaaaaattagtcgggcgtggtggcagatacctgtaatcccagctatttgggaggctgaggcatgagaatcgcttgaacctgggaggtggaggttgcagtgagccgagattgtgccactgcactccatcctgggcgatggagcaagactgtgtcaaaagaaaagaaacagtagaacagtgaacagtgattgccaggggatagtggatggggatggggtaatgatcaaaggtacaaactttcagttatagaataaacaatttctggggacctaatgtacagcatggggtctggtgggtgtgttcattaatctgtggtaatcattacatagtgtgtacttaaatcatcacgttgtgcaccttgaatatatacagtcttttgtcagttaaatatttagaaaaataattgtggggggtggggaagaattggatagagaccagctaggtagagttttcacttcccactcccatccctattccactgtcatcttcagctgtccccatgcttctccatttctgtggatgcaaaaaaggaagcctccacgttctgcttttatgaaaaccagagtcgagaagccaggggtccacttcccctcagtgaaggaccgtgtgatcttggactagtctcagacttctgagttttggtttcttcacctctcagtaataaccatttcctcgggttaatgaccacctggatatgaatgagaaaaggaatatgagagtgtttaaaaacaggtggaaagggaaaatagtttattgcagcttagatacctaccctcacatttggaccaataaaaaagtaaaatcttttgtatttagtaatcacttaatagcttacaaaacaccttcacacacatgatcttgtgtcaacatcagaggagcagagtgaggcagctgttttcctccccattttgtagataagactgaggctctggttccagtaactcccagtggccttgtaggagggggccatagcttgatcttagggcagcctgacaaggttcctcctggcatctgggcaatgccccagcctttgggaccctttggagatccctatgtcggaagcacggggaaaggagctgctcagtacccagccttctcagggctgggtaaataggagacacgggtgagatttgctgaggactgacaaaactggctatcctttctttccctttcatccccaggggaaatggtgtcctgctggagggagaactgatcgatgtatctcggcacagcatcttggacactcatggcaggaaggtgaggatgcttcctcggtgctagctagagggcactgacttcacggtcatcatccactgtggcatctccttgtgctgggtccttccagtgccatgagttgggattcttgatgggcttagaaagcaagtgggaagtaggtcaggagatttatagccaaatgggaccaccagctggaagaatagtttaaggctgtgttgagcagcagacaggtgggagggcctgtgttcttgccagaagagcctgggtcatggctgagaaggcagaccaggccctaaaccccagtcttgcctgaatgtaaactctgacagtgtctggggcttcagttcccatgttgatgtcctggctgcctttgccctctcagcctcctggggtcatgtcctgtatcaccaccccatctcaggtgtctgtgggtacacctggcatttaccatccagtactagcctgtgtcttttttcggagcgctagttccgactttccactcccccttcaaatagccccacctagatgtgctgaccaccttatctccttgatctctataactgagcttggtctctaaaaatgccccctccagtagggccagaggcctggtgctacatggagcctgcatgtccctcctgtaccccatgagaacagctcagcactattttcatgtcaggcggtattttgctgcaccctcccctccttagcacacagtgggcaggtgggaacacccatcagagcccctagctagcctgcccaggagagcccagcagtgtctccatgctgatgtggggcttgcttgcctcatctgccgtcaggcagggccttctcctagcccctcttaaaacttgcctcctctgagttccattcctggtgatggtgcagttgccctcccagccaccgggctgggaaccctcactgtctcctccccaggtaagcaatgccaggccctgctggcattgggcccttgcccattcctccccctcccttgccttcccttcctctttccatggctgcttacctgagatgggccctcagcctgtcctgataaaaccttgcacctgtccccctgccttctggctgtccccagaactcatccctgccctgctgccaataggacaaatgtctttccagaaatacatctctgagggtctcactgctgctcagaaacctttcaggattccttgtccatcaaataaaatccaaactccgaatgccaactcaagacctgtcctgaaccaagcccacttgctttcccagcctgggctcccagaaggcctccaggtgccctgcgtggctcaaacatgcacaagggcctcttggcttttatttcctatactgtcccaggcttttaatattattcctacagcttcttattcccacagttggcagacctccctaccctccaagacttcatctttcttgattccaccaggatgtggcctcctattcttcaggccctgggagcatttcacccacctgccttgaacaactggcaaacagcacttatagcacagttcacgcttggcactgtgcttgcccctctgttatctcattgaaccctcataatattcttaaacacagacatcacgttatccccatgtgatggggaaactgagtggtttgtcccaggctgttggaaggggcagagtggctgccctcacccagggctccttttcagtgccctttccattgcaccttggcagcgcccattcctgcttcatggtatttgcggtcctcgggcttgggttatggttttgttttgttttgtttttgttttttgagatgaagtctcattctgtctccccggctggagtacagtggcaggatctcggcttacagcaacctccgcctcctgggctcaagcgattctcctgccttagcctcctgaatagctgggattacaggcacatgccaccacacctggctaattttttatatttttgatggagacagggtttcaccatgctggccaggctggtctcgaactcctgacctcgtgatccactcgccactgcctcccaaagtgctgggattacagacgtgagccactgtgcccagcccaagttatggttttctatatatactttttgtctttggctgtgtggaagccctgggcttgccctgttaggaacttctagcagggctcattatatgcggcaggtgctcttgtgaacccatgaatgcataagtatttgggggcagagggagcatctgcctagcttgaacatcttttggagctgaggtgggcttctagggtagatgtgaggttggcggggctgcagccggagcccagagtgtgtgtgttgtgggatgaagccgccccctcactctctgtctgcctggccccaggagcgctactacgtgctgtatatccggcccagtcacatccatcgccgtaaattcgacgccaagggaaatgaaatcgagcccaacttcagcgccaccaggaaggtgaacacgggcttcctcatgtcgtcctacagtaggtatcctctgccctccctctctccctcagggccctcctgcagtgtggcggcctttctcttctgagcctcttagcccctggaaagtgtctcttcagccctcttgatgttgaagccctgtatgtggcctgaggcttccacatccacccctggccttgcctcccatttactcagaggatccccgttccctcccctccattccaggggccaggctggccttcccacctcctgccatttcctgtatctggcagaatcacccacaaacctggctttgggctctaactgcctttgtgcagagcccaggccaggccctaggcggtctctgttttactgcccaaatcctcttttggttctggggtctcagtccgtgcgtgctatataacaaaataccttaggctgggtgatttattaacaatagaaatgtgtttgtttattttatttttaatttttaaaatttttgtttctttgtgcatttttagtggctgggttttgctatgtagcccaggctggagtgtagtggttattctcaggtgcaatcatagcacactatagtcttcaagtgatcctccctcctcagcctccagaatagctgggactgtaggtgtgtgccactgcacctacttaagaacagaaatgtctggcttacagttctggaggcggggaagtccaaggtcagggtgccagcagattcagtgtccggtgagggcttgctttgcgcttcagagacggtgccttcttgctgagtcctcacatggcagaaggcaaggcggctctctcttcaatctcttctgtaaagcactcatcccactcgtatgccatgactcacctcctaaaggtcccacctcttaatactatcacattggtgattaagtttcaacatatgattttttttcttttttaaaaaaattttagggtgagtgtggtggctcatgcctataatcccagcactttgggaggccgaggtgggtggatcacttgaggtcaggagttcgagaccggcctggcgaacatggtgaaaccccagctctactaaaaatacaaaaattagctgggcatggtggcgtgcacctgtaataccagctatctgggaggctgaggcaggagaatcacttgaacccaggaggtggaggtgcagtgagccgagattgcaccactgcactccagcctaggcaacagagtgagactccgtttcaaaaaaaaatagtaataataataataatactttttgatggccactttacttctaggcattatgtccatactccatcagtggaggaaaggcagctgagtttgactttttttttttccttttcttttgctgtctgagacaaagtctggctctgtcccccaggctggagtgcagtggctcaatcttggatcactgcaacctccgcctcccaggctcaagcgattctcctgcctcagcctcctgttaacgtacgaattttgggggatacattccaaccatagcaagccctccatgatcttcttcttcttcctgattttgtctctggttgagcctctttgctgtctgcccctgggtgagaaggttttgaggttgagtgggactctatcactttattcattcataccttcagttactcattgactctctgaacattagggaccatctatatcatgtgccagcccttgtgccacatgctgagaggtccagggatgaacaagacccagtcgtatacttgaaatgttcttagtccagtagaggagatggacaggcccgggcctggatcccgtgaagggtgctgagcccaggcaggcatggctggggatgccctagagcagggaataacaggactgaatcctgaaagataagcagaggtcagccaggtgccagggatttgcagggtgtttcagagaggcagagggtgcccaatgcctggcagttgaagagttcctgacccaggtatgagaagccatgcagggcaggcagcaggaggggcgggcactgaggagctcaactctaaccaagggtgcagggcagccctgtagtgaggttttaagtaggcaggtgatgtgatcaggtctgtgtttgaaaatctccagggaggcaaatagcctggagcccagcgatgcctgtgaaaaagctgttagggtcacctaggacagagataagaaggccaggattaaggacctgtcagtgggggtgcagagactggaggagctcaagctagaggaggcacagtggcctcagtgttggcttggctactggggaggaagaggaaggagtcgtgatgatgccaggggttgggcatcggtgccagacttggggaaatggaggggcgagaggtttgtggggaggaggtctgtttggaacacactgagtttgagttgccaggagcactgctgggtagaggtctactgaggccttggaggatagttctagaacttggggagagaactgggctgcagcacatcgagagtattgaagctatggaagtggacccagttacccaggaggagaaaagaagtgggcccaggaggttgtcttgggaaatagcaacaataggagatggatggagaaggaagagcaggagatggagccactgaaaggtccgagggatgggaaggtgtcatgtctctaaagccccgcgaagccaaggggaacaggcgtgaggagctagcagtggggtcaggcactgcccacgggttagttaggtctgagatatggagcatccaagaagtttgcaggttaagagctcaccggtgactctggtgggggtacatggggtctggagcagtaggtgtcaaagccagaacgcaggaaggccttgaggaaaggtcaaggagtggggagagagagacaggtcctcaggaggggggaaggggtctatctgcagcccagatggaggagctggcttgaggcaggaggagaggcctcctatcctttgagacagaaggaaagaggagatgttttgtgtggtcagacgtgagttgatggctgggcgtggtggctcacgcctgtaatcccagcactttgggaggctgagatgggtggattacctgaggtcaggagtttgagaccagcctggccaacatggtgaaaccccgtttctaacaaaaatacaaaaattagctgggtgtagtggcacacgcctgtaatcccatctactcggaaggctaaggcaggagaattgctcaaactcaggaggtagaggttgcaatgagccgagattgcaccactgcactccagcctgggtgacaaagcgaaactccatctcaaaaaaaaaaaaaaagggttgacaggtgagtggtcagggaagtgagaggtctcacttgatggcttctgttaccttgcaaagaaagtgagatgctctgtctagagggtgtcagggcagagggctgaggaggatggagcagtcctgtgggagcagccacctgtgcagtcccagaaggcacccctggcagaggttggctgaggttgtacaccatgaatggaatgtgctccatgaaatgtgttcatgggttggctgggatgttctccagtgaagtgcggccacctgggcttggcgtggcgcaggcagcctgtgggacaagctccggggttgctgtgctggggtgtggccttgtgaacacacagtcctgggaggctgggcccacttcacagtccgggagtgccccttccctaatccagcacctggatttaggactcctcccttagtccatgaactctgccagggccaggagagaggagggggactaccagagtttactcctggttccagtagacctcaccccagccaggtagaccctgagagcctggagagaaccctgcctggccaccggggtctcaagatggaatgtgttggggtgctttgaatcctgcctcctctactactgtgtgaccttgagctaattactgaacttctctaagccttagttttctcatctgtaagatgggaatagtgaaaacatatgaatgcttacctaggggtccatgtgccaggcgctgtgctacatgctttatttcctttatacgtcatttcagtcctgtcaggtaggttctgattttatcctatttttcgggtacggagaggtgatgtaacttgcctaagttattgtggagcccagatctgcaccaggctgcctgtccccagctcatgcctgtccgcctctgctgtggagttccttgatgaggactcgcagaatgggcactgagtcccagcctccgggtgactgagcttggaaacactcagccctcacctggctcctgagaggccctccggaagttcttgctgccacagtgataatgaccctcctgcgctctgtgcctgcagaggtggaagccaagggggacactgacaggctcacgcccgaggcgctgaaggggctggtcaacaagccagagctgctcgcgctgacagagagcctcacccccgaccacacagtggcgttctggatgcccgagtcagagatggaggtgatggaactcgagctgggggccggggtacggctgaagactcggggcgatggtcccttcctgggtgagcaatgcaaccctcactgtggcccactgttcctgtgtggcccatgggggctcttggcctcccttctgcctagagctcatgggagcaggcaagggctggcctccatggggacacgaccaagcccttgagatttactcctaaatccctgcacaagtgccctagggccattgggctcgacagcctggatccccgggtgccacccaatcccatggttcctgtgagcgactctcccaccataccttgggggtcccacccaggggctcattgaccacatctatgcctggagaaaacagtggtttaacccaggcctaggggaccccaccataatgggcccagccctcactatgtttctgccacagggacagaggacattcaatttcatctcttctttcagattcattggccaaacttgaggctggaacagtgaccaagtgtaatttcactggtgatggaaagacaggggcatcctggacagacaacatcatggcccaaaagtgttcgaagggggctgcagcggagatccgagagcagggggatggggcagaggacgaggagtgggtaggtacctggtgttggtgcagttgtatctcctggcaggagcatggtacatactggttgaggttgtgggtaggatgagaagacgacaggatgaatcttaccccccagctttagtggaattctgtgaaacacctgggaatgtgttagcatcaggagaattcctctaaggtatgaagaatgacaacctgggacctttcttgtaggtggctctgaacctaactattccccaaagattcccaagtggtaggaaggagggggtgcagagggatattaatcatggtcattaagtctcaaaacatttctacttcaagtgaatacattaaccatgctgaggcagttgaacaactgaatgcgtagtttttcctcctttggtttgggctccttgcctgaagtgtctggagaatggctgacctggtccttactggtttttcttttgatgagagtcagtccccacgttgatcctcagcctattcacagttgcttttcttttcatttcttttctctttttttgggagatggagtctcattctgttgcccaggctggagtgcaggggcacgatcatggctcactgcagcctcgaactcctgggctcaaatgatcctcccacctcagcctcccaagtagctgggactataggcatgcatcaccacgcctggctaatttttttattttttgtagagacgaggttttgccatgttgcccaggttcacagttgtttttctgaagtatattttacccaaagacttgaattgatgtcataaggccccaaaatgaacatttattattttattttattttatttttttgagacggagtttcactcttattgcccaggctggagtgcaatggcgccatctcaggtcactgcaacctttgcctcccgggttcaagcaattctcctgcctcagcctcccaaagtgctgggattacaggcatgcgccaccatgcctggctaattttgtatttttagtagagacgaggtttctccatgttgggctggttggtctcgaattcccgacctcgggtgatccacctgcctcaggctcccaaagtgctgggattacgggcttgagccaccacacctggcctcaaaatgaacatctgaagcaacgaagtcacagaaaaatgcactatttatctaggtaatggagatgatgtcttttgccagagaaagcaggcgcacgcagatgagagtgtctggattcctttttgtcttcataaagcgaatcttggactgaaaaacagtccaagagctgttggagctgccgggccagctctaatgaggcgcccaggcaagcactcatgggccccacaggtaccacgcaattgaacccttgtttgtctgataacttgcagtgacgtttatgacatgtgctgtctccacatctctttaccccttggatttctctaggatgactgagggacgtggctgcctctgggggcaccagcaccttctgtagcattgtggaacatttcttccatgaacttctactctggagctggagagaacagtctgccaagtcttacctggttcttccccatagccaccttggaatactctttgaacaagctctgctaaaaccaaacccatgaccactgtgttggtggtggggcctcatgctgtggctcagggagggcccctccctgcatgtgagtctagccttcctagacattacatgatgaccctttaaaaaaaaattagagatggaggtctcactatgttgcccaggctgatctcaaactcctggactcaagcgatccacccccctccacctcccaaggtgttgggattacaggcgtgagccactgcacccagcctcatgttgaccctggccctggatagcagctttgtttgtagaggcaggtggtgggagagaccctaggacagcctgagagtaactggacctggtattggtgcggagtggggaatatcccttgtctaaatgcagagcagctgagagaagttagcggggctcttcctccgttctcattgtttcctgctttccttccccacccaccccttcctcagcactctgtgttgtagcctgtactatcctgcttcaagcctccgtgtcccttgtaccttccccctaccttgagttgccagttctttactccctcaaatgttcccatgccacctctggggtttctgttatctgacatccctggctgctttcctggtagatgccattcccagagaggccaacagcgttcccaggcgtggctggctggtccgcatctctcagactcactctgccaggctacagttttgagaataccttttttgttgttgttttgtacctggagaactttttatgaatgagtaaatcttcagaaaggaattcctccacccttactgggttattgtcaggtgtaaacggcctttcagctgagcaatgttcctatgagaaggaagccatttctcttggctcatgaacactgccttttgggtagtatacccacacccagatctgtgaagagacctggaattgaagtctccatgtcgtcaggacttggtggcatgtggatcttgcttgacttgggaaaagagagggtggtggtgaactaataattatggagtccccctaatgtgtcgaacacaatgctagatgatttccatgataataattactcatacttgtgctaagcacttgcgatatcgtacttctcacaacagtccatgaggtactgattattattcccattttctcatgagactaaagctcagagctctaggatagtatacagtggcaagaggaatttacatccaagcactcagatttcaaagcccacattcttaactaccggactattcatattacagagcaggaaaagggtctcagacaggttaagcaacctgcccagagtcacacagctaatgagtagcagaatcaggattcaaacccagagctgtcaaaagcaaaccttatgttccttccactgtcccctgcttccttgcccttcagaaaggtcttggaaacaggggccagaggatgtggtagccacttcactggtgttctgtgtctgaatgggactttctcacaggcaggccatgctgggacctcagccatgggggtggccagggaggtggttgagcagaaggatagctggggacactgactgggggtagagtcacccagtgtctttagacatcctgctgtctaaagcactgtgtccaaagggtatggcacacttatatggacaggtcaccattccaaacaaggaggcccagtgtgtcaataggagaggtcctaaagcaacaaaaagggcggggtgtcttggatgggcttcaggaagggaaagaccattgtgtctggagctcagagaatgggggctggtgtttgagatgaggctggagattgggcatggcatcctcacgcatgttaaggaattggggactttatccttaacatcctggaagccagtgatcccatggagagtgagaagatctgatctgtgtttcaaaggtcacttgactgccgagcagctggaggcgagttgctcctttaggagactgctgcagttgcctgggtgagaggctagaggggtctggtctatagcagtggcaggggagatggaaagaagagaatgatttgaggggcattcggggggcaaaatcaacaggacctggggggagacgaagggatcaagaatgatgcccagattctgggtgagtggcagtgctgtggtgcacaagtagtgatgttatgtttccgggtgacctgctgtttagcaggagcccagcctgtggctaagaagtatagagaactgaaactagctccctagggatgggaaaaccaagtgggctgaggataagaacagggccccagggctgggtgcagtcgctcacgcctgtaatcttagcactttgggaggccgaggtgggcggatcacttgaggtcaggagttcgaaaccagcctgatcaacacagtgaaaccccgtctctaccaaaaaatacaaaaattacccggacatggtggcacatgcctgtagttccagcgccttgggaggctgaggcatgagaatttcttgaacccgggaggtggaggttgcagtgagctgagattgccactgcactccagcctgggcaacacagtgagaccctgtctcaaaaaaaaaaaaaaaaaaaagaatagggtcccaggctcagcaggtagggacactgaggtaaaatcctattccctaggactagggactaggaagggagaaaataggaagctgctgtggcataggcatctgcatgggcagatggtgaggccaaagcccctgattttgccatacctcctgccctggtcaggactggttcaggcattagggcaggcccagccagggcagaagccttcctagatacacctgtggggagttgaggaactacagcagggctgaaaccctgctttcaggggcccccatgtggctggtaggggcagcttttggaagctagactggatcctattactccccagatgaaaagttcaaattccttaatacaactcagagctcatcacaatgtcacaaccctcctttctcggctcgcttcctccttaagagctctggggcgattctttcagaccagcctgagggatcttccacaggttgttaatagggctagaaacaaaaagtggtggtgtttctatgatctaatttgttggaacaaacgtagtgttaaactcaaacatttctgtaggatttcttggagctttaactatactaacatttactgtaactcttcaggacagggtatgattacgtatttcccacatttctttggtcagagaacccgtttttgtgaggagcatttcatgggacagctgttgtgagaaacagtttgggaagggctgtgttggtcccatggaggggctggctgttcccagagcaggtcactcccccacttgcattgccttgcctggactcttttcttggagggaggtccctttcctctacccatctgaatttttttttcttccaccagtgtccagcttgcctttcaccatgggcctaatgatggaaattacagttattttgtatcttcaaacagaaccaagcaaatcctctgagcttcattcatatgggaaattttctttctttcttttttttttttttgagatggaatttcgctcttgttgcccaggctggagtgcaatggctcaatctcggctcactgcaacctccacctcccaggttcaagagtttctcctgcctcagcaggaggattactgtaatcccaagtagctgggattacaggcctgcgccaccacgactagctaattttgtacttttagtagagatgcgatttcaccatgttggctaggctggtctcgaactcctgacctcaggtgatccaccctcctcagcctcccaaagtgctgggattacaggcatgagccacagtgccggacattatgggaaaattttttgagggactaaactaatctccacaaatagcaatgcatttaggaaatatatttaaaggggaaaaaaagactcatagtttcactcagtcatgttcataatttttagtatttgggttttttagcatgtaatttgtgtacatagttttggtttttgtaaacttgcataggggttttctggtacaaactggaaaacctgctagacaaattctgaaacatctgtaatgcttgtaggtagttgttgtaacactatgcccacacataatcactttccatattgctgcatagtctttgtaaccatttttcttcttcttttttttgagatggagttttgctcttgttgcccaggctggagtgcaatggcgcgatcttggcccactgcaacctctgcctcccgggttcaagctattctgctgccttagcctcccgagtagctgggattacaggcacacgccaccacgcccggctagtttttgtatttttagtagagacggggtttcaccatgtcagccaggcttttcttgaacttctgatctcaagtgatcctcactcctcagcctcccaaattgctgggattacaggcgtgagccaccacgcccacctgtaaccattatttttaagattgctaccattggatagttctgtcatggtccaacttttggatatttaaaattgatccctgtgtggctaacagaattaatgtttccaaaaatgttgaaaattatatagttctcttaattccccacctctaactatatttttgggttatttctttaggaacagatgcccaggagtcatattactgagaatctagaaatcttttgcaaagttcttgttatattgccaaattgcttcccaaaagggttgttctaaaccataatttcaccagcaatgtaggggagaaccatttttatgctgcccttgtgagaattgggtatgaaaacatttttaaaatgatttttgatgaggtgaaaataatatttgaatatattttaatttgcctttcccccacttatagtgagcttaaacattttttccttttcctagctgtatttctccctttgttattcgttctttcgtccatttatctactggggagatggggagtgttatctttttagtttatcagttatttgcattttaaatataaccatttgccatattttaacaacgatttttccattaaataattctttttataaaaaaactttatatatctgttgatgttttgtgatttttattgcttctaagctaatacagatttttggatcttattcaatttcgctttcttctgtttaggttattatctggttttatacctaactacttattttcaaattgctaaccagttatcctaatagtatttactgaattccttcccactcctacatcacatattaaaattattttatgcctaaattatttataatatttcagttattcttcctataattacaatttgaaccatcaaagtaggttttcatagttggcagagctagttcttcttcataattctgtttcagaattttctttgatattcttcctcaacattttaaacattttgtcaagtttcagtgcaactgacttttggtttttatttatttaaaaactgggccatgccgggcgcagtggctcacgcctgtaatcccagcacttcgggagactgagatgggtgaatcacttgaggtcaggagtttgagaccagactggccaatgtggtgaaaccccatctctactaaaaatacaaaaatttgctgggcatggtggcatgtgcctgtaatcccagctactggggaggctgaagcaggagaattgtttgaacccgggagacggaggttgcagtgagccaagattgtgccactgcactccagcctgggcaacagagtgagactccatctcaaacaaacaaacaaacaaacaaacaaaaaactggactaggcgtggtggcggtttgggagactgaggctggaggattgcctgaggccagcagtttgaggttacagtgaggtatgactgtgccactgcactccaacctgggtaagaccctatctctgaaaaacaaacaagcaaaccccagaactctggctgcaaaagtagtacatatttctttgaaggaaaaaaaggaaaacttgataatcctaccacccaaagatgtttttaaatcacttatgtggtactcagttatgtgccatgcactgtccaagtgcttacaaatattatactaactccctttgtgtttataacaactgtctgaagtcagtagactcattttccagttttccagtttaggaaactgatattacaccttttctacagatggggaaacttgcccagggtgcccaggcagtccgcagaaccatgctttgaatcagggcagtgtggttccagggtcctgtacagatcaaacaccctgactctgccattccatcagatacatgattcatattttggtgtatttgcctccaatcttgagcaaagtgggttgtccctgtacatactttgtgtaatcttttagcttaacaggtgtcatgaacacttccgtatcataaatctttcccagcatgatttttattatctatttaatatttctcatattcaatgtagaacaatgcacttaaccaatttctcatttttgtaataattttcttcccattttcccctgtaataacactgctgagatatatatttttttcttcttttttttactgttctgaagatactctggcagaaatgtatgttcctcaggctaaatcttttcacacatccacaatcattttatcataaattctagagctggaaacgctgagtctaatgttttatatatatatatatatatgttatatatctgtcacccaggctggagtgcagtgtggtgtgatctcagctcactgcaacctccgcctcccgggttcaagccattctcctgcctcagtctcccaagtatctgggactacaggcgcgcgccaccacaaccggctaatttttgtaattttagtagaggcggggtttcaccttgttggccaggctggtctcgaactgctgacctcaagtgagccgcccgcctcggcctcccaaagtgctgggattacaggcgtgagccaccgcgcccggactgttatatattttaaaggcttctgatccatatcgccaaacagtcctctggatcgatttgcatctgtatccgctgctccatctgcagtatacggacatgctccacttcacccacactgggtcattaaaagaacaaacaaaaataagaacttgatcgatttgggattttaaatggaaatgcactaaaaattccttaattccaccattcaccgtctaccatagaggaacagcccatctgcacggagagacagctacgtaattcactgcagcattataatactgaaaaattaaaatgaacgaaatgttccataaccgacgaacggccgaatgaccggcgtctccactccgcggaacgttctgcgagcgctaaggggatggcgggagtgcatgatttggagcgggcggtgagaaaagcaagctcccgccgcctctccgttttggcaacccggctgacggtcgtttcggcttctggggccagccgtcggtctgggcgagggacatagatccggattcgcatcctgactggccaaccaacgctggccgaggtgaccactctcctcggcatccgcacctgccctccaaggcgtcagagaggccggacccttgggtgctagggctcgtgagcgccggggccaagtttccgagtgccgctctcagcagcgcaccaaccggaagtgatcgtgttgtggcggaaggaggagctttctgggagtagccggtgctgagagaaccgtggctggcaaagatgattcaggcgattctggttttcaacaaccatgggaagccacggctagtccgcttctaccagcgtttcgtgagtgcggcccggcttcaccacgccccttcagggcgcccactatgtcttccctcctctttggcctctcggcgcccgggggcaccgctctttggtcacctggggctcctgcaccgagcatgaccctcgccctacttaagcatttaatctaggcgcaggctggtgccaggccttctgtctcccgccctactgccccgctctcgctgacccttttcttgatcctggcatttctgtgccattttgtgacattttcccgtgggtctctgggaacgagatagaagcgacagtggggagtgtgcctcgatgagaacttgagtgattgaagtcacattctgtcatctttttggttgttgaccacagtttcatgaggaagaaatattaagtttctgaaagtttttgttatagccagaactggaaaagttcttttttttttggaattattttgcttcagtgttggctgggactttccagagactagatacccttcactcttagggttgaagaaaatcagtttaaaagtggaaaaatgatgagaaattataaatgctgccgcataagggctcaataagtgattacgtaaatttgaattttcccaacacgttcctttgcaaacacataaacatcagtatttgcttcctgtcttcgaagattatatttcttcatggcagggtttcaaaatgttacataattgggggactggtggaactgaagaggggaaagagccagaaaacgtgttcaggcttcagctccaccttttctactcttgcgtctgttgacaagttaataaacccttttcagacttttattgtcttttgtcaattagaaatgaaaaaataattttactccttcataagatttttaaagctagattacattttattaagtagattacatcgaggtaaaaatatgagtattcaggccgggcgcggtggctcacgcctgtaatcccagcactttgggaggccgaggcgggcggatcacgaggtcaggagatggagaccatcctggctaacacggtgaaaccccgtctctactaaaaatacaaaaaattagccaagcgcggtggcgggcacctccaagtcccagctactcaggaggctgaggcaggagaatggcgtgagcccgggaggcggagcttgcagtgagccaagatagcgccactgcactccagcctgggcgaaagagcgagactccatcacacacacacacaaaaaagtatatatatatatgtatgtatatgagtattcagcgtaactatttgtatttgcatttgtgtgtatgcaaatttcccccctagtttttttctaacagggttactgagataaaactaacatgccatactgtttacttatttattttatgttatttacttatagagacggggtctttctatgttgcccaggctggtcttgaactcctgggctcaagcaatccaccggactcagcctcccaaagtgctgggattacaggcatgagccactgtgtccggccccagtttacttatttaaaggggacaattcagtgttttttagcatgttcacagaagctgtgtaaccatcaccacaatcaattttagatcattttcatcaccccaaaaagaaacctctgcccattagcagtcactccctatttctccatgactctcccagccccagagagtttctttccctctaaatttgccagttccagaatggcaaatggaatttgcctattccgttgcctataaatggaatcataaataagtggttttttgtgtgtctgccatgtttcatgtagtataatgttttcaagattcatccatgttgtagcatgtatctgatgttcttcatttcttttattgctgaataatattccattatatggatatgccatattttgattgtcaatttataagttgatatttctgctttttggctcttctaattaatgctgctatgaacattcttgtgcaagtttttatgtggacttatgacttcatttctcttggttatatacctaggagtagaattgctggatcatatggtaactgtggtgaacattttgagaaactgcaaactatttgacaaattttccaagtggctgcaccattttacatttccatcagcaatgtataatgattccagtttcttcacatccctgccattcgttatttatttatttatttttggttaaagacattttagtgggtgtaaagtggtatctcactgtggcttttttttttccctccgagactgaatctcactctatctcccaggctgcagtggcgtgatctcggttcactgtaacctctgcctcccgggttcaagtgattctcctgcctcagtctcctgagtagctaggattacaggtgcccacgaccatgcctggctaatttttgtatttttagtagagatggggtttcgctgtgttggccaggctggtctcgaactcctgaccacaagtaatctgcccgtcttggcctcccaaagtgcagggattacaggcgtgagccaccgcacccagctcattgtggttttgatttcagtttccaaaatgactaatgatgttgagcatcttttcatgtgcttattgcccattcgtgtatctttggatcataggatttttataagacctcatgagctcatggatgaaagtaccttgaaaactacagagtactaaaaagatatgaggggttattaaaatcactgaggcatgtaagcaattggtagtttacctttttattgaactagaaattaggtagcctcatcatttcgtaccacttccccactgctgccacttcccccagagtcagataaaaggctttagttcaaaagatgtctttgtcagttttaaaaagtgctgatgcttagcatgttttgtattttgcatatatagagttcgtctcctacagcatcctgtcatctgtgagctttgtttgttctttaaatggaaatgaggaaaatagtgattaatttactcaaatttgtagtgaccaatgattagcaagttttcattcagtcagtaaatactgtgagccattccatacccatgtgagtcaaagtaatttccccacaattacgttttcccttttttcccctctctgtttcttttaaataaccatttcaaagctaaattcagggctatagaaagaaagggattaaaattacttgaacctattttctaactcttggggcaagtccaatttgaaggttttcttatgattcgttactcaaagtgtggtccccagaccagcagaaatgttattgcctgggtgcttactagacttgcatctcaggacttaacctatacctgctaaatccgaatctgtattttaacagcattcacagctgattcattgcaaatgaagatttgagaagcaatgctctagagctttaagttattatctgtcttaattgctggtttctccctctcttacccttttaaccatacttcttctgaaactcatatgtataattagaaatcaaaggtgagttatcaaagtgatttcatcagagttgagctttcttatgcacgtagtaagtgaaaaaataaggccagacatggtggctcacacctgtaatcccagcactttgggaggccaaagcaggtggatcacttgaggtcaggagttcaagaccagcctgaccaacatggtgaaaccccatctctactataaatacaaaaattagccgggcatggtggcacatacctgtaatctcagccactggggaggctgaggcaggagaatcgcttgaacccggaggtggaggttgcaatgagctgtgatcacaccactgcctgggcaacagaacaagactctgtctaaaaataataataatacattttatttgtaactgttcaaaattttaatctgtaatctatttttctcaataatactttgttggtgagtaacacagcatcttatatgtagtatctatattaccagtacaaaagatggcagctgtatttgccaatataactttttaaaacatttacatgattacttcttgacctttttttttttttttttttttttttgagatggagtctcactctgtcgcccatgctggagtgcagtggcgtgatctcggctcactgtaacctccgcttcctgggttcaagcagttctcctgcctcagcctcccgagtagctgggattacaggcatgcgccaccacgcccagctaattgtttttttgttttattttgttttgtttttttttgtatttttagtagagatggggtttcaccatattggtcaggctggtctcgaactcctgaccttgtgatctgcctcctaaagtgctggaatttcaggcgtgagccactgtgcctggcccacatcttgaccttcttaaaatgttagacctgttgagatttattatatctttgtcatagatgttttccaggggaagacaaaatatttcaggatcaggccttccagttattctctgactttgtatgagagtttatcaatgttccttttcttgtttaaatatcagcttacctataggacagtaatggttagtgacttagatatttaggtaaatataccctatcttaattcctgtatcagagcattgtcacccatctttcatagattcactcctattttttctcatcatttttatcatttctagaaacaagtactaaatgtttagatgttcccagcttagaaacacttcttcccttgtccatccccatggatgggatgtagtttttcaggcttgcccactgattcacttatctttttgtttcatagccagaagaaattcaacagcagattgttcgagagactttccatctagtcctcaagcgggatgacaacatctgtaacttcttggagggtggaaggtaaactgtcagcttcatttttctccccatatatccacttgtgagtggccttcattattgcatcttctgacagtactcaagtgtcaggtgggtacttgatgcaactttagctggtctcaccatgatctgctcagggagagacacaattctctttggggcgcagttcaattattgtgcttctgatattgctcatttagatgattgatccccgggaggataggcaggagaagaggtgaggtaaggtggctttaggtacctctgccaaacttggttgccattcacctagtaagaatggcctgcttctagcgtttggccttctcctttccagtgggtcctttctcattctttggcacaaggtttctttttgatgtgtttaattaagctgtgggcatttaaatgtttcccatcttctgcagtttgattggtggctctgactacaaactgatctaccggcactatgctaccctctactttgtattttgtgtggattcctcagagagtgaacttggaatcttggacctcatccaggtatgtgtagtcagctaatgatggcagcagctttagagagtttccacgggatttttgagtaaccagcctgtagaaccttgtgtccatctccttattgatactagtaaaagttgccagatgtccaccagatggtgctctgggagagctcctgagaaaccctcagcacttttagatttattggtttctatctagcccttgcactgcccttggttttcatttacaaatttatactttggccgggtgtggtggcccacagtctgcttacagattgtctttattaccttcatgaaaactgagatgtgtagggaccctagcttgggaactatttatttagcattatttcatcgttttatatgtgagattctagatgagcttcttttaagtacttgaataagcccataggtagaaagcactcaaatagatgctacattgaaaacttaagtaacaacaattgtggaaaagaaaattctatagctataaaatgtaaactttaaatgcttacaacaggccagacatgtacattttacagctatagaattttcttttccacctatgggcttataggctcatgcctataatcccagcactttgggaggccaaggcgggcggatcacttgaggtcaggattttgagaccaacctggccaatgtggtgaaaacccatctctactaaaaatacaaaaattatccaggcatggtggtgtgcacctgcagtcccagctactcaggtggctgaagcaggagaattatttgaacctgggatgtggaggttgcagtgagccgagatcatgccactgcactccagcctgggcaacagagtgagactccgtctcaaaaaaataataaattaaaaataaataggccgggtgcggtggctcatgcctgtaatctcagcattttgggaggccgaggcagatggatcaagagttcaagaccagcctgaccaatgtggtgaaacccggtctctactaaaaatacaagaattagccgggcgtagtggcacgtgccagtaatcccagctactcgggaggctggggcaggagacttgcttgaacccgggaggcagaggttgcagtgagccgagatcgcaccactgcactccagcctgggtgacagggcgagactccgtctcaaaaaaaaaataataataaaaataaatacataaataaatgcttagaacaaaatttgttttcttaagataaaagtttaaaagctaaatatatcttggaacaaataaattgaaattttgaatatatagttttgtaggataattaaaaatttcatacgtcgtattcacttatacataaaaatataaataaagatgaacccatctaaaacagatgcatctcggagataatttttaaatactttcttaaaacctgagtcagattggacattgataatcagcataatagaaagagctcaaggcggggtgcagtggctcacacctgtaatcccagcactttgggaggccaaggtgggtggatcacttgaggccaggaatttgagaccaacgtggtcagcatggtaaaaccatgtctctactaaaaatacaaaaaattagctgggcctggtggcatatgcctgtactcccagctacttgggaggttgaggtgggagaatcgcatgaacccaggaggcggaggttgcagtgagccaagattgtgccactccactccagcctgggcaacagagtgagaccctgtctcaaaaaaagaaaaaaagctcaagatctagcatcagaaaatctgggtttgggtcatgaatctaccatctgaaaagtgatattaggttgtagaattcaaatgtgagaatgtgctttatagtactgttaactgtatgtagcaggctatagaaatgtgtacataatacgagtttatttgaaaattaaggaaatatagtgataatgtattttaaaaattgggatggagtgcttgcctcagcagcatatattctaaaagtgtaccagtgcagaaaagattagcattgccactatgcaaggatgacatgcaaattggtgaagcattccatattataaaaaataaagaaaattttttaaaagagaaaaaaaaattgggccacagttattagagaaaatggaccttggagatttgtattaacaatacaaaaagactaactttataactttttttacttttttatttatttattttttttgagatggagtcttgctctgttgccagtctagagtgcagtggcacgatctcagctcaccacaacctccgactccctggttcaagcgattctcctgccttactcagcctctcgagtagctgggattacaggcacatgcccagctaatttttgtagttttagtagcgacagggtttcaccatgttggccaagatggtctcgatatcctgaccttgtgatccgcccgcctcggcctcccaaagtgctgggattacaggtgtgaaccactgcgcccggcctctaactttataatttaatagacacttattaaatatttagtgtacattgtacattggatttggtaagatcagataagtaaaatgtaaaaataataggaactaaaaagtttgattttttttttttttttttttttgagacaaggtcttgctctcaaactgtagtgcagtagtgtgatcacagctcactgcagcctccatctcccaggctcaacccatcctcctacctcagtctcctgagtaatggggcctacaggcatgcgtcaccacatctggctaattttttgaattttttagagatgaagtctcaccatgttgtccaggctggtctcgaacatctcagctcaggcagtcttcccactttggcctcccaaattgctgggattacaggtgtgaaccactggacccatctgatctttgaaaagacaataaaaattaataaatagttggcctaattgatataaagaagatagaagtcagaaatagaaaacattgttttaaagggatgatatatacatagttatactaccaatatatttgaaatagccgactacaaaaataactgctctggcctggggcagtggcacatgcctgtaatcctagcactttgggaggccaaggagggtggatcacttgagaccaggagtttgagaccagcctgaccaacatggtgaaacttcgtctctactaaaaatagaaaaattagctgggcatggtggcacatgcctgtaatcccagctgcttggctgtttgggtagccaaggcatgagaatcacctgaacctgggaggcagaggttgcagtgagctgagatcacaccattacactccagcctgggcaatagagcgagactctatctcaaaaaaaaaaacaagaacaaaaaactgcccaaatgaggtcaacataaaggcactgaaataatattaggatgaaataatagatgttaaaaaaagaactgactccctaatggggtcacagtagaattttttaaagttgaagtacattaaaacctggatgttacattaagttattttttaaaacttagaacaaggaatcctactacctaagcgcattttatggaataaattggttatcatccaaaaacctgactctaaaaaggaagatgggccaggcacagcggctcacgcctgtgatcccagcactttgggggccgaggcaggaggatcacgaggtcaggagttcgagaccagccaggccaatatggtgaaaccttgtctctactaaaaatacaaaaaaaattagctgggtgtggtggcatgcgcctgtagtcccagctacacgggaggctgaggcagaagaatcgcttgagctgggaggcggaggttgcagtgagccgagattgcgccactgcactccagcctgggtgatagagtgagactctatctcaaaaaaaaaaaaaaaggggaagatgttcgtcaaatattgcgtattagtactggtacaaaattacttactaagtaaaatcttagccgacaatcagttgaaccaagggattgtgagacctgccttttttttctttttgactctgccattaacaagcagtgtgaccttaaacaaatcatctaggctttattggccttaagggtttttgtttgttttgcattttgtctcttctgtgtgttgagtggtttttttttaatctacaaagatactagatattcttttctagccctaaaattatttctttagcaggaaaactgcatactattaaatagaagaattatacattgtgtccaaatagtatttatcccaagaatgcaagtcagtataacaaagaaaaattaatagtctattatagcagtaagaaaaactaatataataaaaattagtagttgctgagaggagcgattatacaaattatattaaatacactcaaactggaataagaagcatttttgattaaaagtacacatttattaatgtaactgtttactttctgaagaaatgaatatagttatgtggttcagaattcagaggcacactatgagtatacaggttgaatatccctttgaaatgtttgggaccagaagtgttttggattttggactttttcagatttggggatatttgcattatacttatcctaaatctgaaagtccaaaacctgaaatgaccaataagcatttcctttgagcatcatgttggcactcaaaaattttggattttgcagtgttttggatttcaggtttttggattttaagtgttcaacctgtatagtgaaaaatatccttcttcccctttccccttatcacctagtttactttccttgaagcaatcaattttagtttcaaaaccaagagccaagaaccagagccaatgttatctcaagggtgaaatctgtaggcatttatgaatgctcttgttgggtgtttcgtccaggtgcagtggctcatacctatagtcccaaccctttgggagcctgaggcaggaggatcacttgagctcaggagttcaagaccagcctgggcaacatagtgagacctagtctctataaaaaatcaggtggtgtgcccctgtggtcccagctactcatgtggctaaagcaggaggactgcttgagcccaaggggttgaggtttcagtgagccatattcatgccactacactccagcttgagtgacagagcgagattctgtctcaaaaaaaaaaaaggagtatcttttattgtttactctaattttaacaaacatttgtagtgagtgatacaaaaacaaatgaagaagtgacatagtaaagaaagaaagagaggtaagttatcaatgtaaggtggccggattatggacatagaaaatatttttaaagaattataagtaaggaaatgatatgagcaaaatgacagaatatgagataaagccaacaaaattaaatttcctatttctgagaaaacagctagaaaattcataattaaagaagtctcatttacagtaataataaaggatagttagtgcttgggaattaacttggtatggaatacttgacattgattccaataaaattataaaatcttaaagaaaaaacaaaggaatagttggaacaaatggagctacaaactctcccgttgttgggaagagtcaagcaaagatgacagtagtcccaaaggtggtgagcaatacatcaaatggaaaaccaagtataattccgtcaggagagtttatagaactcagtaaaggcaaaatttatcagggaaaaggagtggccaagaaatgcagaagtatatttctagggaaaaaggacagtgatgggagatttgctttactagttttcagaatgtataatagttacagatgaattgattatctagaaaatccaaatcagttggaaacaattggaactaataatagagttctgtaaggtgactaaatacaagtttaacatatggaaattagtagcttttggccaagcacagtgggtcacgccggtaatcccagtcctttgggaggccgaggcgggcagatcacttgaggtcaggagactttgagaccagcctagccaacatggagaaaccccgtctctactaaaaatacaaaaaattagccgagtgtggtggcacatgcctgtaatcgtagctactcaggaggctgaggtaggagaacctcttgaacccaggaggcgggggttgtggtgggctgaaattgtactctggcccgggcaacaagagcgaaactccgtctcaaaaaaaaaaaaaagagtaggtcaaagcagaacaggggggtaaaatgagtgttctcagctgattcaggtagcagagcacctaggataacagacactggatactttgtttctttttttaattaatatgaataaaactactctaagtctttatgcaaacggttgtgcctattctgctaaaaacagaatgcctggatcaaagggaattaatatttctaatcataatgcatgttgctagatagatatttagaaagagtatgttagccaggcacggtggctcacacctgtaaccccagcactttgggaggccgaggcgggcggatcacctgaggtcaggagttcaagaccagcctggctaacatggtgaaaccctgtctctactaaaaatccaaaaagttagccgggcgtggtggtatgcacctgtaatcccagctacttggggggttgaggcaggagaattgcttgaacccgggaggtggaggttgcagtaagctgagatcgtgccattgcgctccagcctgggcgacaacagtgagactccatctcaaaaaaaaaaaaaatgaagagtatgttaatttataatgcctctagtactatataagtttgtttccttgtaactccagtactgaaatgtgtcattttaaatttctacccaggtagaggtacctcacacatttgaatttttattaatcatgcttcctttttccacgtgtgggtttataattttgttttccatgtcagccttctataatataattgaaccacttgtccagtgaaatctagatcctggcttataatgtcatattttgtatattctaaggtgcgcattttatcacacttcaataactctaaaatctggatgtgtgttgtagtgggtgacatcttaacaattataattggcagcattttttttctttgttagataaaataatggtttgccttatcatcaacaaataagtaaatctgcgtattttgagtttattttaaaacttatttaactaattattgtctaacctattatattaagtgtaaataatccatttttacctccccttgttgaagaaactctaatgttgtatactgtattaagttcagagtgaaacccaagccccctattacagcctgtaaggcccaacatggtccggctcctttgcctctctctcccctcaccgtatacacgctcatcttcactatgctctaggcttcttgctgttcttcaaacacaagtacatttttgtgtctgggcctttatacttgttctgtcccctggaatactctcatctaggttccttcacttcagctctttcaatgactgacttttaccatttatgtctcagctcgaattttaatccttggacaaactttcttagcactctatctgaagtaacccctgtcacatcatcctgtttacttccttcagggcacttaggacaatagaaaatatcttgtttcatttgcctccttgttcttcccacacccagaatataaactggataagaacatgacttgttgactgtggtgtcaacaatggtatgttcctagcatgtagtcatcacacctttaacaatggttgaataaacatttaatacataattggatttagtttttacccttcatttcttcattttattctactgagttaactgagttacatttttctttctgcattactttcatgttgttttatttattgtttctttttttttttttgagacggagtcttgctctgttgcccaggctggagtgcggtggcgcaatctcggctcactgcaacctccgcctcctgggttcaagcgattctcctgcttcagcctcctgaataggtgggactataggcgcccaccaccgcacctggctaatttttgtatttttagtagagtcgggggtttcaccatgttgaccaggctggtctcaaactcctgacctcggcctcccaaagtgttgggattacaggcgtgagccactgcacctggctatttattgtttcaatatagtttcacatacctagtaagactagttatttcccctttgtggcagttgtttttcagtacgttctctgatatttataactatttgttcatccatatgtattcttgaataatttgtaaaggtcccaaaaagtccctgttggattataattataattagaagtgaattaacagttagcatttccctcttgtttattcatttcttcttttgaatcttacattaaagtttcttttatttattttttattttttggagacagagtctcacttcgtcacccagactccagtgaagtctagatcctggcttataatatcatattttatatatcctaagatgcacattttatcacattctaataactctaaaatctgagatcatgccactgcacactgggcaacaagagtgagactccatctcaaaaaaaaaaaaaaaatgaagagtatgttaatttataatgcctccagtactatgtaagtttgttatataatttggagtctcactcttgtcgcccagagtgcggtggcgtgatctcagctcactgcaacctaactttgaggttaggagttcaagaccagcctggccaacatggtgaaactgtatctccactaaaaatgcaaaaaaattagccaggcgtggtgacaggtgcctgtagtcccagctactgaggaggctgaggcaggaaaatcacttgaacccaggaggtggaggttgcaaagagccgagattgtgccactgcactccaggctgggtgacaaagtgagaccccaaaaaataaaaattaataaaaattaaaagtaatcatactctatatatagttctaaaactttctttttcatcatttaagttctggagctttttccacatgcagttttttttgacggtgtgtgattttccataatatggatgtatcatcatctttgattcatcatgctacttgtgggcatctatgtttttcccaatttcttgctattgtaaaggatgctgcaatgacatccttccacgtgcatctatatgcacatatgttaattcccatagtacagatttctcaattggaattgctgctttaataagggcatgtgttttttaaatggatagatactgctgaattgcctccaaacaaaggctttgcctttgatacttgtactaatggaatgtaataagaatgtatctgtttacccataacctcactgacttttgaatattaagaatattttcacactgggtgcaatggctcacgcctgtaataccaatactttgggaggccaaagcaggaggatcgcttaagccctggagtttgagaccttcctgggcagcatagtgagactttgtctctacgaaaaaattagcctggctgggtgcggcggcccacgcccgtaatcccaacgctttgggaggctgaggcaggcagatcacttgaggtcaggagttggagcagcctggctaacatggtgaaacctcgtctctactaaaagtacaaaaattagctgggccattgtgcgggacgtctgtaatcccagctgctcaggaggctgaggcgggagaatcacttgaacctgggaggcggaggttgcagcgagccgagatcatgccactgcactccagcctgggtgacagagcgagagaccctgtatcaaaacaaacaaagaaacagcaacaacaacaaaaattagcctcgggtggtagcatgcatctgtgattctcagctacttgggaggctgaggttgaaggattgcttgagcccaggagatcagggctgcagtgagctatgattataccactgcactccagcctgcatgacagaccaagaccttgtctcaaaaataagataaaaataagaatattttcaaatgtttgccaatctgatgggtgaaaaaatgcaaattcattgttttcactagagtttccctgaatagtggtgaggctgcgtatctttggtatttggaaatgtctacgatatttgtccacttttcaaaaggctcatttgttttgtttgtttgtaagttagattttttcctaattgtatgcatattctttttttgttatatttattgcaaatattttctcctactccattggtctttttgctttatgtaggtacatctggaagttgttttcttcatagctcccaaggtatgaaaatattctcctacagttttgctgttgttttttttttcctttggagaaaaccatttttattatcatcaccacccagcttatttgtgctggattatgtaccagtggcaagatcttctaacgaacatctgcataacatttattttatgttttaaaagatgaaaataactgtacaaggttaagtacaaaagtacacaagataacagacacaaaaaaatgcatgtatgagatttcattctacctacagcactttatgttcaaaaagtagaattcacgaaccaaaaaatattgtccttctatagtcctgtcaggtttagtgaaagcgagtctaacatgattacaacacctatatcactgatctgatatttatgaaaaaaatcttatttttcaataaattaaagccaatgcaaatgggaatagcatttcagttttttggtgtttttcttttttttaattttttttattttgagacagagtctcactctgttgcccagactggagtacagtggcatgatcttggttcaccgtgacctccacctctcaggttcaagcaattcttgtgcctcagccacctgagtagctgggggttttcaccatgttgctcaggctggtcttaaactcctggcctcaagtgatccacctgcctcgccctcccaaagtgctgggattacaggcatgagccaccgcgcccggccatgtttcaggtttataaaatagagatatgaacatggatggtggtgatggttgcacattatgaacgttatcgaatgctactgaattgtacacttaaaaaatggctatgatggtaaattttatgttacgtgtattttaccacagcttaaaaaaagagagaggaagaaaagccagtgcaacaccctacaaactggaacactagctctttgggaacaaggacctgacatcagaacaagaaggctataagttcccaaaccttaaaagtatgatctttttcaaactgcatccatttctcacgttgaagatgtgaaacccaatcccgttcctctttatgtgtgggtctgtgatcttgccttttcatactgagcatctaaatttctaaatacagtacttcctattgcttcaaagtcttctaactttcttcatcaagtgagctacatctagcttcatcttcactcttaatacccactaatttccatatatatgacattttggtccttgtttcccaaagtcatagttcagcagacggggagtttgcccagtttttcttgccttgacttttttcctcttgttcagcaaatttcactggatttccagctgctgtgtcataatccctaggtacagctgttctgtctctgccaaagctgttgcttgcagggctcccatttgagctgccatagctatctgagttactggcattcctgatgccaacagggcagcaacattgagaacaaaatctctagtaactggagctatttcttgtttttgtttttcaatgatttctttttcttttaaaaaattttttcccaacacccatcccaactatttctttttcttgctgttcttgtaatttctttgcctagtccatcctcccagctaaagcttcttatgcatcctttgctgtgcctctgcctctgaagagagatgaactggaaatctggcttaaacttctgctaaatcttagtttctcaatgctcttctttctctcttgtcttctgcttcctgtactacttctgcttctttcctatgcatgtcatatttatttatttacttatttttcacacgcaacacagatgtagtttttatcttgaacaggagcaagatctgatccatggttttctttctttcttttttttttctttcctttttggagacggcgtctcactctgttggccaggctggagtgcagtggtgtgacctcagctcactgaaacctccacctcctgggttcaagtgattctcctgcctcagcctcccaagtagctgggacctcagacatgcatcaccacgcctggctaatttttgcatttttagtagagacagggttttgccatgttggccaggttggtctcaaactcctgaatctcaggtgatctgcctgacttggcctcccaaagtgctgggattacaggtgtgaagcaccatgtccagcccatggttttcttttcctgcttctagatcatgatcgttcttctctctgcttctggattgagactacttcttttccctctactacgatgatgcctttcacgagacctgtatcttgagtgacttctgcttcttgatggctttctttgtgtttgtgtctgtcctcatcattttcagatgaatgtatttatttattgagacagcatgtcactctgttgcccaggctggagtgcagtggcacaatcacagctcactgtaacctctgtctccccggctcaagcttctcaccacagcctcccgagtagctggaatcacaggcacacaccaccacgcctggctaacttttgtgttttttatagagacagggctttgccatgttgctcaagctggtctcaaacttgtgagcccaagcaatttgcccaccttggccttccgaagtactgagactacagacgtgagtcactgcgcccagcccattttcagatgaatttagtccctctcttcctttatcagaataatgttctttgtcattatgctcctcagaagtgtatttcttagaggatttgttgtaggattcctgtcttcttgcctcatcatgaaataggcttattattttcctacctgagtctgcaatgtcttcagttcagcctctttgcccatcagcatgcgctttgtgttttcgtccttcgttttctttcttgttttctttctcttgaccttgattgtgatcttgaataatattttgagtaagaaaaacagatgcatctgacagttctttttccacccactatctggggatgtctttttctggggctagtccatcttgtcctggataactaccctatcttgagaacccagtcttagtttcatgaaacatctttaatgaaaacagccttttgggatggtgctgctgcaaactgtggtctggctctcctcgcatgtgctctggctgccgcagaacagagctcaggccgctagggggcacctccacgtgccgcttttagcagtaccagccacctcaaagctttgccacagactgaatagctccttccgggggcctggatggcacccaggggatctgccgttgcttttttaatttatttttttacatttagctcattaatatctgttagatatttttatgtctgcattgaaatatgtaactttatttttcccccaaaggataactgttccaacattatcagttagcttgtcttttccccaccaacttaaaatacgactcttatttttaaaattgcattttataaacatgtatgtttcagtaatttatattctgccccactgatctatattcccatcttagaattatacttttattttatttttaaaatttatttagagacaaggtcttggtatgtcactcaggctggaatgcagtggtgcaatgataattcactgcaaccttgaattcctgggctcaagcaatcctcccacctcagccttccaagtagctgggactacaggtgtgtgccactatgcctggctaatttttttatttttatttttttgtggagacgatgttttgctatgttgcccaggctggtctcaaactcctgggctcgagggatcttcctgtcttggctgcccaaagtgttgggattataggcatgagccacctcacccagccttagtattatactattttagttaacaaagctttacaatgaattttgatacctagaaagactgcacccaggtgaaataaacagccttgtttctcacacaaagcctgtttggtggtctcttcacatggacacgtgagacagatttcgctagggaagcaaataaccatggaggtgggcaagaaatatccatgattgtagagctttcaatcagccttttattcttgtaacaaatgaaaaacaaaggattatcagacatctgcggaaaacctctaacatagaagaaggagataaaatgaacaaacaataaaaagcaacttaaaaatggacaccatataaagaaaggaaaacagtttaaaaaaaaaaaaaacccaaaaccctattcttaagctacagagaaagcctggccaacatggtgaaaccctatctctactaaaaatacgaagtattttagccaggcatggtggcacatacctgtagtcccagctgctcaggaggctgaggcaggagaatcacctgcacccgggaggctgaggctgcagtgttctgagatcacaccacagcactccagcctgggtgacagagtgagaccttgtctcaaaaaaaaaaaaaaaaaaaaaagccacagagaaataagacatttattttaaataataataagacccatttattaattagaaataaaataagacccatttatgtcttattgctaaatgggtgctaaacaaaaacactcacagccttgttgctcacacaaaatgaacaaaatggtctcttagaaataaaaaatgagaggaaatggaaacaaacaaaaacccacttcaactgaagtattagaaaatcaagttaatcaattgtctcagaatgggcagagatggaaaatgggagagaaaagatgagaaaataagacagaggccgggcacagtggctcacgtctgtaaccccagcactttggtaggccaagacagggggatcacttaaggtcaggaattggatatcagcctggccaacatggtgaaacctcgtctctactaaaaatacaaaaattagccaggcgtggtggtgcatgcctgtaatcccagctactcaggaggctgaggcaggagaattgcttgaacccaggaggcagaggctgcagtgagccaagatcgtggcactgcacttcagcgtggacaacagagcgagagtctgtctcaaaaaaaaaaaaaaaagaagacagacagaggtccaatacttgaatataagcagctccaaaaagattgattaggaatgtggaaaggagggaattctcaacaaaataattcgataaaatttcccagaactgaaggacttgaactgcaggattataagggcttaccaagtacccagcatagtgattgagaaatagacccatttaactatgtgtccttatagtgaaatattctggcactgttaaaaatgtaaagatttatgaatggcactaatatgaaattattgtatgtggtttttggcatacatgtatatatctgttagatatgttatctgggagtagaattcctagatcatagagcatgcatacataatgtcatagttttccaaaatggttggtatctggcaaaatacagtgcactggttaccagtctcaagaaaggaatctaaatgctcttgcccattgcatcttggtatcagagtcggcaaggaaaaagtgcaaacactggataaagctttacttacatagagaagagacagagcaggatcagctccaatagtgtgcgttggttcctcatggcaagtgggtctgtctccccagcagccgctgcagggtggtttgcctatgagcacccatcttgtgctacagtggaacggtgtgcctggtctctgtcacttgctggcctcaagtaagacccattttcatgcagtgccgaacaattcatgacactgctgacaatgagattgtttaaatgaggtcattgtctgagagaaattaaacagttatagatagatacctaggttgtagttacatggtgtgttcattctgaaaattcattaaactgtgcccttgtcatttgtacacttttctgttatgttttattaaaagttaaaaggttctatagagaagtaagctcagggcttttaaaaaaaaattttaagttgtaaacacgtcaattaaatttattcataggaaggtattttgtaggctaaataactgaccaaaaaaattaaaaagggaagatgttttgaagttaattttggctgaaattaaaacacagctatgttaaccctgtaataatgaaaaattttttgtacatgtattcattgaggacatagtattgtaagtagttggtttttttaatttgttattcttttatgtaattttttttcttttttctttttttttttttgagagactctcactctgtcactcaggctggagtgcagtggtgcgatctctgcttatggcaacctccacctcaaatgattctcattcaagctattctcgtgcctcagcctcccaagtagctgggactataacaggctcgtgtcgccacacccagataatttttgtatttttagtagagatgggttttcgtcttgttagcaaggctggtcgtgagctcttggcctcaagtgatcctcctgccttgggctctcaaagtgctgagattgtaagtatgagccaccatgccctaccataaattagcatcttataaagggggaaagagccacatgtgtctgctggttgtgttgctatgctgaaaacaaggttttcctgtcctagattattccctctaaatcgagataagtagggtgatcagctaatgctggagacaaaaggtaggtgttttaatttttgagatttatcataaagtaaatagtattgtgacagccccttttactttcagatgtgacattgataaagctgtgaatgtgttcctatttctcttctttatctatttctccttgttttctaggtttttgtggaaactctggataagtgtttcgaaaatgtgtgtgaattggatttgatcttccatatggataaggtatattctcttgcagttctcttccaaactagggttactagaaaaccaagagccttgggcatctgtagccacctctacatcttcatattgtttcttgtttttttttactcttaagatagtcctagaacatgttttatttaatagatttaatagtttgggttttgttttgtttttgctaagatctactaacagttttaacgtgcataagattattactaggcctatatcgtggttcatctgttcacagactgatttcttgatataggagaatgatgtcactggctacttggccaaaggtgagataaatagttttatgctgattataaaattagtttcctagtcataggccagtgacaatgaaactttggaataatcatgacgcaggggctttgacttagatagtaaaatttatatctttcctaaagagtaatatagtgactaagagatctgtaatgtaattcaaggtcaggtgatattctataggaaggtagactatcagaggcagaattaaaatggccccaagtaggtgttctcagatttgttttgctaggataactgtgacatggcctatgtcctcatatgccaaattaaacttgggcaatagccagcaagggaataggaattgccatgtttattttattcaacttaccacatgctgtcccctgtgcagtttactggtgcgtctttggtttgcttggtcctggtttttcttcaactgattgttgtcattatgatccctggcccttggagagagatgattttttaggagactgctgctcattgctaagccatgatcctttattaaccttttcatcatgatgaagtaggagtttttagatccatcgttgctagcattgctgtctaaaggactttcttgttgtttttcaatagggtcttcagtcttagttgactctgttgaggttggcagatccccactttccaggctaatgtagtgaatgcattcttgagtttggatgacattagaatggagtaaagttttgtctctcaccatctgacatggctctgtgactctatcagcatcctagtgcaggaacatcatggaacccttttccttctttagatacttaactttggactccctgacaacctcacggggcttccagtatttactgatgcttttgagtcaccctccctttcatatgaaagggttgtatactttttggaaacttcagcgatctcttagcaccctttctttgcaagcacttagagttgttttgtacttttcatatgttaaagatttgctattttgcaacttctgtcaaggagagccatagctcaaatctagttcccttttgtactagaggaactagagtccctttcaagtattaaagagacttgaaaatatagggggaatggagaggtgccttctgtaggccttattgttatgattttaaaataatattgttaaatacaggccgggcgtcgtggctcacacctgtaatcccagcactttgggaggctgaggtgggcagatcacttcaggtcaggagtttaagaccagcctggccaacatggcaaaaccttgtctctactaaaagtacaaaaattagccaggcgtgatggtgcacgcttgtaatcccagctattcaggagaatcgcttgaacccgggaggcggaggttgcagtgagccgaggtcgcgccactgctctccagcctgggcaacagagcgagactgtgtctcaaaaaaaaaaaaacaaccaaattgttaaatacaaggtgttactttcgaagttaccacctagtgtgcaaagtgggttctttgaagatgccacctgttgctcaccaggctgcaaatgaatttcttaacatctcaggtgtagattcagggattcaaggatagattttactaggaaagggggagttttctttttttttttttttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgcgcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtgcagaacaaaatgaaaagtctcccatgtctacttctttctacacagacacggcaaccatccgatttctcaatcttttccccacctttcccgcctttctgttccacaaagccgccattgtcatcctgacccgttctcaatgagctgttgggcacacctcccagacggggtggtggccgggcagaggggctcctcacttcccagtaggggcggccaggcagaggcgcccctcacctcccggacggggcggctggccgggcagggggctgacccccccacctccctcccggacggggcggctggccgggcagaggggctcctcacttcccagtaggggcggccgggcagaggcgcccctcacctcccggacggggcagctggccgggcagggggctgacccccccacctccctcccggacggggcggctggccgggcagaggggctcctcacttcccagtaggggcggccgggcagaggcgcccctcacctcccagacggggcggctggccgggcggagggctgacccccccacctccctcccggaccgggcggctggccgggcagaggggctcctcacttcccagtaggggcggccgggcagaggcgcccctcacctcccagacggggcggctggccgggtggagggctgacccccccacctccctcccggacggggcggctggccgggcggggggctgacccccccacctccctcccggaccgggcggctggccgggcagaggggctcctcacttcccagtaggggtggccgggcagaggcgcccctcacctcccagacggggcggctggccgggcggagggctgacccccccacctccctcccggacagggcggctggccgggcggggggctgacccctccacctccctcccggacggggcggctggccgggcagaggggctcctcacttcccagtaggggcggccgggcagaggcgcccctcacctcccagacggggcggctggccgggcggagggctgacccccccacctccctcccggacggggcagctggccaggcggggggctgacccccccacctccctcccggacggggcggctggccgggtgggggggctgacccccccatctccctcccggacggggtggctggccaggctgaggggctcctcacttcccagtaggggcggccgggcagaggcgcccctcacctcctggacggggcggctggccgggcggggggctgacccccccacctccctcccggatggcacggctggccggatggggcggctggccgggtggggggctgaccccccccacctccctcccggacggggtggctgccgggcggagccgctcctcacttcccagatggggtggctgccgggcggagaggctcctcacttctcagacggggcagctgccgggcggaggggctcctcacttctcatacggggtggttgccaggcagagggtctcctcacttctcagacagggcggccgggcagagacgctccttacctcccagacggggtctcggccgggcagaggcgctcctcacaacccagatggggcggcggggcagaggcgctccccacatctcagacgatgggcggccgggcagagacgctcctcacttcctagatgtgatggcggctgggaagaggcgctcctcacttcctagatgggatggcggccgggcgcagacgctcctcactttccagactgggcagccaggcagaggggctcctcacatcccagacgatgggcggccaggcagagacactcctcacttcccagaccgggtggcggccgggcagaggctgcaatctcggcactttgggaggccaaggcaggcggctgggaggtgtaggttgtagtgagctgagatcacgccactgcactccagcctgggcaccattgagcactgagtgaacgagactccgtctgcaatcccggcacctcgggaggccaaggctggcggatcactcgcggttaggggctggagaccggcccggccaacacagcgaaaccccgtctccaccaaaaccagtcaggcgtggcggcgcgtgcctgcaatcgcaggcactcggcaggctgaggcaggagaatcaggcagggaggttgcagtgagccgagatggcagtagtacagtccagcttcggctccgcatgagagggagaccgtggggagagggagagggagagggagagggggagggggaggggtagggggagagggagagggagagggagaggggaaaagggggagttttcaaagcaagagaagagcccatggagaggtgtattgaggtgtctctgctggaatgactcccatcacccacctcctccaatgctgtcttttttatcaggcacctgtgagagtagctttgctagtggagagataggcagaatgcttagacaccacgaaatctgtatttgtgtgccagctgcttatagatgttgtctaggggccgggtgcggtggctaacgcctataatcccagcactttgggaggcctgaggtcgggagttcgagaccagcctaaccaacatggagaaaccccgtctctactaaaaatgcaaaattagctgggcttggtggtgcatgcctataattccagctactcaggaggctgagacaggagaatcacttgaacccaggaggcagaggttgcagggagccgagatcatgccattgcacttcagcctgggcaacaagagcaaaactccatttcaaaaaaaaaaaaaaaggaagttgtctgggaatgccagctgcccaacacctggaaacttagggacctgtgggataatacacacctggagaagacagctgtaggtgctgtgggaagttgtgcttgggtgcagcccctctcactgggagaaggggtagcctcccaaccccctagtctaagctagttcattgtctaggcaacgtggagtatacctccatggtgacttttttttttttttttttttgagacggagtctcgctctgttgcccaggctggagtgcagttgtgtgatctcggctcactgcaacctctgcttcccgtgttcaagtgattctcctgtctcagcctccggagtagctgggactacaggtgcctgccaccatgcccggctaatttttgtatttttagtagagacagggtttcatcatatctgtcaggctggtctccaactcctgacctcaggtgatccacccacctcagtctcccaaagtgctggaattacaggcgtgagtgagccaccgcgcccagcctccaaggtgactttgaaagtcaacatttgttgttttgtgttttaccttctttgctccgtgttatttgtaagaatcacccattttgttacatgtggccttaggaagtttaatttcattgctgcataggatttcattatatgaatttatccattctatgactgatggaattagattgttttgagtttggagcttttatgaaatatgttgtcatgaatattcttgaaaatggatgctattgtacatttttgtacattttcttgaaacatctatttctcttaacagtgcaattcctgggtcataggtgaggcctctagaaggaagaaacaggcctctagaaggaagcacaaaagcaccagcagggctgcagcactggcaaaagaagtctgaggctcaaggcctctggactgtagaccatagtatctgccactttgttagataatgccagagtgattgtatccatttatacttctaccaatcgggggtgagtgttcccagtgctctgtatgctcaccaaaggtttatattctcagtgtggtaatcattagaactgttaactaaatatttacagttctttccccttcgagaaacatggtaaaattatactaatatgccttcctgaagttaggtgtagccatgtgacttgctttagctaatgaagtgtgagtggaagtgccatgtgtcacttctaggcaaaacttaggagccagtgctaatatatataataatggaatatatatatatatattccatttgtggaagcatggacacacagccttccagggcctgggtccctaactgaggatgaggtagagcagtgctccccagtggacgcacagtggatgtgtgcatagtatgagagaaataaacttgttactttaagccatgaaatgttaaaattgttactgtgacttaaccaagcctgtcctgactgatggatatagaacttaatttttatccagctagtaggtatgtactggcatttcattgtcattccaattgcatttcttatgaagatgagcatcttttcttgtttattgcctattaggaggtcctctctagtgaaatgtttattcagggcctttgttctttcttctgtgaggttgtctgcctgtgatttaaaaacgtatttgtaaggaccgggcacagtggctaatgcctataatcccagcactttgggaggctgaggcgagtgggtcaacttaggtcaggagtttgagaacagcctggacaacatggtgaaaccttgtctctactaaaaatacaaaaattagctgggcgtggtggtgtgcctgtagtcccagctacttgagaggctgaggcaggagaatcacttgaacccggcagccgagatcacaccactgccctccaacctgggtgacagagcgagactccgtctcaaaaaaaaaaaatgtgttggtagaagttgtattgaatagaagtagtgacagtgggcatctgctctgattcctggtttcaaagggaagctttcatcctgtcaccatgaagtagagtatttgctataggtttttttggtaaagattgtcaggttaaggatgtttcttcctttctcttcctactaaggatttttaatcataaaaggatgttaaaatttatcaaaagctttttttccagttcctgaggtaatcatgatttttttgcatcatcattctaatactgttttgtaaacatctgtaaggatgcctgctaaagcagtaaagtaattccagttccagccattttattggatgtggcttttagaaggaaataaaaggccataaaaatgttgttcttcctcatatgtcttatcttcagataagttccataaagtattttgctgccactgcaaattttttttacagtttatgaaactatgtatttttgttgttcatgcagtattaggaaataactgttcatatctcctgagatttttgaaaacaagtgatgcaaggaatcagaatcctaccctattcagctttagaatgtctgaggcttccaataggtggcttccttttcataggatttcaagcttatctttgccctcatagagagcagttgctaattcaagtatagcttcttctgttgataatagaaaatgatctttttactaagataggcaaaagccttgtcctaagacaataggaacatcaccttgaactctgttctttttaactaaagaatctcttcaccttgaggtcagaaactctcatcagttcctaggtctttaagatcttcattagatagtcatggatagatgccccatcaccttaagcagatgtggccggagtagtaggcctgtgtaaagaccagctatgactgaattccttggctctgccaagttgtttattcctaatcttgtgatttcttgtttaacctcctaagttgtttttgtatactctttttatcactgcttctctctttttcacctcctctctctccttttcttcctgtgttaaaggagggtttatttcattccatttctagagccaagttatctttctgtctctccccgacacacaccataatgtcacttcttgcactggtctctaaggtgtccttagtgtttgttcttctgtgtctacacagaatgccctggtctcggagtgaatacagcccttcccatggctctactgccccactaactgtagttccatttccattgttctcatgcaaggtgaacttgaattcgtgggtgatttacgcccagtctttaattctactttctctgttctctttctagagtcccatagcctggttttcagtcctacccagaattcactgatgatttcccaattttcaaatcctgtggccgtttcctagtcatcaccttttttattgtttctgtggtatctgatactgttaacccttcagtggagcactctcttaatctttttccacctttctttctgtcatatagaaccctgctgatttctttcctattcttttcccactctatcaggaagttatgttgtcagtcatctctcacctctctcttctccctctcatatttctagcataaatctcatccatatttcatgttctaggtcttgaagcaaaacttgggtatttaaaaaaaaattttcatgctcacactattatctatgtaggtaattcccaaatgggtaattctagtcttgatgtatggctcgagtcctattcctgtatttccaacagcctgaaggcatttctccctaatgtcattctcacatctaaatttcttcttgccacgtatccagagccagcttcagcatatgtcttctgaaaaccatttctccctgcagcttcccttttccaggagtgttactaccatcctctgtcatctacattcaaaaccttttctccctcttcctcgctcccaaggtccagtcaatcactaaatctgttgcttttttctgtaatgtccttctttatatcttgttcttagattcaccaactattaacatttggcatacttgcttttatgtctatatacatatatactttttttcctgaacgattttgagaattagttgcagacatcataacttttcatccctaaatatgtcaataaatatctcctaagagcaaggatattcttatataatacattgtatgtaattctctaatgatgcacaacacaattaacatagttgggaaatttaacattaataaatattgttttccaatatatagttcatatttaagtttcccaattgtcccagaaatgtcctttagatctttttttaaatctcagtttcagttatgagtcaaacattgtctttagttgtcatgtctcttgattgtttctggcaggttttctaaccttattctctcttccttcttgttgatcccacatactgaaattagtttttctaatgtacttcttagactagccttgactccttggccggacacattcaaggctctccacaatttgtgcccatcctatcctggctttacttccgtaactactggccagacactttctgctctagccacagtggaccactcctacttattttgtagttcctgcctcaactctctgcctgaattgtcttttcatgtactaaatactgcctgtcattcaagtgctgctcaaatcctaccaccctaaagcttgccctcatggtctagcctattgtgatctctttgaaccaggtatagtattatttttatccttctgtgaccttaatttatgtacctttctatgttttccctgcttggttagactgccttatctttgtattcctcactgaatctagtgtggtaccttttactgactggggtaatcttcaggtgactgtcactaaagagttcccaggactctagtctcataaggttgctcatgatttaaactgttggaggctggagtaaggtctgatttcatagtctctggggtaaccatcagctctcctggctgtgccatttagagcctagggtacttggttcccttttgctttcagaaatccctaaacacagctcaacattatgactgagctgggtgttggtgttaattatggtgaattgaattttgttcaaagaaaactgtgtgggtgacctaacattctgatctaccagtatctaatagcaaagctggatttagaattcaattgggctttcaagatttggtcatcagagtcacaattcaatggctatgtcaagggaatttatccagcgctttatttttttttaaatagatttcaatttgcagtgggccctctcaagagaattgaaacatatgcttctgaatggtgctgaacccaagaaaacctcatagtatggaattttaaatctctgctaagcataggctgctaaaatggaaaaatgctgagagttcaaaattaactcgtgagcactaagatgaaaggatcataaacagtaatattgggttttgtttgccagatgtcccttctgtgaacagagcttgtgataacaaagctcattaatacctgccacaccctgtgacgttgaagcagatgtcctgactgcaggtctccaggaatggagggacaagtgagggacagacagtttgtgtttttgatgatgaaagaggagctatttggtctggaagaataaggtattctgtttgagttttagttcttgtaaaaggtgcgagttaacatacctgactatccctggctgcctctgtttctctatctggatgtgcctaagagaagaagagagctgagaccagccttgtgttccattgcatctataaagcccttctttactgatgcttgataggtaagaattttgtggcagaatttttttttttggcttaagtaataaggaaatttattatcttacatacagaaaggccagttgtagggcagagttaaagcgtggttaagacagacagttttatctgcagtttcactttctgtagttccagttatgcacagtcaaccatggtccaaaaatattaaatggaaaattctagaaataaacaatacgttttaaattgcatgccattctgagcagcatgatgaaatgttgctctgtcctgctccaggatgggaatcatcccctcatccattgtatccgtgctgtgtacactagctgcccactgcttacttagtagccatcttgactgtcacagtgtcacggtgcttgtgttcaggtaacctttattttacttcataatggccccaaagtgcaagagtaatgatgctggcatattgtcataattgtttttattattagttatcgttgttaatctcttactgtgcctaatttacaaattagactttatcctaggtatgtgtgtataggaaaaaataacgcatccactgggggtcttaggacatattctaggcaggtaaggggggactactgtactttctgtatgttatcttcaattcttagtgttggctgtagaatatttttttcagaggccaaaatcttattccctcagggtaacataaagacagagatcggctggtcatgatggctcatgcctgtaatcccagcactttgggagggccaaggcggacagatcacgaggtcaggagatcgagaccaacctggctaacacggtgaaaccctgtctctactaaaaaatacaaaaaattagctgggcatggtggcaggtgcctgtagtcctagctactctggaggctgaggcaggagaatggcatgaaccctggaggcggagcttgcagtgagccgagatcgcgccactgcactccagcctgggtgacagagcgagactccatctcagaaaaaaaaaaaaaaaaagatcagcaataatgatttcttaaatttctaaaatccctgtaatttgtttagaaaaaaaaagaaagaagggctgggcgcggtggctcgagcctgtaatcttagcactttgggaggtcaaggcgggtggctcacctgaggtcaggagttcgagaccagcctggccaacgtggtgaaactccgtctctactaaaaatacaaaaattacccaggcgtggtggcgtgcacctttaatcccagctacacgggagacgtgaggcaggagaattgcttgaacctgggaagtgtaggttgcagtgagccgaggtcgcgccactgcacaccagcctgggcgacagagcaggactccatctcaaaaaaaaaaaagaaagaaagaaaaggaaggaaggaaggaaggaaggaaaggaaggaaagaaggaaggaaggaaaggaaggaaaaaggaaggaaggaaaggaaggaaggaagaaaaagaaaagaaaaaaggaaagaaagaaaagaaaaaaaggaaggaaggagggaaaaagaaagaaagaaggaaagaaagaaagagaaaggaagcaaggagagagggaaggaaggaagaaaggaaggaaggaaggacacttgggctggttgtggaggctcacgacgataatccccagcactttgggaggctgaggcgagaggatcacttgagcccaggagtttgagaacagcctgagcaataagtgagaccccatctctttaagtaaaaaagaaaaaaaaaaagaaaaaaacaaaagcaaggattgttccagactatactgaatatctgctgccatatacacactcgctttccttacttgaactttggattgcctcagtgcacaatctcattgattacctgctgcttcaagtttggtgtgttagtcattccttattactggttagtagaataacagtgtacacaaaacagcacaatttgacctttagagatattcatttgatatgcagccgttttcagtaaaacctagtgtttgtcaaggttgtagtcagtaaacaaagcttattacccatggtattacttggatatgttgcagataaaacgaattgtattttgctttggttgctgatttataggcaccctgaaaggctggaattgagattcaattttattgttcttgctattattccttatattgcagaagaggattagcctactctaagataagaagtagagtttctctttctttctttctttctttctttctttctttctttctctctctctctctctctctctctctctctctttctttctttctttctttctttctttctttctttctttttctttctttttttgagatggagtttcgctcttgttgcccaggttggagtgcaatgacgtgatctcggctcactgcaacctccacctcctgggttcaagcaattctcctgcatcagcctcctgcctagctgggattataggcgtgcgccaccacacccggctagttttgtatttttttttagtagagacggagtttctctatgttgatcaggctggtctcaaactcccaacctcaggtgatccgcctgtctcagcctcccaaagtgctgggattgcaggtgtgagccaccacacccagcaaagcagaatctcttgattcctaactaagaacccttttccaggcttgatttttgtatcaatcaaggtaggctaggtaatgcattactccaaaatcccaatggcttatgagagcaaggtttattttttcactcgtgctatgtggccattgtggtgtgtctgctgactgtagttcctctgaggtccaggctgatggaaatctcctcaacatatgcttctacctgggcatgtgtgtgttccggctcttgaagtgacacatcctcgtacactcacatttcagtgatcaaaatcagtcacatgctcccacccaagggatggggaaatgatcctattatgtgcccaagagggaggagaacctgaactagttgaatattaccaatgatgaccatggttttttcatggattttcttagaggaaaagttaatgtttgatttttattatcactttgtagaagggaagctagaaattttagtaacagaaaaatagaggagtgctctaataagaagaaaacatggttgaatcttaggaaaggtatcccacatggcagcttttcagtttctctgattattgggcatttatatcttctatacttcccaaatgaatttaagatgacttaaaataaaatttcttaacagaataaatggtttttatatgtgggaggcgagtgcctccctccttagaggctttctgcaaatcatttgtctttaccttggctctctgaccttgatgaagtactgatgtctgagagtgtttttgtcttttctctgattaccaaacaacaatcatttattaagcattcattaggaaaaagacactgcgctaaatatagagatacaaagatataaaactcaaattttctacctgtaagaagctcataaactaggcacggtggctcacacctgtaatcccagcactttgggaggccgaggtggatggatcacttgaggtcaggagttcaagaccagcctgaccaacatgttgaaaccctgtctctcctccaccgtgcccagccccagcccagtttttacttttgatgaagctttctctaaacttcggtattgtagttctccaaactgtttgtcttcttgctcatgctctcaagtttttaattctaactgtttctagtagattgtaaacgcctttggaatagtgtcagtatgtaatactttgttggttatccaaacaatacaggacagtcagagttgattagttgatgtgaaatagatatgtgtcccaattttgtgggtttctttttcttttcttttcttttctttttttttttttttaagacagagtcttactctgttgcccaggctggagtgcagtggcatgatcttggctcactgtaacctctgcctcccgggtttaagcaattctcatgcctcagcctcctgagtagctgggactacaggtgcgcaccaccacgcccagcgaatattttttttttttttttttttgagatggagtctcactctgtcatccaggctggagtgcagtggtgtgatcttggctcactgcaatctctgcctcctggattcaagcaattctcctgcctcagccttccgagtagctgggattacaggtgcgcaccaccatgcctggctaattttttgtatttttttagtagagacggggttgcaccatcttggccaggctagtcttgaacttctgacctcatgctctgtccacctcggcctcccaaagtgctgggattacaggcgtgagccaccacgcccagccctaatttttgtattttttagtagagacagggtttcgccatgttggccaacctggtctcaaattcctgacctcgagtgatccatcctcctcagcctcccaaagtgctaggattacaggcgtgagccactgcacccagccaaggcccattttttaaaaccaaattctaattagaccttgcctttgaaggttatgacttgtgcatactggctagtttcggggtgggctcacttttcactttgcctttgctcccttgggagataacctctgggtgcactcaggaggaactaggaaccctgtgttcctcaagtgggattctgcatgaattgcctttgtgggcttctgactctaccagattctaactgtgtaatttatgcaaccctcttaaagacctctttgtgcctcagttttcttcagttgtaaaacagggatgatatcacatttcattgattctttttttttttttttttttttttaaaggacatatcatatttattcatacacatgctggaattattggtgcagacatttaaatacattttctttgagaaagtcctttttttttttttttctgatggagtttccctcttgttgcccaggctggagtgcaatggtgcaatctcagctcacaacaacctctgcctcctgggttcaagcaattctcctgcctcagcctcccaagtagctgggattacaggcatgcaccaccacgcccagctaattttttttatttttagtagagacggggtttctccgtgttggtcaggctggtcttgaactcctgatctcaggtgatctgcccgccttggcctgccacagtgctgggattacagtcgtgagccaccacagctggcctgggaaagtccattctttttttttttttttaatttattcttttattgataattcttgggtgtttctcacagagggggatttggcagggtcatgggacaatagtggagggaaggtcagcagataaacaagtgaacaaaggtctctggttttcctaggcagaggaccctgtggccttccgcagtgtttgtgtccctgattacttgagattagggattggtgatgactcttaacgcgcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctgttccacaaagccgtcattgtcatcctggcccgttctcaatgagctgttgggcacacctcccagacggggtggtggccgggcagaggggctcctcacttcccagtaggggcggccgggcagaggtgcccctcacctcccggacggggcggctggccgggcaggggggccaaccccccccccccccacctccctcccggacggggcggctggccgggcggggggccgacccccccacctccctcccggacggggcggctggccgggcggggggccgacccccccacctccctcccggacggggcggctggccgggcggggggccgacccccccacctccctcccggacggggcggctggccgggcggggggccgacccccccacctccctcccggacggggcggctggccgggcagaggggctcctcacttcccagtaggggcggccgggcagaggcgcccctcacctcccggacagggcggctggctgggcgggggtgctgaccccccccacctccctcccggacggggcggctggccgggcggggggctgaccccccccacctccctcccggacggggcggctggccgggcagaggggctcctcacttcccagtaggggcggctgggcagaggcgcccctcacctcccggacggggcggctggccgggcggagggctgacccccccacctccctcccggacggggcggctggccaggcggggggctgacccccctacctccctcccggacggggcggctggccgggtgggggggctgacccccccatctccctcccggacggggtggctggccgggctgagggtctcctcacttcccagtagggcggccgggcagaggcgcccctcacctcccggacggggcggctggccgggcggggggctgacccccccacctccctcccggacggcatggctggccaggcggggggctgacccccccacctccctcccggatggcacggctggccgggcgggggggctgaccccccacctccctcccggatggggcggctggccgggcggggggctgaccccccccccacgtccctcccggacggggtggctgccgggcggagacgctcctcacttcccagatggggtggctgccgggcggagaggctcctcacttctcagacggggcagctgccgggcggaggggctcctcacttctcagacggggtggttgccaggcagagggtctcctcacttctcagacggggcggccgggcagagacgctcctcacctcccagacggggtctcggccgggcagaggcgctcctcacatcccagatggggcagcggggcagaggcgctccccacatctcagacgatgggcggccgggcagagacgctcctcacttcctagatgtgatggcggctgggaagaggcgctcctcacttcctagatgggatggcggccgggcggagacgctcctcactttccagactgggcagccaggcagaggggctcctcacatcccagacgatgggcggccaggcagagacactcctcacttcccagacggggtggcagccctcattgattctttagactcactttttgggtaccatttataattttaacatctcaaatcaagatttttcttataatcaatggtatgtcatttttcttttgtagtagcacataaaaatagtatgttttacaatcagtgaagtcttagatttgatataatacagtaatatccaccattcaattatttgaggatcggaattagtgaataattgcttagttcaataaatggtgaatttgtctttatttttacttttttcctactagtctctctgcctcctatattgtgccttaagactatcctttacacaccttcctaatgatatatttaaaaatgtattttttactaactcccttgctgatgtatacccccagctgcagtgattcttaaggagaaggacatgcctcactcccctccaccaccttcctcaaaaccttatgatagttcagtgacactgagtgattgagggaagtgtgttatttaagtgaattttcatgaatttttttttaagttggggaccactgccaaaagggtgaagctgcagccccttcttatgtacaaagacctccatgagcatgcccagcctgcctgtctagcctcacctcttgctttgaactttacactccagtgatactgaactatttttgtaacttgtgtttagggatgttacagctttggaagtctttgagccagcatgtaaagggcgagcaggtggactggggcacagggctgttccatgggcagtgatttagaaggagcaggaactgtggggatggagatggtctccttagaaacagttttatgggatctaggtgtggcatttggactttttttctttttttgttttatggccaaattgtgcttcacttatctgcctgcctatgtggttgccttaggcagagtgatagaatcccagggtagagggcagggacttactctgtgttgctccagaagacacaggtaggatcgggggtggaaattatttgatgcttgttgtagctcagtacagttaaaaactctctgacagttgttgctgctcaacagcccactgagcagcttggaaacagtagtgagctctcttcatggaggcgaaggatctgtcaccagagtgaaggatctatactgttgcaggagccaaagaacagaatcctgcactgggaaagaggttggtcaagatgactttgattataactaccaaattaaccaacatccgagtacttactaagaactaggcacgtaatagatagctaagtgctttatatacagtgtctcatttatttcctacatcatcttttttaatctttagaataagcctggcagctaagaactctggttctccccattttacagatgaagaaactgaggtttattggtaggaagcctcagtttctctaaggtcacacagctggtaagtgatagagccacattcagatcctggactctgattatggacccgctccctctacactctgcaatgctgcctgtagtattcccgcctgctttgacatcctaaatgtggggaaatgtgtttgtgtcatgttttcttagcagataagcaaccaaggaaggatgaaattcaaaaggacaaggtctggatctttttctgtacttagcactgtgcttggcatttgggatcagcagtgcaaacaggtagtagccaaaggaggatgaaacactgggttagaaagaaaaagtcctgctagaacattaaaaaaaaaaaaaatgatttcacggagaaccctgactcataataggaactggtttttttaaaaaaggaagtaataatatgtagtgagtatactttactgcagtcaactatatatattcaaagagcataaaatatgaagccagtgagtgagtgatccttttattaattaaaaaagaagttgagttgggcgcggtggctcatgcctgtaatcccagcactttgggaggccgagttgggcagatcacaaggtcaggagttcaagatcagcctggccaacatagtgaaaccctatctctactaaaaatagaaaaattagccaggcgtggtggcacatgcctgtaatcatagttactcaggaggctgaggcaggagaattgcttgaacgcaggaggcggaggttgcagtgagctgagatcgcaccactgcactccagcctgggggacagagcaagactctgtctcaaaaaaaaaaaaagaagatgaattagtagagcatgaagaataatgaatgagttgctaggtaatttgccattccctctgcctggatgccttttcctccaattgccagttagttttaaggccacccttctctgaaataacatagtactttgtacttgggtcatggtatttatcacagacttccttttattatagttaattctgtacatgtttaatctttcttacttgattctaagctctttaaggacagggtccacatcttatcttcatttccttcttccagctcttaacaatctgtgatgttaagcatatttgaaaatagacattgttagagattatgttcttttagtgaaaaatcggccaggtgctgtaatcccagcactctgggaggttgaaacagaaggattgcttgagcccaggagtttgagatcagcctgggtaacatggtgaaaccctgtctctacaaaaaatacaaaaattagctgggtgtggtgatgcaggtctgtggtcccagctactctggaggctgaggtgggatcacttgagcctgggaggccatggctgcagtgagccatgatcacgcctctgctctgcagcttgagtgatagtgacagagcaagaccctgtctcaaaaaaaaaaaagaaaaaaatcagtgaatgccttgaacctaacacactgccttttatgtggtaggtacagtgggctcactgaaacattcaacttgttcaactctatccatttgtccaaaaacaaaaaggaaatgaaaaattctaaatacagtacgaatatgccctcaattctacttaattagtatatgtctggaatgagtgtgacatggaagatttgaatctgctcttctttgcctctgctctcatgtgcctgtgctcatgtgtatcgtagagtgcttagagtgattctaatgcttaaaacaaattttcaatctctgtggcccctaaaccagccagccgtttcatctgatgtgtaagacaaggctccactggattcattcattgcccactgaaacaatgtatgatcctgtgagtgaaagagagaaagaaatcaatggctagggattgaatgtcttgtggaattttatgacaagaagacatctagggaaaaccatggaaatgtccagtctgaagatcaaacagttcataaaagtgattcagaagacactaagagcaggtgaaagggaaaaacagaactttacaaagcaaagttgctttcttggcttgctttcttcagagctgcttaggaccagacagctctatgtgcctgagagttcctgaaggaatcttagcattaaaatacaatttaccatgaaatactatgcagccataaaaaaaggatgagttcatgtcctttgcagggacatggataaagctggaaaccaccattctcagcaaactaacacaagaacagaaaaccaaacacgacatgttttcactcataaatggcagttgaacaatgagaacacatgggcacagggaggggaccatcacacaacagcacctctcgggggtagggggctaggagaagggtagcattaggagaaatacctaatgtagatgaccagttgatgggtgcaacaaaccaccatggcacgtgtatagctatgtaaaaacctgcatgttctgcacatgtaccccagaacttaaagtataatttttttttaaaaaagtacaattcataggctgggcgcagtggctcatgcctgtaatcccagcactttgggaggccaaggtgggcagatcactaggtcaggagatcgagaccatcctggctaacatagtgaaacccccgtctctactaaaaatacaaaaaattagccgggcgtggtggtgggcgcctgtagttccagctacccaggaatctgaggcaagagaatcacttggacctgggaggtggaggttgcagtaagcctagatcgtgccactgcactccagcctgagcgacagagtgagactccatctaaagaaaaaaaaatacaattcattacttagatattaacaatgagctgcaaaaaaagcactccccccaaaaaaagcccaattacatttagaatattcttttttagaagtcatgggagtgtgtaatacgcttttaaagttttctgttaaaatgatttaatggtgatttaatgtctctttcatgcatattgttttgtctccctagctagaagtcaacttttcaatgaagtcaagtatgcctggtacttgttaatgtgttccatgttgttcactgtagttacacctacatagacatccagccaacagtcattgagtctaattaccatatgttcatttttaggtaaaagagatgcaagggaatgaggatagtcagtcctttgcttgtcttaaaacaccgataaaacattggactttggaatgaaagtacgagtaagagagaaaaaggcatatgtaccaggtcctcaatactactcataaagatatcttcttcctcttttcatttctttctaaaatgtataatatgggaactagagtctgactctgggccaagatgactctcagatgattttctcttcccgtcagtgctgagtcacctcagagcgtcgttaccctttggctcattaatagccaccatgcccccaagtatagacaagaaaatgatgcatttcccatctctcaacaatctcttccctacttattttctgaagccctttcctaggaattaatgaaaccagctatgccacgaaggagtagaaaaagctatcagcctgggaggccaaggcaggcggatcacaaggtcaggagatcgagaccatcctggctaacacggtgaaaccctgtctctactaaaaatacaaaaaattagccaggtgtggtggcgggtgcctgtagtcccagctactccggaggttgaggcaggagaatggcatgaacctgggaggcggagcctgcagtgagccaagatcacgccactgcactccagcctgggcgacagagcgagactctgtatcaaataaaaagaaaaagctatcagcactcagctttttatatagtagactagagtcttgtcagtgattaacaattctttttcaaaacttgagtgttgcagtattggcatcctcatgttttaatacaagcactgtgaccatgctcttttatatttgattagtgtttttgtcttctatgtataacacagttattttgagaaagactccacagtaggaatgtgagcctctgtcttttgtagcacaacaggcatttgccctacagtgcaagggacctggagagggattgatctagattagaggtttctatggattcgattaagcttgggatgtggcatgcattaacatgctgctagtgtctcaaaagattttacttatcctctctgcctgtgaaattttcggttagatggaatcctgccatcccaatacagaactgcattttattatagaaacagtattgttcatattaggtgtagtggcaggggtgctctctggtaccacattttgggtagctttatggatttaagtctgctttcatgagctgctagccttgaaaatcttacttattacctttatagaaaaatgcattgtaaatttaaatacttaaacatttggaacatgaccaatttaaggtttggagactgtgtttttactagagtaaaaggtaatttaaataccttgcttatgccttcttgtttattatcttcaggtaccagatcagtctgtttttaagtgatctctgttgacatgggattagattcagaactttctttgatttcagtgagaaacaaccagggatggaacccttgaagagcatggaatcctctgtccttccggagggttgttgcaactgacttgtccccacccctagtagttctagagctaggttcctgaggcacatctgtatccttgaagaaacacttttatttttcttcttagattcaattctgatatgaaactagcagactcattttaatctacttttttttttttttttttttttttttttgtaacagggtctcgccctgtctcccaggctggagtgcagtggtgcaatcactgaagtcttgacttccaggctcaagtgatcctcttacctcagcctaccgagtagctggaactacaggcttgtgccactatgcccagctagtttttaaactttttttttttagagagacagaggtctcactatgttgcccaggctggtcttgaactcctgggctcaagcaatcctccttcctaggcctcccaaaatgctgggaatacaggcatgagctgctatgcctggtcttaatctacttttgtctgcagaggttaactttgtgttgcagacagtaagtaggtccagttatagaagcaagtaccttcaagggatggaggatgaggtgatagcatcctagaaaagaaaaaatgaggccaggcgaggtggctcacacctgtaatcccagcactttgggaggctgaggtgggcggatcacctgagatcaggagtttgagaccagcctggccaacatggtgagaccccatttctaccaaaaaatacaaaaattagccaggtgtgctgggcgcagttgctcatacctgtaatcccagcactttgggaggccgaggcaggcggatcacaaggtcaggagatcgagaccatcctggctaacacagtgaaaccctgtctctactaaaaatacaaaaaattagctgggtgtggtggcacacgcctgtagtcccagctactcgggaggctgaggcaggagaattgcttgaacccgggaggcggatgttgcagtgagccgagatcgcaccactgcactccagcctgggccacagagcgagactccgtctcaaaaaaaaaagaaaaaaaattagccgggtgtggtggcatgtggcctgtagtcccagctactggggaggttaaggctgtaggatcgcttgaatctgggaggtggaggttgcaatgagccgagatcatgccactgtattccatcctgggcgacagagtgagaccatgtctcaagaaaaaaaaaaaataaagagacacagatgtccagaggtgttgggggagagtggagagactcgataacaggttagattgtctttagaggaattgacattttgactacagtactcattcctactcttgactattttcaggggttccaagagaaaaatttaaataggacagagctaaaaacaccgactttcactcactaaaatgttgtcataaatttatgtatcttgatcttggaaaacatcagtatctatgcctcattttaccttttaagatttcagatttatcacccgaagcattttctctattgccttccccttatatcaagatatcctgttggtttattggggttatcctaatctttatgtcagatgaaactcatcctggttgtaattatttttaggttgaattaccattggatttgccaagtactgaaaaatcagtagcacttttgtttaaactctgttaataaacacttctgagtgaattttgctagtgtcattatttcccatgcttgctgagtagaaggttgaattattattacttcataattcatatttgttcaatgcacactgtgtgaagctgagtttaggcctctcgaagacttagcctctttctttctgttcctgtggttttgaataccatttacatgactcacgtctcagattttctttccctaccagcctccctgtgttggtttgtgactttatctgtcagtgttctctcaggtatttacttagatttctgcaggcatcctcaaggtcagcgcatcagccaacttctgttgtttaacagaacccttctttgtgccctgactctatctccagttctttaggtacatgagttcagtgttgattcttgactgcttgctcccacacccatgcttggcagcctccaactttcttaagtcccatctatctccaatcagagaaatgttagccatctttcatggtcaacttcatattcagtggacaaggtctgaactgactagcaggactaacacgggcagctgttcgctcatccattgctcacttacacttgagtcattttgcttaccaaaggtcagttgtgatgtttccagatctctttatgccagtaaactggtactgtaattatgtaatttgattaaataatatacagattaaattatgagggagaaaagaaaattattctggctgtgcatggtggctcacgcctgtaatcctaggactttgggaggccggggtaggcagattgcctgagctcaggagttcaagaccagcctgggcaacatggtaaaacctcgtctctactaaaaatacaaaaaataagctgggcgtggtggcgggcgcctgtagtcccagctactcaggaggctgaggcaagagaatcgcttgagcctgggagacagaggctgcagtgagccgagatcgtgccactgcactccagctgggcaacagagtgagactgtttccaaaaaaaaaaagaaaagaaaattactctgtgaaaagtaagaggaatgctttggaaggacaagtactttaaaaaggaaatgaagctgaattaggtttgggcaagataactatggaagagtagaggtggaaggatcttaaaaatctaggattctgtacttactgtttcacagcagtttgagttctaactttaagaaactggaaattgtagatgatgcattctgggtgagttttttgcaataatggcaaaaaactctaatcagcagaagagatccttctaggttgggcacattggctcacacctgtaatcccaatgctttggaaggctgaggcgggaggatcccttgagctcaggagttcaagaccagcctgagcaatatagcaagacctcatctctacttagaaattaaaaaaaaaaagaaaaaaagctgggcatggtggcacatgcctataggcccagctactcatgagactgaggcaggaggattgctggagcccaggagttcaaggctgcagtgagctattatcatggcactgcactccagcctgggtgacagagcaagaccctgtctctaaaaaaagaaagaaagaaagaaggaaggaaggaaagaaggaaggaaggaaagaaaaaagtaaagaaagaaagagagagagagagaaagaaagaaagaaagaaagaaagaaagaaagaaagaaagaaagaaagaaagaaagaaagagaaagaaagaaagagggttttttggccctagccaaaagttcagtggctctcaaagttttgttgtttataacaatgatggtaggcttgaacattcacgggaaaagtcacagtaaaagtcagattaaccatatctttattactttagttttaaatgctatccatggactctcagttactgagggtgaggaaatcagtgttcgtattctacctccctcctttttcccctcttctcttcctagtttttgctagctggagttttatacatcatcaaagcatatagtattgacgatctgttgttaccctaatcctattttagtcttagacctacagttaagtagttttcagtgctcaccgtaagtttttgccgtagtttttttgtttttgtttttgtttttgtttctgagacggagtttcactcttgttgcccaggctggagtgcagtggcacgatcttggctcactgtaacctcctcctcctgggttcaggcgattctcctgccccagcctcccaagtagctagaattacaggcacatgccacttctgcccagctaacttttgtttgtttgtttttttctgagatagagtctcgctccatcacccaggctggagtacaatggtgcgatctcagctcactgcagcctccacctcccgggttcaagcaattctgcctcagcctcctgagtagctgggattacaggtgcatgccaccacacctggctaatttttgtatttttagtagagacggggtttcaccatgttggccaggctggtcttgaactcctgacctcaaatgatccacccaccttggcctcccaaagtgctgggattacaggcatgagccaccaggcctggccctgccatagtttttccagtcacctgttagttggcacaagtgcttccttttgtagattccttaagaaatacttggctgggtgtagtggctcatgcttgtaatcccagcactttgggaggccaaggcggacggatcacctgagtttgggagtttgagaccagcctgaccaacatggagaaaccccatctctacgaaaaatacaaaattagtcaggcgtggtggcacatgcctgtaatcccagctactcaggaggctgaagcaagagaatcgcttgaaccggggaggcagaggttgtggtgagcggagatcgcgccattgcactccagtctggataacaagagtgaaactctgtctcaaaaaaaaagaaaaaaagaaatacctgggaataatggtccccattctgttacccttgctggacagttgactgggtataaagtccttgagtcttctgggcacagtggcttacgcctgtaatcccagcactttgggaggccaaggtgggcggatcacaaggtcaagagatgcagaccatcctggccaacatggtaaaaccccgtctctactaaaaatacaaaaattagctgggcatggtggcgcatgcctatagtcccagctacttgggaggctgaggcaggagaatcgcttgaacccaggaggtggaggttgcactgagccgagatcgcgccactgcactccagcctggcaacagagcgagactccgtctcaaaaataaaaataaaaataaataaagtccttgagtcacactttctgtccttgagaattttgtaggtgttgttccattttctgttagcattaaatattaatgtggaaattttcattattttgtttctcttttaagtgatttgatctttttgcctggttgcaggaacccagaaaccttacctaaaggtgtatcttggtactgcctattctgaatttgtttcccctgggatacagtgtgacctttcagtgtgtagaccccaatcctcttatagttcagaaacaccttagattctatctttatgaacatatctttacatatttttcccattcatgttaaagttttcttttatgcaaatattacatctcctttgctgtcttttgtaactgtttcttctctatttcttttagccctttttggtttcattttttttttccatttctctccttttgttcctagtgtgtttttagcagtttcttctccctttgcttcttccagtttcaccttcatttctgtaacagtatttttcctttcacttctttcctcagttctgccagtatgcagcttgtcttctcttctcgtctccctacctctgctaaagttcttgtatttctgctttgagctctcatttcatagagacaactattttatcaagttttctttttttctttgtgtaaaatattttattaccattgtatctagtccatggaggcccttttccagtctgtggtcttagtctgccatttggttttcctatttctttcctaattttttctcgttgtatatttatatagatcctgtttagattttttgtatacttatctttaaataggcaagtttttcagggaccagctgttttgcaggatgtttgttggaggagctaccaaaactctgttctgggctagctacagttgttcccttgatttagggttctgggtgagtccgtttacccttagtctctagccagccaatcgagataggcaaggcgtctcttagcatctccacaatgcaaaggatgtcttctctactaccacagacaccacctctgtgaggcaaatgtagcttgcgtgatttctcatttagcctcaacttcaggtccaaggaagttcctgccttccaaaaacaaggaattaatttggtgctggagtgtgtcctttacccacaggaagtacatatttttgcagatctttctgagatcaccagcttccctgtcctctccctgtagcatcctttcttctttttcttctgtgaagcaaaggagtccctgcctgagctccctgcttttgacagctttttcacctgtttgggggtttggaattttggatatcctgtagttataacaaaaatggagtttgcatttttatttcttctttttgcatttggaacatattttgaacagcatttgaaaatgctgactttatgatgcagtgttaaataagaagttttaactgactttttctgttaaccagccactagtctccacgacatcatgtgttaggccttttactataccttctccagaaagcccccaccaccacactgttgtctatcttcgaagtccctaaagcccaaggaatatgctacttagatatatggaaagcctttcattcatttagcatgcctactctgagcgttgttctaggccttggagataaagcatggaagaattaatacaagatattgacacaccaaagacaagtcttaaatgatttcatgtggactaggggtcagggatgaatagagtggaagacatagtttgggattctgaggaagtatgatataaagggtagaacatgagctccggaatcagcaccattctgctgctaatatacatgacattgggatcattttattgccttttcctcatatataaaatgtatcaatttcttcatatataaagtgaagtcaggccaggcgtggtggctcacgcctgtaatctcagcactttgggaggccaaggcagggggatcatctgaggtcaggagttccagaccagcctggccaacatgaggaaaccccgactctactaaaaatataaaaattagctgggcatggtggcgggtgcctgtaatcccagctactcaggaggctgagttgggagaatcgcttgaacccaggaggcggaggttgcagtgagccaagttcacaccactgtactccagcctgggtgacagagtgagactcagcctcaaataataatagtaataataataataaagtgaagattatattacctaccttagatgaatgttgtaaaattaaggtaagttacataaagtacttggttcataatagatactcaacaagtactactttctacccacacagggattggctaaataaaaggaataaatactgaaagtgcaggtatagaggactatttctctccttttttgttaaattgtggtaaaatatgtaacatatagtttcctgtcttcaccatttttaagcttacagttctgtggcattaagtatatccacattgttgtgcagtcgccaccaccatccgtctccagagctcttcatcttgcaaaacagcacctctgtacacattaaacaatagccaccactgtcctcttccccctgcctcatggcagcccccgttccagtttctgtctctgaatttgactactctgggtacctcacaggagtggaatcacacagtcctcatccttttgtgtgtgggttgtttcacttatagtatcttcaaggttcatccgtgttacattgtgtctcagaattcccttcccttttacagcatctcaattcagatgaaaaaaaaaaaaagaattcttttcctttttaaggctgaataatattctgttgtatttctatggcacattttgttgatccagtcgtctgttcatggacacttgggctgcttccaccttttggctgttgtgaataatactgctatgaacatgggtgtacacattctcttcaagtctttactttcagttcttttgagtgtatatccaaaagtggaattgctgggccatatggtaattctgtttttaatctttttgaggaaccaccatactgttttcagaggcctatttcttgatggggaagtataaacagtggaattcccccagggaataattttaaaaccagtcttgtttaacattttgtaaattatctaaatatgagacttttaccattaaatcttcatttgcatatagctaatgaataattcatattgtataaaatgtaagaacacctcgtgagagtgtgtgtgtgcgtgtgtgtagacagaacagtggttaataaagctcaatgtgggcacacacgcaagggaatacatttgatttattatactctgtcctcaagatcagaagttccctgcacttactgagggcaaaatacagggagccaatgccagagaacttcagatgtcagaagtgcacagtgcccagatatgcagacacatctttcttcttgactctgcattgctgacagagtaaactggtggttgactctagactctggaccagtggttctcagctggggtgaatttgccccctggaacacatatgacaattctggagacatttttgattgtcaagctggaggagtagagaccagggatgctagagaacaggccacagtgacaggacagccccacagcagaggattatctggtcccagatgtcactagtacctaggctgagaagccctgctccagacccaaattaccttctcagccttgtcttagcctctctcctgcataaagaaagttgccatcccagccagacccaggagctccccatacctgcccatacaccagctgaattgctccttccaacatcttctacctgaaattctttcccctacctctctaatgtcagagcccagcttccatcctcccactgtctctgtgaagctctctgatctctctagccactgtaccctttcttctctgacttccccaggactatcccagtcatttggcacttagttaacaatagaaggttgtacttgctgtcttcccaacttgaccgaaagcaccttgagggccatttgatgtgatttggtttgaaatatggagtaccattccttatgaaccacagtgggcatctctgctttgacccacccagggctttctgtgacagctttcctaccacaaaggggtacagtagttgagtcacctccgtcccatcacagcagttaggtacactgagattcagctttgtttagatgactgctagctagatggaacctaagcccaaatgtgacccttatgcttagaaaggtgtttatgctgaatctgctttctaatctaagcagtaagaaatgaggtgaggagaggtgcaaaggaattgggctctatcttgctctgatcacgtcccttcagtggagcacaggctggaggatctgccttatagaaggtggaagacattcatttcagttgcttggacagggattattctgtcatagctggacctacttaatgacagtcagtgttgatgatggtaatattaataatgaaagccaccattccttacttagaacccagtgtgtcctgggcaccaggctaggtgctttacacacatttatctcatccagtcctcactgcaatcctggaaggaggctgaagcactttaaaggtcatttgcccagggccacccagctagcaagtagcagagccagaatttaaacaagagctgtcagactttgaagcctgtgctcatagctaccacctcgctgctgaggggagagattcgtgttgccatgtgccaagacctgggagagacccctcgttgtgtcactgggcaggggggtttgagtgtctgagttgtgagtcaggacaggtcatatctgaccactctgctgctgcaggaaaaggaaacctcgtgggttacactctgaccaccacagagtattctgactcctgatttttgcttcccttttaggtgcactacatcctccaggaggtggtgatgggtgggatggtgttggaaacaaacatgaatgaaatcgtggctcagattgaggctcaaaacaggctggagaaatccgaggtgagtaagcagctgtgctctagccctggctgggtagagaaaacctgggcagaggcaggagtgtgtacatgtgttggtttgtgttgctgtgaaacctcgggaaatgatactcatcttctttcttccttgagtccattgaaactcatggatttgaaggtcagccagccctgaaaattaaacaggtaacaagtttgaaatctcagattttcagggtagaagagcaaatagaaaagccagatggcagaggaaggcaaacagcttctggcttgggggttatggcccatgtttgtggtttgtaattcctcctttgaaagccactcgttccctggagggacccagaaccctcttccctagtccagtgtggtttcctagtttgtgtgctctaagagtctgatctcccagcagccatttctcgtggtgtctttcagacctcagagttgccaatttccttatttccagttagctttataaaaaactacagtagagtttgggctaggcttgaaaataacataccccagtccacccccacatggtgctgggcttgatagagatgttcacataaattctgtcctatccctctgaggtctcgccgtccccttcctcagccttcccagagcacagaggttacagacgtatactttcacatgcagaaatagcagaacaaattacctctttaattatctgagtgtcttaaagagcttctttgccttgtatacggaacttgatcttgcgaaaccaggaattcttctttctgtgaggactggcagtcctgtggaagaagcttttccagaccacagctattggtggcagctatagttcttttagaaatgtaggctgggaagattccaggaatagtaagtgagtcagaggcaagggggttggaaatgagaagaaatggagacttgctgggtgagggcagaagcagagttggtatccggaaagaaggcaataggggaaaaatgattgtgagagagttttcatccacttttgccgttccctccacgtgggggtgagcctgccaggtgggggttcactgtagatgtgcatactctttgcgttttgtcaccagctcttctttatctgtgataccccccaccttctcccagcttgttgccacatgacacttccaaagccagctcttttcatctcacattattagttggcaagcagttgccctagagctgtgactgtccttttccttttaagaacttcccggtgactttgcacgtttcaataagagtctttggtctcttgaggaaagggttttgttttgttttgtaaccagaaaagtgcccctgacaaatcaccttagattatttcagcatttattgggtacccaccatgtgccaggtactgtgagaggctggggctgtgaaactgtataggccacactccgcctctgaggagctggtagtctagtaggactgcaggctttggatccctgtgccaaaccccatctaacctcaagattgttttgttggctacttttgaggaataaggggggaaagttaaaacttcagttgtgtgtgctcagtttggaatttttctaggcatccttcacctgttattttgtttgtttgtttgtttgagacagagtctcactctgttgcccaggttggagtgcagtggcgtgatctcagctcaccgcaacctccgccttctgagttcaagcgattttcctgcctcagcctccctagtagctgggactacaggggcccgccaccactcctggccaatttttgtatttttggtagagatggggtttcaccatgttggccaggcctatctcgaactcctgacctcaggtgatccacccacctcggcctcccaaagtgctgggattacaggcgtgagccaccacacccatcctgcttgtttgtttttgtttttgctttttttttttttttttttttagcattaagcagataacagtgagaatttgtctcatactcgcctctcatttcttcttagggtggcctttcagcagcccctgcgcgggctgtgtctgctgtgaaaaacatcaacctgccagagattcctcggaacatcaacattggcgatctcaacatcaaagttcccaacctgtcccagtttgtctgaggatcaagtattggcctgaaatagagtccttaagacaagcaaagacaagcaaggcaagcacgtctggaaacagaacccattttgagccttagaagagtcaagcctcaggacctggaaactttgtgtctggggaagactgtttggcatggaatagggaagggattcctattgacactgctcgggtgcacccagttctcacatgtgcagtcatgccgttctctgatgcatacggccactgcagatgtgaggggccctgccttcctcagtagggagtcaacatgcccaagtcatttgcacctttacctctcacatggatgctcccaagggttagggactgcattgagcaggcccacctgcttcccagaacctcctcactagggctgagcaccttctctgagtagagtcttcatccttagcaccacagacttctgaggtcctgtgccctttacttgctggtgaggtgtcataggtagaaaagggctggcccttcagatctgggggtgtggtgagtggcaagtaagggcagaattttaggagaaccagagtcacccgctggctctactgagattgttacacccagaatccttttgtgtttttttgtggttttttttttttgaggtggagtcttgctctgtcacccaggctggagtgctgtggtgcaatctcggctcactgcaacctctgcttcccgggttcaagcatttctcctgtctcagcctccccagtagctgggattacaggcacccaccaccatgcccagctaattgttgtatgtttagtagagacagggtttcaccatgttggccaggctgggctcgaactcctggacctcaagtgatctacccgccttggcctcccaaagtgctggcattacaggtgtgagccaccgtgcccggccaccagaatcctttggtatagccaagccttttggttaccgcctcatgaagaatatgcttcccgcattgtcctagtcccagttgtattctcacaggtgttatgtgcaggacacaatccaaatcataaacctggctcatgcccaacacatttctgctaatagggagagggacccaccacacacccacacatgccagaggtccctcctcacagaggagagggcctgtgtctgtagaaggttaaagctgacaacatgtgaaacatcccagaattatgactcttcccaagtttaaaatacattctcctcatgagagcagaaggtttgttgctgtgttgtgaatgatgagctgcctccatagggaacccactgccacctgggccagcttctggagcatgagaacctgagccagggtcacccttgtggggcctggacatgacgcacgctggctgcgactaggagcagggctgcctcttctccctccccaaggtctgcttgtgggcacgctctgttccctcaggtgccattctcccagggcttaggcgcccataaatgttctttctgtggtggagtagggcctcctgcttccatactgtcgcatgggctagatctcaggtgtggtgttgagccaccttaagatgagggctgcttcgcagtaaagtttccagcctgggcccctcttgggccttctggctggggaccctcagcctcctgatgctgttgcagggcaggtctgagagggtgcccagcagcacccggtgtcagggccaccttgttttccatttttgaacagcgctccctgtggtttgtgcccactgctcaatacagcctccgatcctcactcttgaaagctccatgataagcacagagatgggcagtgtgggtcagaaggtgggccgcttcctgtggaagagggaagtgtaggtgaatagatatcaaaacccctgatgtcattcttttgaggggttggattttcttttttctggcagacatttcagtacattcacatttctctcacatttgctgaatgtgagatcagaataaaggagatcggcgtttatttcgt

SEQ ID NO: 36150 - DNA, 10211 bp, Homo sapiens
gaagggtcgggggatccctccgccgccagcgcgtggtcccggccccctccacccgccgtctcggccgcggccagcagcccctgccccccgggggacgctgacggccgcccggcgcgccgccctagcagacggacagggggcgctgcgcgcggcctggggcaacccgggccacaggggcaggaaagtgagggcccaggtcggcccgggcgtgcaggggccccgggttcgcagcggcggccgcggcagcgatagcggcactagcagcagcgggagtgccgggttgagccgggaagccgatggcggcggctgcggcggctccgattcctcgctgactgcccgtccgccctcctgcatcgagcgccatgttaccgacccaagctggggccgcggcggctctgggccggggctcggccctggggggcagcctgaaccggaccccgacggggcggccgggcggcggcggcgggacacgcggggctaacgggggccgggtccccgggaatggcgcggggctcgggcccggccgcctggagcgggaggctgcggcagcggcggcaaccaccccggcgcccaccgcgggggccctctacagcggcagcgagggcgactcggagtcgggcgaggaggaggagctgggcgccgagcggcgcggcctgaagcggagcctgagcgagatggagatcggtatggtggtcggtgggcccgaggcgtcggcagcggccaccgggggctacgggccggtgagcggcgcggtgagcggggccaagccgggtaagaagacccggggccgcgtgaagatcaagatggagttcatcgacaacaagctgcggcgctacacgaccttcagcaagaggaagacgggcatcatgaagaaggtaccaagccggggggctggccggccccggggcccggttggggtggggatgtgcaaagggagcccgggaggaccgcagagccgaggcggaggtgagaggctgcgagtccgcaggaggtgtgtgggaggggatggctcctgcccggggagggccgaaggggaggggccgccggggaaatgtggggagaggggagatcccgcgaacgctcgcaaccgtggggaaaggcgcagaggtgggagtgaccggcgccagagaggaagagggcccttgctgagtgaaggggtgaggagcggtgatgggaggctacgaggctgccggggaggtggataatgagaacccgggatcagtaggtccagtgcactccggtgttcggacgagggcgccggaaaagcagggagcaaacgagaaggtatggaggtgaggaggctggagctgcatgacaacaatgagcgaacatgtgtgggaggaagtgggcaccacgagagtagtgctggttggaaggacaggcagggttagggaccaggtaagggagcggggcaggagaactggtgctgccctgagcagcaggaacctagtcctgcgccggccgtgagtcttccatggcatccactgggaaccacatgctcctggcaggacccgctgcagaatctcctgccgttaggacaagtggggtttccagccctagggagaatctatgcttggatggggtttgggggaagtcagggaggcttgcagaggtacctaggaattcctcttctgccagccagtgaaaagtgttgaggaaaggagtcattttggggtgtagacgataagggaagagatgaaagcagaggaactgggagacaaggagctggatccttgggaacactggctggtgtttatttctgtcccatgtagaaaccagagctgcttccaaggtggtttgcagaactttgttgggagagtatggcatctatggggccatccttgaaggtccccttcctgggctcatggcaggatgtttagtgctaatctaggtctcgtctcccatcactccagacactgttgtatcagtgtcccttgtcacttgatcatcagtggagaagattgtggggggaggtaattaaggaaaactctcttctctccttccataaccttcttcccaagacaaaggagtaagggcagtaaagtattacagggcaaaaggagaaactaggctgtggcaacaagttggagcctgtgcagtttctggaaagaaacatgggacagttggagcttaaatggtccattatcactaatgtcttgtacaaattccagtgtgataggtagggatccatcctggtccctgtgacagtgagaaggggtgaggctctgggacattccaggcactaagctgtgttggggagcagctagctgggtccttcgtatcccctgaagttatatgttccatcactgggggctgttactgtttgcttggggtatcttcaggtcaatggggctgctcctcaaaggaggagcatgggtagttttgctgcttccagagatcctgataggacaccctgccctcagagtcattagagacgaaggtcattatgggaatgggggaatgacatcactgtataattctttttccaacttctcaaggaaggtagagataaaaagtttgctgacctgcccatctccctcctcacccctcaggcctatgagctgtccacgctgacagggacacaggtgctgttgctggtggccagtgagacaggccatgtgtatacctttgccacccgaaaactgcagcccatgatcaccagtgagaccggcaaggcactgattcagacctgcctcaactcgccagactctccaccccgttcagaccccacaacagaccagagaatgagtgccactggctttgaagagacagatctcacctaccaggtgtcggagtctgacagcagtggggagaccaaggtgtgtttgggttgcctatgtgagaggagggaagggagtggggtccctctccctttctggcccaggacaggtggataggtgcccaccgatgtggagtggagccggattaacgaccctcgtcctaggggacaggtgtccatcctcactttcctgatagaagaccgcccccctagataagcgggcggcctccgtgcccatataaggccggcttgggctccacgccggcctcccgcccgcagcccgcctgcctggcagggcctttgcattcctcccgccagctgtctccccgctaggggcgggggtgtagtttagcccggccctccgggctgggtcgccagggagtagaaagggagcactccggtcccggggtcctgggaatccagcactcttggcaggcgggctggttgactgggccggggactaccttacaagccagccgctgccctttcagggtgttgggggcctgggcagttagggagcgcatttgcctgctgctagggatgcctgcgctgttactcctcccccttccttttcccggtaaggagagggggtggggcttcctcccttgctgtctggggagctccaccttccgggtggcacttaactgactggccaatgggaggaagcggcactgtttgccttagcaacgcctctgccaatcaagggtcttgggcccagctgctttgcaaacgtctcgtgctgacccaccccgcagcctttgagcctctggttgactcatttcgggtctgggcttggtggcttggttctcagtttccttcttccccttctaagaacgaagtcttccttaggggagagtcagtgctgtaggctacctcctctcttagtggcatatcatctgtaataatttttaaacttttataacagtagggctcatttattcccaggaaattttgttggatgagtacattcttttggtagtttacatcttgggtgtttgacatatagtgtgtcattgccagattctcaagatctctctcaaactcttaagttccctgagaaactcagttcctatctcagaagcctgacaaattagagctggaagaactctttgaaagaaaacgtagtagcccagccccctcatgcttatagaagaggaaaaccgaggttcagaaaaggggactggttatttcagggtcacttagatggtcattaccagagctaggaacagaccttggtgtcctgactccccagccaatgggattaccacagtccgctggagcagagaactcaggggattataataatgacaatgataataattatcataagagcagcaaatatttattttggtttttttatgtgccaggtagtgttttctaagtgatttacatatgctaacctacttaatccttacagcaacctagggggtaggtattatcctccttttaccgatagaaaactgtagctcagtagatcaataacttacctaagagtcaggcatcaggtaaatggtggcgttgggatttgaacccaagctcactggtttcagtctgggttctcagtccacacaaagcttctgcaaaggcaggatctggtaggggctcattgcttcatctttactctgggtataggacacactgaagccggcgttcacagtcaccaacctgccgggtacaacctccaccatccaaacagcacctagcacctctaccaccatgcaagtcagcagcggcccctcctttcccatcaccaactacctggcaccagtgtctgctagtgtcagccccagtgctgtcagcagtgccaatgggactgtgctgaagagtacaggcagcggccctgtctcctctgggggccttatgcagctgcctaccagcttcaccctcatgcctggtgagtcacgaggggcagggagagattcgtccttcctggggcaaatcaagcatgctaagagtgtgtttagggctggcaccaagagaacctctttccctgctcagaaggaaggtgaataggggccagagcctgagcgaagcctcttatatcccgttggcaggcatacctctgcccactgagacccctgctgtccttgtcagtaagtttcaaccatatattctggccctgtctagctaccccagccccgtgccctcattgccacagggcagtagatgtttcaccacttcctgccttgactggaaggcagatcatgtctttgatgggttattgccagctcttgggtcaactgaagaaaagagagacaaggcccagggcaggaggaggagggatgggcaagagtagagcgtggaagcccccagagtggatacttgggcctgaagggcctctttggcttccaggaaagatagtgatgggagttggagaccagtgtgccagaccctgggactggggtgtccatgggtacttggtggaggtggcaattgggtgggacagagcacaaataagactctgtgtcttgcaggtggggcagtggcccagcaggtcccagtgcaggccattcaagtgcaccaggccccacagcaagcgtctccctcccgtgacagcagcacagacctcacgcagacctcctccagcgggacaggtatagctcgcagccctgtcaccctccctccctgccttcccccacgaggcctagcagtaggtgcccaacagtaaccctcctgtaactaaagtcaggggatttcttaaagtggagattgaggctttgggcctaataattatggggaagtcaggtgaggatgactgggttttgaatcccgccctgcagtgggctgcggattccagaagaaaattggggaccattgacctacctcctcattcagatgaggagcctgaggcctagaaataagaagttacttgctcaaagacacatttgcttaattatcaggaaggacttagagagcaattttctctttgtgcgagggtcttacaggttttgagtagccacagttaccctcaggtatctctagacatttcagaaatgatgagatactctcaaagtaaggttaattttaagttcttattatttataacctttttactcaaagtgtggcctatggactgggaacaccagcattacctgggagcttgttggaaatacagaatcttgagtctcaccccaaacctagtgaatcggagtctgtttttttttttttttttgagacggagtctcgctctctgtcgcccaggctggagtgcagtggcaccatctcggctcactgcaagctctgcctcccgggttcacgctattctcctgcctcagcctcccgagtagctgggactacaggtgcccgccaccacacctggctaatttttttgtatttttagtagagacggggtttcaccttgttagccaggatggtctcgatctcctgacctcgtgatccgcccacctcggcctctcaaagtgctgggattacaggcctgagccaccgcacccggcccagagtctgtgttttaacaagattcccatataatgcacgttaacatttgagaagtgcttgtttgaaagatgaatttgttagctgtgcattaagaaggagagagaggccgggtgcggtggctcacgtctgtaatcccagcgctttgggaggccgaggggggcagatcacgaggtcaggagattgagatcatcctggctaacacggtgaaactccatctctactaaaaattcaaaaaattagccgggcttgatggcaggcatctgtagtcccagctactcgggaggctgaggcaggagaatggcatgagcccaggaggcggagcttgcagtgagccaagatcgcgccactgcaccccagcctgggtgacagagtgagactccatctcaaaaaaaaaaaaaaaaaggagggagaatgagaacaaataaaaaataagatgttagagctcctaaaaggggagtatctgagttttctgagagtaggtcagtcataatctttgtttttcccaagatttaggacttagagaattcagtagatagacaattgaataaatagtacaatgtgataggatacaattaaagattgatgctgttgtgttcaagaaaaaataggcttttcttagttgatgatggagctgaggaatagtcgtgtctagcttctgacctgggaaatggcaagagggctctgggggcctggaattcctagggacggaatgggagttatcagtggggaccagtgccgagctgacacatgtctgtgtttgccagtgacgctgcccgccaccatcatgacgtcatccgtgcccacaactgtgggtggccacatgatgtaccctagcccgcatgcggtgatgtatgcccccacctcgggcctgggtgatggcagcctcaccgtgctgaatgccttctcccaggcaccatccaccatgcaggtgtcacacagccaggtccaggagccaggtgagtagaggagcagggctaaggaaaggaggaccgtttccttctttatacacacacacacacacacatacacacacatatgcactgatgcctacaaatatttctacccaaatacaacacagacttggatgctcacacacacatttggacaccccacttggacactcacacccgcatgcaccctcagacacactggcaccctttcccttgggctcttacatctgagactgccccagtcacttgtgcatttgacaccactcctccaatatctggaagtttcaacaaacaatttgagtatctcctgtggttttccaatgtaggtggcgtcccccaggtgttcctgacagcatcatctgggacagtgcagatccctgtttcagcagttcagctccaccaggtaggtagggatatctttcaccccatcccagatagccacttctttgtcttgaccttaggggatcctgttaccagttcatcaaagccaaaatccctagcctggaagcccatctgcttttctgctcaggcctgtggttggcaggcagggaagccaggggagcctgaactggctggccagtccctgcccctcctcatacatccccttccctccagatggctgtgatagggcagcaggccgggagcagcagcaacctcaccgagctacaggtggtgaacctggacaccgcccacagcaccaagagtgaatgatccgcccgccgccctggacagatggcccaagggatggcaccacttatttattgttgccttttcacgttttctttacacacacgttgacgggccgcaggagggaggcggggaggaggaacgggcagccacaggactgagccctctcactccagccaaagaaatgggcctgcctgcctccacccgtcctccctcagcctccccttcttcccgccccacctcccatttctgttgctggaggggctgtcctccttcctgggaccccctcgccagcttggctcgatgtttgccatgagtattagcttacccaatgggaccgtgccccacctccccacacacaggccttctgtggggctgggcaccgtgtcctcctctgaggaagcagttggggccctcttgccagcctccttgctgaccccaggtcagccctgtgtctgtcacaggctgggtcaaaagagccctggctctgcccctcagggggccagctggggagatgggggcttcttcctcacactgctgtcctctcccccttcagctcctgagtagctgggcctgtgcactgggcaggttcctggggccgcctgccctgccttgccgctccccttggacctccaggggctcctgggttggagggaaccaccagcgttcccttctcccccttgtcttcccccctctcctcccagctgctttacttaaagttgattttgaactttttatttgaggagacgaagtgaaaacaaatctataaatatatatttttaaaatatttaacttttttttatggcgtttttctcgtccccctccctgcccaaactccccttccctggggagccctcaggctccccagaactggctgggcccctggggacagagccaccccatgagctcggggtccaccagtgtgtgggggagattctgggtttgcccagtcctgggttgtttccaggagaaagccgggggaggggccctcaggccattccccaacggggtggggagggtgacccacagctctgggcctctttttgccctttagggctgttgctagggagagggaagagggagaccaaatgtcggggttggggtgggagggcgtcaggcagaggcaactgacttcatttgtgccacacgcatgggcattgcagccttgcgctgtcccaggcatgcagctgcctggggcccaagttgcagtgagcagggtggggtctgggagggggtgagaggcaggaatgggggtcagaagaagtgggagcagcttcttgggctgagtgcagccaaaggggagccagaaatgggcagttctcccagggagtgagcagctactgtaacttttttaaattaagacaaaaagccttgaagaaaatgactttatttttctaagtgtaacctcagtatttatgtaatttgtacaggggccatgccccacccccctcctccccctttggggtagaccttgagggtgggccagcataggggggagggtcttttaccctgtgtcagagcctaccttcaccacctatatccagaaggggagctttttcagaaacagggcagcagtggggtgaaattttcttaacccctaagactgccttcagtaggaacaagctggcttctgtgattaggtgaagggatgggggaagattttatgcacagcctagttatcaaggggatgatttgccgacatgtttgagaaccccctaacctctaaccctcattgctgtcttgccccagtttggggtgccaagatggaagtcacctttctgggctttctcctggagatagctggggcttatgggtggctttcaaggctggggcatggcaaatcaggggccagagagcaggggagcttgggactcaggtctgtaactgcccagccccttttctctgctcttgtttcactccaccatcactcactcactccccactcccccacccatggggaggagacctttgatgaattcttcctctccttcccacaaaagacagacccagtgagtgaatcaggcaaagtgcttataatgtgtgttgtgtgagcgtggccttgggaggacatgcgtgtgtcagggatgagttgaggtgatatttttatgtgcagcgacccttggtgtttcccttcctcggtggctctggggtatgtgtgtgtgggtgtgtgcgcctgagtgagtgtgtgtgcttgaatgtgagtgtgtatgtcagtggtttctacttcccctgggatgctgacccaggaatagtggacatggtcacagtcctatgtacagagctttcttttgtattaaaaaaaaatactctttcaataaatgtatcatttttgtgcacag

SEQ ID NO: 36151 - DNA, 36672 bp, Homo sapiens
gtgtcccatagtgtttccaaacttggaaagggcgggggagggcgggaggatgcggagggcggaggtatgcagacaacgagtcagagtttccccttgaaagcctcaaaagtgtccacgtcctcaaaaagaatggaaccaatttaagaagccagccccgtggccacgtcccttcccccattcgctccctcctctgcgcccccgcaggctcctcccagctgtggctgcccgggcccccagccccagccctcccattggtggaggcccttttggaggcaccctagggccagggaaacttttgccgtataaatagggcagatccgggctttattattttagcaccacggcagcaggaggtttcggctaagttggaggtactggccacgactgcatgcccgcgcccgccaggtgatacctccgccggtgacccaggggctctgcgacacaaggagtctgcatgtctaagtgctagacatgctcagctttgtggatacgcggactttgttgctgcttgcagtaaccttatgcctagcaacatgccaatgtaagtgccttcagcttgtttgggggagactgggtagagaggttagatgggagggcaccctgccctgaaaaggaaaacctgtaacctgaattccaggtacacttggagggcagactctcaggcatgtgggaaaacgccggaattgataagaaacatggaaattactttaaaaaatgaaaacataaaagccttgccaaaagttagggaacttttcctctaagttcagagtgagacagttaactcggtctggctcctcagcttagtaacccccaaagggagcggaaggtctttttccctaaggatgagatattaacgaccaatgtggtggaggaagtcaagggcctgcaccccacaggccccataaccgcactgatgtccaccttgtaaaacttgaggcctgcgttagaaagcccttcaactgagtaatgtaaaactcacctcctaagagcttttatcttctgggcattgtaaggcttgtccggaggaggaggatgacgatgctgatatgatgatggttataaggcgccctctggaggaaggaaaatgaaagtacaggggacagggccttaagcagatggaatcccaattaaagcttctacggatttatacagattaatgatcagcatttctggttggagcctttcccagtggctagtcagtgaaccctggaaagaagaatggatgctacttggagtgggtacattctgaaaagtaatataagtgtctcaattcactttctagtcatggaaatggtaacattttttaactcaaatctgctctaaattttgtttgagcctgagaattacccctttgacatgttcccagtgataagcaaacattatgaacgcagcaagttgagaaatatcaacattgagatgagactcaagagaccggggtttttcccatgagtctgacaccaatttgctgcgtgactttgggcaagtcaaacggccttttctaaaatgtgagacagagattaaagggaccccaaggccactttccagctctaggttccatggccagactttcatgtcaacagagaatgaagaagatcagtccgttttcatcttgaaaatggctgccaaagtgctagacaaagatattgactagatgggggatggtattgtctgaccacacccagtactccaaaaagttgttccacccacacagcacggtgtctaccactgcataatttctaatgcatttgtgtgcttgtgtgtgtgtgtgtgtgtgtgtgtgtgtctgtgtgtctgtgtgtctcttcccccttcattcacttttagtatacatactgtggatactaaggagtaattgcagtgaacaaattcacattaccgagttcatatttttaatgagatcttgagagtgggaggaaagagtcggctcctagagaataaaatgaaggcagacttagggaaatttgaaggtacaaaggcaacttaccttctgatcaacagccaaccacagtctggaataaatgttatcaaacacacattcttcaaaatggtccatgtctgagtaattaaaaggcaaatttccaaaatcataaggacttccgttaatcaagtcaggcataattattcttcctactgatggacacaatgaagtaaacatatcattcttgtaatttaacagtaattctcgtaaattgcccttaaatgtcagtgctggatgtggtccaccctcctaaattgtgactgttgcaacagatgttctcacttcaaataacgcacttcttggccacctaattaaagcaatttttggggtgattcatcctactgcaagcttggccacacttgtatcctgtattaacctataatttttgtaccgtaggagaagaattcactctttaaggacttataacaattatggcaaaaggggggatagtacttttgtttattttttctattatttttcaagatctttaatccggtttttccatttatacaaaactctttctccgagacaaaaatgatacatattggtaaaatgatcttacctaatttaagtgaactaatttaaagcaaaattcagatgtctgaattaatccattttcatagttaataatgtgcaaattagaccttttgaaaaaggatattaagaatggtacaaactcaatgaagtactaggtaacttcaatgttttataaaaaagtaagtcagcttcaatgtttcataaaaaacaaattcaatatagaattttaaggtaacatactttcctaaattttaccttttttcgatatttaggtattaaaaatgatcaaaatcataaattatttcctcatcaatctactagtcttacattcagcgattcatctgtgcactttaccagcttaattgctaagcattcaaaatatccttcagacacattaatatttcacaacagttataaaatagtaaataattaataatttaattcaaaatacatttacatattaatattgcaaacaaatcaccctgctgatccctgccatacttttgacctgcataatttctaggtcattaaaatattcttaaaaaaatataattggtccttaattaggtaattcaattctataaacttgtttctctatttgttaattattgctattgatccatgaagtgatactaataattgtttcctactttttcttttttttttctacagctttacaagaggtgagtaaaactttttttagaatttttaaaaatactttgattcccttggctacagtgatgtcttctcttggaagggaagaagttacattaatattgaccatcctagattcccaagaaaattgtgaagaattatgatagtcaaaacctttctggctgccttagaaagtacccacccaattttccaaaataggcggggctactgaataagactaggtttataaaatattcataagaaatatagagtaaataatccaatagaagtttgagttttaggatcagcttctatgaagcagaagatttcactgagctagagaatcttttcactcctttggaattatttgcaaaagcacttattgttaacacattcttagctcatgagttgaatttgaggcataagtacaggtacgtattgctatgtattttttgttctgtaggtacatatttttatttgacatgttggtaaaattttaaattgtagtttgaaatattaaactgagataatagtaaatgcataatgtaatgaattgtgaaggtatatttgtatactacaccaaaatggaagctgtttttaaatatatatatacaattttcttcataataatctttgatttattcttttctaggaaactgtaagaaaggtaagagtacactacttctccataaatatctaaaattatcagggataacataatttaactaaatttatagtagactatagaaggaaaatactttatcaaaattttgttcatatgaatatacattagctaaagcataaaataaagtagctttgatgtttaagataacaaagtttaattatcttctggaatcatctgtaattacatttatgtgatacaaactggtgatttacatacaaaaggaaaaaaaaagacttgtttttattctggagatggaaggcatattatgttaattatagggagtaaaaaaagtttattttaaagggctttgactatataaatgtgctgttaaaaatgtaacaaaatgatcatttaatctacagttatcatcttattcaaaatgctatgcatagtattgacctaatagctgaagactatagcagcttccaatcctccagctgaaaaaaaattacgtataattacaattaaaatatatacttttatctattgcattgtgtcaattttttatatgctatctaataacattgtagttacatcagtcttaccaactaattattatcaagaatgatttgtttgttcactggaaattacttcttaggcatttattattgtcctgtttgtatctttcctgtagggcccagccggagatagaggaccacgtggagaaagggtgtgtaatttttgaactataaagggcttcgtcccgtatttgaataactatatgttagaaactacaggaactggcaatttataagaatattatgtatccagataattgtacacccctttaaacaggtaatgcactgcagaagaagcgaatgagcattattatatatgatcaatatttgttttaggtcaaaattaccgttaaaaaagaaaaactgttacagtcatattctttgcatggtctactttctttatttgtaattgacccatccaacacatgcataatggaaatatatctacctaccaccacagtcctctttttaacacatttcatttgcttttgaactaagatcccttaggtagcttggaaataatagtgaattagtagtcagtaacatgtttctctgctcaaattcatgcatgtacaagtcaggcttacattttatttgtggcattcttaaatctccctgctatgcttatttgacatttataactatgtggttttgcattgtataacacttttgccaatatatgaatacctatatcttatatctattaggaagaggagacttacatgtatttcactcaatttattagaaatagaattaaatcagttaattattttaacaatacaagtagttaatgatagtaaatctgcaggattttctctcctatgataaagtgaccttattaactgtcacatcagttaattcattcacatgtaacataccaaaacaattgaatcagtttgtcacagtcagagatcggcaataaaaatacgatgtaagtccttgtgcactgttaaacatatgaagcacgtggaaccatacattttggctataatttttatatttgaatactggagcttcagtatgaattaatattcaatggccgagatagttctttaggaaaactaccctgtgatatcttaagagttattaaccctctttctaaaatagactcataagtgaatttcaatcaatgacaaatatagtatattaaatttccaccctacttgcacatagaaaggtctgaacaactgatcttaccacatataattcttaggtttctacagggcctgtctaacctgaccttactcactttttacataacagggtccaccaggccccccaggcagagatggtgaagatggtcccacaggccctcctggtccacctggtcctcctggcccccctggtctcggtggggtaaggtgtcttacgtattgctaacttttagctaacttcagttgaaagaaggtttattgtggaatttatttttagcagttaagggataattcttccatttgaaaattagtatattttatttcatttatttggttttttcactcaagattctgctttacccattctctttgtgagcccttgtcaattacaggactggtctttgtgtgcactgaagttagctgtggccatcattaccattatttaatttggagatttaatatcttttattagtaaggcacaaataagaggtgttgcattattaaggattttgattagattgaactgtgtaagtgaaatccctgatcttaagcaattttacaaacatcctacgctttttattctccttgacttgaagtctgctgaaccaacattcaaagcggttttaggtttaatttgcttgaaactaatttgagaaaagtacatttccctttttcattaatatcttcttttagcttcatgtctttaacaatggtatgagtgccaaatgacctcactgcaggaaggaaaacatatttgcttaattggttagcactatgaatcagaagcctgattctaatacccaactgtatgtcagtaaaataagacctttctcccccaaagatcttattatgattgcttatctatgaattgcattaaaaagcagcttctttaatagagctaccactataagagagatctttaacagtaaagttattactgtgaactagtttttagaagttttatcttccaaggggtattttaatttaattttcctctaaacttgaaaactctttatgcccttcctgaaactccagcaagaaaaagatctcttagtcattttgtgtagctccggtggggaagggcaacaggtgaaaatgtgaagatgtcctcttgagctctgtctaatttgtcaggagcccttagtaacattaaaagtttagaaagcttcccttcctcagagtagaggtaaaaggtgggagtggagacaccgagttaaggcagaggaagggctcaaaaagtaaagtagggaagttctccatttcaaagaggtgtcggccaagtttttgacgtacagctctcataactttttaggaatttagttcaatatagaattttaaactaataattatatcaaaaacattgccctcttttaaataacaacagaaaaatatttacaagtagaatgagaaaatgaactacatgactagtaactaaaaatattttatatatatatataattttttttttttacttctctagaactttgctgctcagtatgatggaaaaggagttggacttggccctggaccaatggtatgcttatctgtttatcttagccaaaaaaattgctaaataaatcattcattttatgtcacattttaccacgccatttatttagctacctaagttaacactcaatacttagattatataaaaacaactctttttgttttcaaatttatgaaaacataagttaaggagttcacttttctttacaaaagaaagattaattgatcttttatgattatatgatctttttgattatatgatcctcattaagatagatcatatacttatgtccaagaaataatctttggacatagtaaccataacttgggcaaatcaatttaatttaaaacagtaatcactctgattaattttttaatattctttaacattgcttagaattttaagcaacacttagaggcatagaactatttattaagttctctgaacttgttggaaaggatcaacaagttctatctagtccagctaactcattttaaaatgggagagtttaagcccttttctcaaagtcatccaggtaactaatgacataactagaactagatgccaggcaagatgtctaatatttgcttacatcatggtttatgtacctagtccttgaataaaccactcatttagtcaacagatattaatcagatgccttcaatgggccctaaactgtattaggaactggggaaattacaaggaatatgacagattctgatccttcctcaaggagttaacaatataggaaatgtttctttttctgaattttgaccaaaaaaatccttttttagtctattgattgtaaatctatatagaagagagtatgagtaaaaatctagcatttatgtcactcagtacaaatattcagcaccataccctatcagtggagcaccgcttagaaacattccctatatgatgatgatgatgatgatgactattaacaaatgaagcttctaacaagcattagagagaagtttgaagggaaaaatgctaatacgagcatgcaaaatgtatactagcatatatgaaatagaggggaaaactgccagaagtcaaagtgttaggttgattaagcactacagaatttaatgtatacacacacacgcaatttagtgattttaattaattgtttcaaaacaaaggtatttatctgcccaaagtcaacaaggtctttaaaatgtaaattttacctgggcagtgcacttagtgctctatcttcaaaagaagatgttctgctggagctaatggcccacagtaagctaatatactctaagggtgagataatattttctgtaaattaaaactcccacttgagaaataatgtacctttaattgacgacttctaattccctaattttttctggtagtttaaaatgttcatatctgaaatgaaaaagtagagtgtttcttttggctttgtttatattggatttttgaaattagctgtttcagctaatgctggacattagtcagttttaaagcagtacctacatctcaagaagaagcaagggggcggaaagtaaagagctactaaatgtcatttttaaaaagcccactaagctgggaaaattaatatggatttcagatacccctgttttcggaacatctgtcttggcataaagcagagtattttactttgaaatatcagtgaaatataatttaagcttgcacatccacacacatgcacagacatatgtaatcaacagatatctgtttcacaaatagggaagataggcagcaataaagtattaaaataatttccatgttggaaaatcaataactataaaaccccacagggttcttctctgaattaatgagtaatcacagcctccatgaaatacactacattttatgtaaatgaaattgttgcaaatacatgaaaaaataaatataattagaaattcatgatgtcaaagaaaattattttttaatgtatgcctaaaaagctattgtgatggaaaagtgacagtttcttttaatgtcagagcaatttctaaaaccaaatgaataattcttataattaaaatgacatacattttagataaaatccatgttatttcactctaggcattaatacagtaaggtaggtttgactgcagagtccccacagctgatgtcatgaacaaattacttgagactggtacatgaaatattttcagcattatgaggaacagaccctacggatgagcttacacaggcactgattactgcaaagaggagtcaagaaagtgtatttagcttacaaactattaacagcctgttttaccctacttttgtgctatggaaacaacaaaggggaaaacaatcttccatcatttgggccatattttcaacaataatatcatataatagactcttccagaaggctgtttcaataatgttttatttttccttcacccctcattacatccacttttgtttgacattttcatcagtcaccaataacccttagaggagcgataaggttataacaaacttctctctaatcattaagaaggacttttgattcttttcaatttatgtcctttgtggcaataaaaataccaatttcttagctaaatatgacataggaagatgacatatgatcaaagatatccaaatggacatgcttcatctgctgtatagaagacaattgtatattctgcacttctgcaaagactgattcacttcattgcatcagaacaatctcaatatgcccaattgtgcacaactttaaggaacctatctgccccgtctaattctcattgatttctgttgataaggattgggagaaaaggaaaagcaaagggagagaactagtgcaggaagtttgagtccttaaattcttccttgggaggaataaaaactatggaatcaaaccacaacaatggcactgctaagttggtcatatctgaccccagccaacaccatgacaacttatcagtgctaactgttgatatatctgctttctttacagggcttaatgggacctagaggcccacctggtgcagctggagccccagtaagtactgaaagcttgtaatgcctcttatgtaaaaagacagagaattaagaaataaaggcttggagtatgacattctttttttcttttagggccctcaaggtttccaaggacctgctggtgagcctggtgaacctggtcaaactgtgagtacatttttccacctttgtgataagtttttttccaggaagtttatgaatataaccttagtgaaatgatgggtctcccattttcttagggtcctgcaggtgctcgtggtccagctggccctcctggcaaggctggtgaagatgtaagtatttactcttaagcactttcaaaatgctatttaaatactcttgcctcaacaagattttctagattcaaattaagtattctgccaaaagctgaatatgcctgacagaactcttaatgtatgggaaatattattttaatgaaatattaactaacctacttgtattaagggaaagattaaatatatatctggatccatatttttatgtgataactttctccccttttgtaaaaaccaagattcccccattttgtctgatagtttaccaagaagaagttgactctacaatgttttcatgtttagggtcaccctggaaaacccggacgacctggtgagagaggagttgttggaccacaggtgagactttttacattggtagatagcacaaacatcataggcctataagatagttgctaaaactagcatcaatctaaatgacaacatagatgtcacccaaactcataacatgaatcgaaggcatctaataaagaaaaaagcctagttaaaaaaaaatgcatatacattttattcatgcaaataatggaatataaatgacagcaagcataccataagcaactaaattgtgttttctacaaataccgtattattagttactcacattagagcaagttaatttgtcactctgtgcttagaggtatactagactttggttcaaagcttgaactttgatgagaataaatactttggagggaagaagtcactgtctttttatttatggtaaaacattattcaccatcttctgtatttctttctaagggtgctcgtggtttccctggaactcctggacttcctggcttcaaaggcattagggtgagcacattctttactcagaagagagaaaatgcctattaatttttggaaaaaactcaagtatgtttaaaatcttgggtgacatatactcactttcaaatccctggagtttgccaaagggaagaaagagttaaagagtcagatttcttgaaagtaaagtggggtgcaattttttcagtctgttcatagctaccaaaaaacaggctcactacagagaaaattatatagaacatgtattacttattgagtatttacaaccgtctgaaaatcataaaattattaaggatggaaaagatgtgagagaacacctagtcctccatccttctctctcaatggcaagaaagttaagtgacctatctagggcaatagactgagtttgctgggacctggaacactggacttctttctactgcagcagacaagacttacccaagagagattaatggcaaagatatacaatacaatttttatttgaccaaacactatcatggaacagcattttataataaggctttcctttcagggacacaatggtctggatggattgaagggacagcccggtgctcctggtgtgaaggtaaatattaaattagaagcactgtttttaagcacttgattgaaattccccatgacctccaaaaaagtatattatactgaagactacccatattacaaaaagtatttttattttttttctttcctgtacttcaaatccctcaaggatggggactatgagagtctgtgaaaaaaggtcaattattaatatttattaaaattcaatatctattaaacaattgagataaaaataatattaatagtttcttgttccatttcctttcctccctctataattccagtgtatctctgcagccaaaataaaagtaaataaacatataatcagagattacgacactctgtattattttaaactgtaaattctcctttgccacacactaattagataggtacattcatgtcgctatacacttttcaacctctttcctgtgatttatctgtgcacactcaaaaaaattttaattaggtaattaaagtctcagaagtgtgttatctcttggctaggctcttctctgacagcgttttcaactataaaatgttctctttcctattaaggagataatgtgatattaaagtgaataccaacgtaattacaaattaatgagtaacgaatactagcgggaccagaaatgaacatgaatatggagaatctattctaactttccagctgccacacaaatggataaggtcaaactcattctcccaagagcccgatataacagctcagactactaatcactgtatcataaaatgttagagctgcaaggagctttggagaccccctcattttgcagaggtgggaaactgaggcttcgtgagagcaattgacttgcccaaagtcacacatctagaggttagaaagtcataggctagaaatgatccccccttgccacttcaatgcttattcccaaagaatagacttcacatagaatcctggaaattaagggtccttatgaggtctcttaaaccatatttcccctatatctaaatcagattatctttaaaaaaagttcttttacatgtgccatagtattaaatcccactactactactactactaccctggtttttactcaggataagaatatagattggaaataaatatgatggctctaaaaaataccatgaagcttcaatttttcatgcacattttatgaaagtgataacactgagtgttcaaaataactttaaaaaggataaatatggttacattgaaagcaaatttatcctttgccatctctttttatgatattgtttctagtatataattgatatcctgaatctaagggagaaattggggaggaggtacactcaaataaccacatctccttagaacctggatatgtggtactatctgaataaaaactcatgttagcacattttaaaatctgtgtgtctggcataattgaaaaacaatctatatgtgtaagaaatattatgaagtatatgaatggttcaaagtaaaaaaaatagagtaaaattgcactatcaggaaaaataattgttatatttaatgaacaaaaactcaatccttctccatgtagggtgaacctggtgcccctggtgaaaatggaactccaggtcaaacagtaagtattgactacttcattgtaaatttaaatgtgtacactctttatgagatggaacttctttaatgtttttgctaatcactgtatccttcagcattgtattctttgatgtttttctaatagccttctgatacttaattgaaatccactactgtttagttggaattagaaggcaacttatttatttttagtgtattcttgtacaggttggaaactgaacaaagcaaatgatgcctgtgactttttttaaattagcattctggattttattgaaaatatttctgcttctagggagcccgtgggcttcctggtgagagaggacgtgttggtgcccctggcccagctgtaagtgcttccatttttgttcagtttcatccttttaaaaaatcttctaatggctgtcatttaagtttccacctgatcttccctttattttcttcttagggtgcccgtggcagtgatggaagtgtgggtcccgtgggtcctgctgtaagttttgacactggggagtttgaaaggagttgagaatgtggggtgggtgctgtcttcttcattaatctcttacgaaatagcatcatttcagacactttaccaaatgttctgtgaggtcttttgaaggctccatttataagtagtgtaagccatttataagtacctgaacttttgattgatgtataaagcaaaatatccccaccctggataccatgaatgtcttgcctttgatgagatcctaacgacaacagactggttgtcagtttttttctttactaatataaacagtgtcatgccactgtaagcaacttcaatcttctgccattgttattgttttcttaatttacttggaggaaatttcttaccaccttctgctttgatttcagggtcccattgggtctgctggccctccaggcttcccaggtgcccctggccccaaggtaaaaacactggtgaccattgtcactactttgataaactttttactgtgatgtgaaagattggaactgtgtttgcagataaagagataattacgaaacagttaccttaattattccttcccttcaaaatggacatagaatgaccagttttctcactctacatttgaaatagatcatttctctgcactgtgcactgtgcccatcgatatagatgacaacatggaaattgtctctaggactagttagttaggactgactgagaaccagagtcaaccacagagagacagaaggagagggaaggtagtaacagtagccaagatggcagaatcaagcaaggaaaataggaaaccaaactcaaatcttgtaataaaacggataagaaaaataattgcaattttgaagttttatgaagacatttcataaaacttggcatcttaaaaacagatatgctgtttcattatttgctggttaattccttggtttaatttcctcttttagggtgaaattggagctgttggtaacgctggtcctgctggtcccgccggtccccgtggtgaagtgggtcttccaggcctctccggccccgttggacctcctgtaagtagccactgtctttaaactttattgagtaaaagaaaacaaaggtggagtatggggaagaagaagaatgaagatggggtcaaagaagaaccgaaatattccaattaactgatatccttctcctttccttttcctcatagggtaatcctggagcaaacggccttactggtgccaagggtgctgctgtgagtatacctgcgtagctaaaatgtgctgctatgattttaaaggcatttaatgtgtgctgcctctacagcccatcacctccctaatggaccacactgcattttccttcacagggccttcccggcgttgctggggctcccggcctccctggaccccgcggtattcctggccctgttggtgctgccggtgctactggtgccagaggacttgttgtaagtggtcatgactgtggttctcatcatcctgaaataccacctctgccatcatttcatcactatctagacttccacttgtagttttattattcctatttttctcttccttagcatttttagtttatatttcttatatatatatgtacactcccgtctgctatatgcacacagacatgcccttcctgttatcttaaatcattacctcaaggtaaatgaggcaaagttctacaatatcagttttgtcccttcgaccaataataccattcccctgtactcaatttaaatatgaacagggtacatttcctagagaacttgagcttctctttaccttgacccacaaatattctaagagatttgtctgcaagagagtttcaacaaatgtttgtcctttgaccactgttctgtattgaaccctagggtgagcctggtccagctggctccaaaggagagagcggtaacaagggtgagcccgtaagtagctctatcatcacacttttataaagttaattgtttttctcattccagtttctccagctggacatagtattaaaattatttttttactccctcttcttttgttcttttcattaaacagggctctgctgggccccaaggtcctcctggtcccagtggtgaagaaggaaagagaggccctaatggggaagctggatctgccggccctccaggacctcctgggctgagagtaggtttcaaatgctcccaacaccctaacacaccagaggcagattatgataccccttcactgggaattggtcaaaattactgactgtgttttcttaggcaaaaaaagcatctgctttccatctgccttattaaatcagtgactctcaatttaatatgttataaaattggcctggaaacaatgttgacctacttttgcaggatgctcatctatgaattcctctaggggttgggtgaagtgttttggcttggtttgtgtctgtatctcccctgtaaggagatcatgctattttttacaaactctaccttatcaaagccaagagatttctttaattctctctatttcatgtactttcttgcagggtagtcctggttctcgtggtcttcctggagctgatggcagagctggcgtcatggtaagctgtctatcacttacttcctagaaaggggcttgctgcttctggtggtgggtgtgtcattagctttagcatcctcctcctctatctgttttttttttttttttgaatagggccctcctggtagtcgtggtgcaagtggccctgctggagtccgaggacctaatggagatgctggtcgccctggggagcctggtctcatgggacccagagtaagtttcaaactgattctgagcaaatcacacctggcattacttccttctttaaagggttggttaatattgaagataacaataaaaacatcaaaagtaaatttgttagtagtcttgctgacagttgcatttttgactttatcaaagctcagtagatattttcatgcatttaattagttcataaattttctatttattacttgatacaatggctatgaggtttttggaagaatagatctattttaatatatccaaattagattggtcctcctatcagcatgaatcttttatcttaatttgtgagttttatataaggtgttcatgaaatatattaggactatacatttttggtttattagattcataagtgaagtctttttcctagcaatcacaaagtgctgtaatgtattcagcatcacactagctatggagaaataacctctaggtccatagacacactaatccatagcaatagagtaatttttttgcctccattgcctcttatgggtgaatatcaactgtaattgtaccataaacaagtaatagggacaccaaatatagcaataagaaatccactttggaaattgtttactaaaagtattagtttttctattatgaggtaaataacgtgatacattttgcccatatacatgttgcttaacagtttcttgagatatctataaaaggatgagttgcactaaatttcaataaaaggaaagccacaaaaaaatagaagaaaaatttcagaactcttttcacacttcccagctagtggctaatattcctaatgatttaccctaggcaacaaacaaaaagtcgggggaaaaggtgcctttgttagacttcagttaatctaaggcttgagtatgtaagttaaagtgccaatataaaaacatcctcatttattttatagggtcttcctggttcccctggaaatatcggccccgctggaaaagaaggtcctgtcgtaagtattgctcattttccattatattttcaaggacacttattgcacccttatcaagtctattttgtggcttatttatacatgaacacattgaaaataaatatcagacacatacatcatctgggaatgcagagtaatagattgtaattatggagtccaaatgaatacaggactgaaagcagagcaggggagagaaaaacatggcagggaaaattgaagcaggtgacaaggggatgcaagagaagggaatgagggaaattgcatacatacgagattgaattggctatgtgtgtactgacatcctagttagaaaaggaaaatggattcataatttattaacgctttatacaagaagctctatgcattcagaaaactattctgtttcatccgtggcagcatcataagcttgaggttgtgagaatatgttgacactgagtaaacttgaaataactctgctttcagggcctccctggcatcgacggcaggcctggcccaattggcccagctggagcaagaggagagcctggcaacattggattccctggacccaaaggccccactgtaagaatcaccacaactttcttaccctcagcactttctgtagccaaattttaccaaactctagtatttatctcctgcgaatcagtccagtctcagggagtttcctttcaacacaggaaaactgcaggccacttatcacattaaaagtttacctctagtgtatccttatatccctgctaaaaatccatctcctgagccccatgcttccacagacacagggacatcttactgtacatggagctgcatggtgatggatcatccttagataacagaaaccacagactagggatctcaaaagaacacaaaaacaagcaggattcaacattgcaaaatcaccgtggttaatttgacattaaatgtgcaaagctgttctttgttttgtttttcatttttactctagggtgatcctggcaaaaacggtgataaaggtcatgctggtcttgctggtgctcgggtaggtgctaacttgtgtacagatctattcacatagcattcatctaagaaccacacttttttttttacaccatctgatatcattttgtcactttcttttcaagatggcatccccaggggtccttttactatcataaaatgcctttttaaaaaccaaacttataaaacagtgagcaaaaacaaatcagaatatacattaggtcaaaaatacagaagcacttggcttttattttattcattttgtaattaaaagggtatgaatatgtagtagcattctctggcctttataaattgccttgtgtcgcatacttcgcttgagtcatatcaaaagttagtaggcaaacccataaatatatatacctactatgtacccacacaaattaaaaatttaaaaagttagtaggcagtatttgggctttcgtgggaacccacaatgagtttaattcatgctaaaatgacaaacttgttttaaggaagtaatacctgaggctttgagacatcttaaactacctggcttgcagctaaccatcagcctttctgttaaatatttttagggtgctccaggtcctgatggaaacaatggtgctcagggacctcctggaccacaggtgagtatttctcccactcttgtgctcttctgcactagaatgtatatagtcctcaaactggccatctccattttcagtccaaaagttatacagctagacaacagtggtgacatacgttgctatttatgctctctttcctgtcactttcagggtgttcaaggtggaaaaggtgaacagggtccccctggtcctccaggcttccaggtaagtcaactcaaacatatacaatactgcctttggtcagcctattgagctgtaaatcaccataccgtacctctcttctccaccacaataaacatgatttcaggactgaagcaaagaaaggtgcatttttttcaaacaaacttttgtgtaatgcttaataacatacaatcgtgctcatgttgatatttggtagccaccacccccaaactcaattattagcaaatctcctgaacgtagccatgggattgagatttgtatttcttttcatttttagggtctgcctggcccctcaggtcccgctggtgaagttggcaaaccaggagaaagggtgagtaaaacaagtaatagtaagtagtaactactaaacttgagaatttccccctgtttaataccccactgctatgcaattataatatgtaaaagaaaatttcgtatttcatatgttaatgatagtgttttacatactttggtgctgatggagagaatgagccaaattactttagttctgattactttgttttacagatttaatgaaacatcaccttatgaaagtaaaatctatcaatgaatattttatttaatagccttactttttgtattgttcttgataacgttaagatacaaattatttccttccccatagtgaaaaagtaaatgcacaattttcaatcaaactagatcccgaaaaattccttttgtgtttttcttggcattcagacatgacactactatacacaatcagggcatgagttctgagtcattttctctctaattgtgatgaatgtgcccctatttagttacattctgtggcctggtctcctttgtcaacagtaggacatattaaggagacagctggtcagtaataaaagagatacacttgggtatacaattaactaggcaatgtacagaatatgataatttctcttaagaagacgatctgttatacagctaaaaataggcaatgtctaatattcattattatttatcttattattgaaggaaatagtctgtcactttttaaaaagcaataaactaaataatgggaaacaaattttttgataccaagttctgggatggatacatttttgtcaccaataaaattctctctttctgtatctttccatactaaaagttgttcttattagcctgtgtacttatgcactcatgtagatactgccaggtttatttcactctttccaaatttttcaaatattttaatcataagtgaatttagagatcacacacagatttcatgctttattctcatgttttgtctagggtctccatggtgagtttggtctccctggtcctgctggtccaagagtaagtgttacttcattaactttcataaactctggcaatgtgtttttaaaagtagtagtgctttctccttaaagccactgatgaccctgcaacaagtctctgatgctcttctatagtcaaatgtaatctgtagaaagcattagatttctaagttgatagtagaattttttgtttcattgctcatatttcctattcaataattacatagttataagaaacacataaatcaatatatattatagtcagtgatttatatagacaactatgctacatttgtgacagtggctcaacttgagctaaggaaaaataatatgttactaagatataaagttaattttggccatgtgtgttgatgttcaaagcctaaagccgaacttatgagtagtcatataaagaaaaaaaaacttagtttctctatgggtattagcatcactgaaatgattaatttgccctgaaagtattccatcatgtcactagttaacacatatgtaggaagctcaaagaaccaacttataacaaggtcctttgaaacagttacaacgtggacctatgtgataaatattttgggctatagaatgctatgctctagtgatatttagatgtaaattgggagatatttagatagacagacatatatatatatacacaaatacatatatcaaatatacatatgaatattgtaactgttatatcattattacacagggttataaaaagggggcatagataggagaatatctaatgttatctacacctgccattgctattcaactaaaatgacacaatcttttctttgaatactacacataactggcatctgtttttacctatggatttatcacagaaaagactcctcaaagaaggggaatgaattgcaaaaattgaatattatactctagaagcaacgaattctggagtcgtagtcatggaacattagagctaagtgacactttagagaatatctcatcaatctcttcattttactagtggagagattaggaacaaaagaaattttaatttgctaataaatgcaaaccagggctcggaagctacacaaatgtaaactctcatatgtaaaacagtatcactgaaagtgatgaatggtgcaacacttcttctaatcacttttttcagggggaacgcggtcccccaggtgagagtggtgctgccggtcctactggtcctattggaagccgaggtccttctggacccccagggcctgatggaaacaaggtaaaatcttatgttttctatattgctggtttggcccagtctgcctggaataagtagaccctttacaatagaaagataattgtttttcagatttttatttatttccagttctgtgatgacttccctctcagtaaacagcaatccgattccagtggacctgaattattctaaacaaacaaacaatagcaacaaactgtgggggaaaattcagagttcccaaaacataaatgaattagtatgggttgtcactcttttctcctcacgctgtttatgcttttgttttaatctagaaacattgtattcattggacattattttcagagaaaataactttttatcttaacatctcatcccatagagtaaaatttcaacaagtagtctgacttttaataataagagtttatgatgatgaaaattcattgggcaatacattcacccccaaaaatttgtctggaaacttgtgttccaaaatagaatctgtggtttagattttaaaatagatttaatatacattcctgaaaaagagattaccttaaccacaataaaaagaagacaacacatattattttcattcttaactctaggggaaaaaatgtaaacattagttgcaaaaagctattttagtgtatggaaggatgttcttgggaaaaaaataaaaacataaaagggagagaggaaataaagaaaccacggttttgtgaggtagtactttcaaagggatctatgtatctcagaagctagtcaacaggttttaagtatgtggaattgtagggttttatataaaaatggaagatacagtctctactcttaaggagattaaaacacaaacatctcctcaattgacaaggtctctttccatgctttctatctgggctaagagacttatccttgaaaaatgtttgtgggtaaacattttttactctctgcttcccattgtcctatcctcttctccatgcctgccatccttaagaggactgaagcaggttatagaggaatcgcagctgtgcactcccactaccctcatctcttcagtcaccatgtcattaacagcatctctctctgctatattctccctcctttcaatagcccagccttctttgtgtttcaaagcaggcaagaagcctgtctagctagctgtttaaattggaattcttctagagtttgattcttcattttcttctttctccactaaaattgatttcacatgtgtttgactcaagggtgaacctggtgtggttggtgctgtgggcactgctggtccatctggtcctagtggactcccaggagagaggggtgctgctggcatacctggaggcaagggagaaaaggtacgtgttgacccctattacatattgttgatgaactctagtaaagaaggctgcacaaggatgcccaagttttcacaattcttggcaggtggtctggtagcattttcatatctatctatatacatttccctctgccacctagcacctacacatttctaaactcactaatctggcaaaattccttgctaccatggaatttcacacaaacagatggtgttgagtaatacatgaggctcattttaatgccactaacaataatgcctcatcctgtcctaattaatgggaagaagctacattgaacagctgtcaaccatgctgctgcattagttatgccgtaagagtgatcaggcgctgcagcccattgtgatgttgccttacaattctgtccacatgaatctgtaccttgcttgattatgcttcaggagagtgtacggaaattagaaaagattgtttaacaataatctggaaatggccttgaattattttttcctcattatttttctcgattaacattctacagaatggtaaggaatcgagacattgctaaaaatcttaaatgactgaaggtatcatagcatcttctgtaaaaaagaaaaaaacttcatattaatttcgattcaaaattttggtcagaaaacaaaaagttgctcttgctttatactttcagggtgaacctggtctcagaggtgaaattggtaaccctggcagagatggtgctcgtgtgagtagaattttgtttgtatgtttcttcgtacttggattttttttttatgtttgaattgagaagttttccaaattagaactacacacactttatttatcaagtttaataaaataatattcctttctctcctgggtctatgactaataatatcattttacatgttccaaaggaaaaattaaatgggatttaacctctttgaaaataatatcctgaattttctaacttccctagtgtcaatgataccaactacaaactatagaccaaaagctttaggtttaatagaatattaaatgattgcttcaagtgataacagagattaaaataaataaataaataagtctcctatgctttaggaagccgggacctctaacaagattctatagttattcaaacctactccctagaaatttatcacccaaagagcagccccaaagattagctgttaatgccatgaagatgccaaagataatcccatgacagtctaattaccttatctcgtatgtcagcctcatgggtcttctaggccacagtcggcctggattcctttattcacctctccttcagagctgaaaactgactgtagcacatctgtaatagtctttcttttgaatcacgtagttctaacagtttcaaacaaggctactcatttgctgctctccagggaattttacaatagcggaaagttcagatctcccaaatttctgacctgctattgacttacacatttccataacctttattactggagtaccctccttctgagagtggcttctaatagtcttgttaattagaaccaaaatacatcagaggccttctagatatccaaccagagtgcagtgaaagtgttcagtcactgtataagcacagaaaaaaagaatgacaaggttcacttttgatgatacggggtgttattaataagacatgtttcctttttggtactagggtgctcctggtgctgtaggtgcccctggtcctgctggagccacaggtgaccgggtaagcatgcattttcactaagccaacagcaatatctaaaatttcccgccttccctagtcccaaagagccccagcaattcatttttatggcttggtataaagcctacttatttaaaaacctagctattgtgatagagcagcaggaaacaaatgctgtgtgtttaaaattacttttcccttcctatagatttgccagctatctgatctatactctaatccctagcatttgttttaaagtctctccatgttgcgcattaacaatatcctaatgcactgaggcttctcaaagccttcaattattaccaaaaaatcaataaaatacatagtgtgcccatttcacattgaactctccacttaaaatagatcttatttattgtattgcaaagattgccacaaatagatcagccccgtgtccatctaaaaattaaaatgtcctcctcctggtattgtaggcactgatttatagtgttttctcaagtgtataacccatactacttaacccccaaaatgaatatagcattaagtaaaaatccacttcattttactctgtgagatgtgcgtcagttatctcttccaaggcaactacagactctgtctgtccaccactgttctctctccctcccagttctttgagcatctatgtcaggcacattaacagattcatctttggtcccattatagggcgaagctggggctgctggtcctgctggtcctgctggtcctcggggaagccctgtaagtaagaacctgggtcattttgtatactcacacctcacaatgtttagacattgatgaacctaggattgataacacatttttaaatcccttctcccacctagggtgaacgtggtgaggtcggtcctgctggccccaatggatttgctggtcctgctgtgagtatcacataatgaagattaatctgaaaacatcctaagttggggagtagagtgggtcggaataccagagctgtaactgtttatttccaacagggtgctgctggtcaacctggtgctaaaggagaaagaggagccaaagggcctaagggtgaaaacggtgttgttggtcccacaggccccgttggagctgctggcccagctgtaagttgaattcactggtggtccacacagcagctacccattagatcttccaattaaatatatatccgtcaagtgcctgctatgcaacagggaatataccagatagaagatggaaaataacggaaggattaacatttgcacactgctttacaaagtataaaagtttcatgaatattgttttattttaattctctgataacctcataagggtggtaatattgaagaacattctgacacagatagtcattttttatttctatattttcttctaagagatgcgggaatgatccacttgaagaaaagagtagcatttacaagggtttgtttgtgatttgactccatctttttgtttgcatttagggtccaaatggtccccccggtcctgctggaagtcgtggtgatggaggcccccctgtgagtatttacaatggactctcgccgcttttcttttttcagaatctattaaggacacttgaaagttttgaaatttttggtaaatttggactaccatgaggaaacttttgagattcaagttcattctattcagagcaattccgatattgatgttaacttgaactcagctggaactcagtgtatgttgctatcagctcacttgaggtaataaccaaggtgggccctaggcagtttaattgtaaagtcggaaaaaatattccttttggcgtttattaatatgccccttcttctgcctgaccatgtccttctcctttgcaggcaatgctatcacaacaattctctagagacccagagctccccaaaaatgaactttactgacttcttctctcactggacagtgctgaattatctaggtcatttgttattcttttgtccatgaacaccattacctattaagtgtccatttccttaccactcagccaggtggtaaagatagttattaatgtatacacattaatgtgtaataatgacatagtgtcttatcttcatacctttacaaccataagataatatgtcagcatttcagaaaggaccatccaaaccttaacgcaaaatatgggcattgcaactggtaatatgctggtaaggaagatgtgtggagaaggagggccttcagggtcctggctaaataatgccctatatgaagctgcctacctcctactccttggtctattcctggtcacatgtactgattttccaaaacaaagaaattcccatcttacccaaattcttggagttgatgttgactgtggaattctaatgtgcttggctcttagggtatgactggtttccctggtgctgctggacggactggtcccccaggaccctctgtaagtaaatcactgtaaacgtgtcttcatttactctagccaaaaggcctggcttctgataggaaactggtaagaaactcttcatgaaaacacatcactaatattcgctattactctcctggtctgaagtcagcttttctgaaccattaaggtatttcatcacaagttatattttataatatcagtttaagaggcttttattcatgtgaacaccagtcccctttcaggggcatggtctttttgaaaaaaaaaaaacaaaaaaacgaacagttttagccacatatcagatatttctatatctaattatcctttatggctaacattctgcctccattgttaaggtataattgttcctgaatttaaaggtggtttggcctctaatttaattctgattcagactctcctgtcaggactcaagaaaatttaattaattaccaaggattaagtcttctggttaaggtttctgggaaaaaaaaatagcaaagatgttgatttcttggaatccttttacaggttcataacagaaaaatcttcattccctgtaggcatttaattaaacctagttgagaagtgtgtgggattcctcaattatgaacaaaacacgtatattggctttctttaaaaaaaaaaaaaaagaagaaaaaagaaaaggcaaagtccttcgaaactcagagtcccattcatttatcattaactcctatcattctacatagttctgattccaatatgccagggtaccagtggcatgacattgtttttcctcatagaaatttgccatagtctctcctccattatttggttggttacagcctcataaaggaagacaggagttgcttctttctgcaagaaagaaggttaaaaactataaatatttcccccaaatggccagggtattattttattgcatcacattgtttgcatcttaagatctagaatctttgctgctctcttccaggcccttggtgattaacagaaaggaaatgaccttgtacatttgctcatagggtatttctggccctcctggtccccctggtcctgctgggaaagaagggcttcgtggtcctcgtggtgaccaaggtccagttggccgaactggagaagtaggtgcagttggtccccctggcttcgctggtgagaagggtccctctggagaggctggtactgctgtaagtgatttccaactcctctttcttaataccttatgctgaattaaaataaagcccctacacaaatcttcaagtggcatctatttgttgatgagtattgcaggctctcaagtagagctcagttgagccaggaaatctgtccagcacacactgaggggctgtggcttccaagatgctcagaaagcacaaaatcgggaagacaataaatgagggaactcagttttatcacaaagcccttaaagctattgaaggcaccttactggtaccaggattagaacagagtcccattgctgtggccatcctactacatattaatcaatctcagtaggctaccaatttcttaaacatacactgtccagtattagtgctactctgaaaggtgcccctattagaccttagaggccaaagtcaaaatttgcttccttttgatatactgattttactgatttcctttttgtttttgttttttgtttttgtttttgtttttttgttttgggatggagttcccctctgttgcccaggctggagtgcagtggcacgatctcagctcactgcgacttccgcctccccagtttaagtaattatcttgtctcagcctcccgagtagctgggactacaggcacacaccatcatgcctagctaatttttgtatttttagtaaagacggggtttcaccatattggtcaggctggtctcgatctcctgacctcaggtgatccacccaccttgacctcctaaagtgctgggattacacatgtgagccaccccacccagcctgatttcctttcctttgtgtatatacccagcagtgtgattgctggatcttatggtagttctatttttagttttttgaggaacccctcctactatgtacaactattatgtatccataacaatttaaatttttttatttgtttccctgcctagaggctataaaaactctatttcaccaccccaagtgtctttataaatctcaaccacatatttttaaatgttgtgccattggtctcaaggatgaatcagatacaaaagtattcatgccaagatgtaaactcaccgtcatcactagagaaaagatatccaaggatatgtcctagtaataggaggtcattagcctttttctaagctgaagacagtttattctcacaatcttcaagccaacctgtgttatcacctagggtcttacccataatactcagtattttttctctatttagggacctcctggcactccaggtcctcagggtcttcttggtgctcctggtattctgggtctccctggctcgagaggtgaacgtggtctaccaggtgttgctggtgctgtggtgagtgcttgacagtattctgactccattaacataagaaaagattttaaaagctgccacttcaaatgtgacagattgatcactgaataacttcacttaagatttttattcatggcattttctttatacagatcacatgtcacttatctaagaagctttaataccaccttacttagacacacactataaagacacagcttaaaattatgcagaatgatttttgttctttccacgcacttaggaatgatacaatctctaattgcgtttactcctctgcaatatgaaatgctggcatcatttatcctgtaggaagaatgaaactctggaagttctgaatcgttccattaaaccttatacgtgacaacaactagaaaccatctcatctccataaaatatatcaactttttgaattcatttcatttgggatactgaatgacacgaggctcactttttacagagcaacatcccgtgattacataaagctggccatctacatgtggagaaggagggcagagatgatactaatgatacttcttaccattgtgtgacccattcacattcaatttaccttcttccttcaaactagaatctcctgagtagggttgttttggaggggaaggttagcattccatcgaataaggggaatgtcattttatcttctctgcctgtttagggtgaacctggtcctcttggcattgccggccctcctggggcccgtggtcctcctggtgctgtgggtagtcctggagtcaacggtgctcctggtgaagctggtcgtgatgtgagtccaacacttggtttgtaaaataaaactgagcaggatttcattgtgtgaaactttatgtcctgagctgaggttctcttcttccaaatttctgaacaagatggtcagcttctccatagtatctacacctagtactgaaaatatgaaaattgcttaggccaaagaatgggcttttcaatagcacactgcaaaactgggcccaagtatttaaaacatctctaaaaaatatctaggttggcaggtttttatccctagttttaacagtctgaaagagggttcgttactgagcactggaagtgatgaagacagagtagctacaacataggggctggtaggcagcagagcctcaccaacagccttaatttgtgtggtgtcttcacagggcaaccctgggaacgatggtcccccaggtcgcgatggtcaacccggacacaaggtcagtacacttttcatctttctctaattcaaaagtgattaaaatgcaacccagattgatgctaagcttcattttgcctttggtagggagagcgcggttaccctggcaatattggtcccgttggtgctgcaggtgcacctggtcctcatggccccgtgggtcctgctggcaaacatggaaaccgtggtgaaactgtaagtttgtgaataccagtccctcagtgcagcattctcgtgggcttcacttctgacttccccacacttggggatggtggaggagtggggaggggtatcttgggcctagctaagttgtgtttttctttttcatttcacagggtccttctggtcctgttggtcctgctggtgctgttggcccaagaggtcctagtgtatgtacatgctgaagatttctttgcaacactaacatttagagagaatcagtccaaaacatctgttaagaaaataaacaatatatcagctagacttaatattttttaaaaatttcagtccatgctgagaattgatacaaataacttgagctattttaaatctcttatgcttgtttgtattaaacaattacaaggatctagccactttacagatagcacaactaaagcagattaccagcagaggtgagagcctagctaaaccattacatgtcctgagttacctttgtaaacgaattaagcagtatttgtggtgaagtgagtgccatttttttaaaacggtaagtcttatccatccttctgtttctttatagggcccacaaggcattcgtggcgataagggagagcccggtgaaaaggggcccagaggtcttcctggcttaaagggacacaatggattgcaaggtctgcctggtatcgctgtaagtaaactgtagccatctcgcacataaactgatcctgaaggccttcagctcagaaggattttcatattttcactgctattgttccagtatagcctatataatatccatttcccattctctggctaactccatctcactcttggaggtaatgctatttcataccaacatgaaaggtgaggattaagggagatagaaatagacatacaataaaatctcctggtaacaatgtccttcaaccccacttaaaataaacataattagaggaatgactaatattgcactgctgaaataggttgtgaaaaaaaaattgaatataatagacataatgggagaaaagagccccactttacattttcaattttctcaatccggagtccatttaactaaagtttcccattcaatttggaaaaaaaaaaaaaatatgtctcttgacatgtgctctgaaagtgtgattttcctcttctgtctttaaagggtcaccatggtgatcaaggtgctcctggctccgtgggtcctgctggtcctagggtaggtggactcaagagaagacagttcatctctgaaatagaggctaaagcgagcagtgagccccaggctgctgctcccttggtgggattcaccagctcacatgtacctggtgtctgtcttccttagggccctgctggtccttctggccctgctggaaaagatggtcgcactggacatcctggtacagttggacctgctggcattcgaggccctcagggtcaccaaggccctgctgtaagtatgatttggggaaataataaagaagatcacggacctaaggaatgttttcttcagactaaaccaagacaactttgacaacccattaaagttagccccatttcaatatatcctctaaaatatctggaaattgtctatatgcaatgggcttgttaagtccatccctgcaagtgtgcctgggggctcgttatttatttatgtgaacttgattattttttactgatgagaacatgcttccgtgtgaagctcaactgaaaatctgctgccatggatgtctctcactgtaacaaaatataaagcctctcctatctcactttcacctttgcagggcccccctggtccccctggccctcctggacctccaggtgtaagcggtggtggttatgactttggttacgatggagacttctacagggctgaccagcctcgctcagcaccttctctcagacccaaggactatgaagttgatgctactctgaagtctctcaacaaccagattgagacccttcttactcctgaaggctctagaaagaacccagctcgcacatgccgtgacttgagactcagccacccagagtggagcagtggtaggtcaagatgtccagaccagactgacccttctcacaagttgagcttttcaaaattagtttccattgacatttagagtgaaaatgcatttgggtaaagattacattatgtgaaatcacacccaattaatggagcgtcatcttctcccaaccagcacccaacctcatttcccttaaaatgtatttttgcacttttcatagtaataagtaccctgatttgatttttcatggaggaggggagggaaggaactgtctaatcttaaaaatagccaccctcttcctcttaaatatggggtagacaatcaaaaatgttacttatgagagtcagtatctttcattagttattattagaatctgtgttctgctcaatgagaagtttcatgatctgaatgttattttcttaaaaggttactactggattgaccctaaccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagccaggtgaggaatcccacaaacacctctccttctgctaaataatattttggtaggactgtttgttaattatctgcattttaatctctgacaaaaatgggcttattaaaaaaagacctgttcctttcctgggttccaattttgtcctaaattgcacattagaagatggattgattggacacatccatgtaattcaaagttattattcaaatttgacttaattggtaatcattgaaaaaactgactaatgtcatttagtgtgaaggagcactggccagctatatgccacactcatacatatgcattttcagaatgtgagcagcttttctgaatttttaatcaaaccttttcaccaactttactgaatgcctactggaattccataaattacaaaatgacagaaaaagaaaaatgtcagaatttctacctcctcattctcttattctaaagaagaagcatatgcaaaaaggattaattgaaacagataacttttttagatgaccttgcctcagtctagtaggtcttatgttcatctaggtaactgatacttcaaagacaagtgaattaagttttctttaaaagtacccttttcctaagcttggatctgagtctactcttcctgagatctttttttttcttttttttttttttcatgtttgactcttagtatctgagtccttctccacttaactggaatttcatcctattttctgtagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctgtaagtaatagtgaaatatgggaatagctttgggaagtgggatggagggggttctaacttagactgcccccaagggggggtctaaaggggggttaaaagaacagaagaatgagagaactaacttatttcataagtaaattcagtttttgtatgtattttatatttatttatttatacgtattaatttcgtacttaaattcagatgataaattcagagtattcttatcagatagtgccttctgaaatgctgaaatgtatactatgtccatgcattgttttttctttagcatgttttttaaatggtaatgtgtgcccagaacttaaaatttcttgagacttcagtggcctaaactataatttatagttatgtgtattttattttacttattagtatggcctacatttaacttttaatgctttttctacaatatgctataaatataagaaaaattaaaattcactaacagcaagactacatacccacccaggtcccgctcccaaagacacacatagagggacatacacacaacaatcctaaaaatgactttgtagagataggtcacttggaatgtgtgttgaaatgttgttggtttttttggtttgtttgtttgtttgttttttgttagactgatagggagcccctcccactaaagacacccttgatactgttatttcaaggatgaacttatttatctgggacagacatcttcagaatgacacatgccaaacagtggttcttattaaatcaaaggttcagatattatcagattcagaaatagtgatgctttgtgtatctattttcttctctttaaacagaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaaagaacatat

SEQ ID NO: 36152 - DNA, 36672 bp, Homo sapiens; identical to SEQ ID NO: 36151

SEQ ID NO: 36153 - DNA, 21628 bp, Homo sapiens
tcttcacgtcccagcgcgggtgggcgccggcggctcctcttaaccacaggttccagaagtcctctgcagaagtgcttccctctctcatttccaggaccacaattcccagagacttcggcttcacgacgtttctctttttgcccgatctctcccggagctggctgggcttcggccggccagaggcccacagcgacgacgtgatccgtcgtgagcgggtcccagggtttcctcggcggcccttttttctctcccctcggtcgtcccccttgcaggctgtcgcggctggcctgagcggtgacctggcgggtcgcgcctgcgctctgccctgtttcctgcctggctggtggcggcggccattttgttcatcctcctcctcctcctgctcctcctggttggagcgcagtgtccggagcgggctggggggagagagcccgagagcagggttcggtgccttttcctctgtccccagccggtgcccagagcccccctccccttcctccccaccccctcccctccccaaccctgccctcccccttgtcccgggatcgctccgtcgcacccaccatgatggaagacgacgggcagccccggactctgtgagtacccgagacgaggggtgccaggcgccaagaggcccgggcaccgcgggacgctaagggagggagcaggagagactgggccgaagccgggactctaggcggctccctgaccagggcggcgtggacgcgaagtgcattcctcatctgtccccttttccttgggaaggaaatcctcccttcccccaaacagtcacttcctggggtctggggcttgtctcgacctttttctctggcgtccttctttgcatgccctccctaggccgggtttctgcacggctgaggctgtcaggcccaggagaactcctgcaccccctccgcgttggacgccctgggctgggcctggagctgccggcgcccacgggggaagggcctggcgggggtaggattgggggtgggcccgggggtgggccccgcgggccctgaggaattagcactcaccccttccacgtcctcagctcgagtcgctcccagctcttctccccagctaagctctcggaggaagcaggacactctttcaccactcaagccccttctctctttatgccccacgtgcccccgcccacgctgtcagaaacacccgcctagcgcccgctacttttgaagtacataagggataccttttgctgcccgagcatctttcccttcttggataaagaagtttactttgagcgctccctacgctaaactgacaaccagttgttaaactccttttgctctctaggtgttgcctcttcctaatctgtttgtgcgtcgaaagcttcagagttggctaaaattatgtcttcatccgctatttgatgtgtgtcttctgaacgctttttctcctgtcttgctgttgctttttacctgaagctcaatctaatgaatgaattccatcttccaaccacttaattctggtttccttcctttccaatgaagagtgatgactcagcatttgcattcctttctgaatagtgtggcactccttttctctgcatctttttttttttttttaagtctgaatactttttaattaaatgtttaaattgggcaccctaatttcccggcctctccaggtctagcactcctaccttgagtaccaaggagtcagatcgctgctttgtttctcttgcctctcctggtattgataggatcatagtccacttggctctgctctctgatggggaaattgctttttagggaatagatgaaggtggaggggcactcgagaagtttgactagcttcacatctcttcactcctaccaaagaaaggatgctcagtaaagaagatagatgttcagtattgatagagatttttttggtgtggccttgtacaggaataaatgtgttctctaacgtctcactgaagtatccgtcccgttttgagaatctgaggcctactgaagcacatccaatgcttcaatgaaacgcctgcttaatagaacgtctttgtgttttgtgttgtcttccatttctgccttctctccctagaagaaagaattgggacacacttgaaatttgtccttcaggccgggcgcagtggctcacgcctgtaatcccagcactttgggaggccgaggtgggcggatcacgaggtcaagagatcgagaccttcctggccaacacggtgaaactccgtctctacaaaaaacacaaaaattagctgggcgtggtggcgcgcgcctgtagtccctgctacttgggaggctgaggcaggagaatcacttgaacccaggaggcagaggttgcagtgagccgagattgcaccactgcactccagactggtgacagagcgagagttcgtctaaacaattaaaaaaaaaattttatccttcaacatctgttgaagccaagacttggtgttgagttacaatgtgtactttgatataagcatctgggaaagctaggcttaaagactagctaacatgtatttaacaaagataaaagttacattgtatctaaaaatctgaagtatcatcacacactgaatgattgataaatactcatggcaggggtctcatttactgtatctgttccttaccaagaggaatctctggttttgtagtgctaaagaatgtgcttttttgatgtcttttatttatctttgcatctgccttgccttcatccctatcagagtttctccaggggaataataagctaacttctttgtcacttatttccttcctctaccttctctaatctcttgttctttctttgaaacagttaagttgtctatgtttacagttctctaaaactgtgacatgttcatatgaataaataaacatcttaactctgttgttttgtatgtcagtacgtgtttactattctgtcttcctttttccttctcccacccttttccatagggcctttttttttttttaagagaaggactactacatcttcctaggtcttacccccacagcacttagttcactgcctggaacataagaggtactcagaatttctacagtgattatacttctttcattaaattagtattaagttcttttttaaaagtcctggttgaactaagattgtaggcagacattactgtcacatgtggtgcagtctgttgacttttatatattttttaaaaccttcaaatgtaaaatcttgagataaaagcaaatgtttaacaattgggatttttattagagtttaatacaaataatgcatagtttttctaagtgtacgttttacatattctcaaagggttctattagatataagtaacatgatgaaaactgaacatgattttagacgttgatatctagtagggttttttgtttatggagatcttatattttacattgtgagctatggattaggtttttcaagtggccagtatgttttaaaagaatgtgttcttaacaaagcttatcttaaattgtttccttaagatgcctgtgtgttactagtgaggtttttttcctgcagacacacacaagctaagacatatggttctatcttcagaaaacaatatggtgtttagagcctaggtaggtctttaaatattcattacctacagtattactaatttatttgatggtatttaaagtggcaagaattgctttgatgttgagcctaaatttctatttgtcatatagttgctttaaaggtctgttttctgatgttcttcattctcatttgacatttattttggggtattatgcattgagtaacttgtgatctaaaaaaacaaacaagatcatgctgtgtaatactggtgttggaactggactgtctgacacctgccttgtgggacacacatttcaggcttgggttgtgtgtatctttgtagtgcagtgatttgatccatggtatatctgaatctacaatatgacactaaattgtaatagtgttttattgtagcttattttattttcttcatctatcggatgcaccaaaattgctaggaattcgtgtaataccatgttacacaatcccttcctttaaggctattctttcttcctggaaataagctaatgatttagagtataatctgaacatctaagaacaaagcagaagaaaattctataaactattacaaaattgactggctataccatggatttggctatactgtggctataatcaagcccctcattcaaattcaacttaatcatattctttgtttctttaaagtaagagagagagagtgagtgtgtgtgtgtgtgtgtgtgtgtgagaatatctcatatatatagttggtcaatttagttgtacctcctgcagctatcttccatcatgcctccttcctaaaatgaaatactgtaccgacaaattgaacaattaattagagatctattgaaggatattattgcaaaatctcttcttgtataggacttgtcaagaacaaaagcaaaactattatggaaatttagctatagttttttgtgtgaaagtgctgataatttcagccttggtagggctactcttttcagagtgagagcacattcagtgttgaaaaagtgtcattagtcttctgaaaggcatgatattcttaacttaaaattctgcccagtcggacacaggaagtagtttggcaatgtgaatttctgcctactgtgaaactgctaagtttttagccccaaattggattttaaccctgatattagagataaaggtgtcattttcagtttttaatgcttcagttcctacagttcctgttcttagaagacaaaatagactctaaggtatgcctcttctgaattttttcgttgagttaaaaatcattttggaatttcctaagtgtttactctttgaattgacctctcaatacaaaaattagagccatttatcttttttctgttattttgtgtatgttctttaggtagcaattatatatttaaagacttggatctttagcttgactatttcataaccagagcagaaagaaagtgaagtgtagaagctataatttggaacgaataaagatgtcatttcaatgaactaccaagagatgatcttactaggtcaggcattgaactttgtcttaaatatttttgttagtatttactttgggacagattattttatgatactgtaaaagtacttaaaatagaatagtacagtattttaaaagctatacaatacgtctctcaagtgttatgatgcacgaaggcaaatgtaaatgaagaggcaatctgaaatttgggtacaagaactcagtaaaagaaaaggcagtctgaaatttgggtaaagtttaggtgaaattatatagtgaatcatggccttttaatcctggtaaattaagatattgtatgtgttgttatggaaggcctttcatgttagtttttgaaatttagtttgctgcttaacatttaacttttagtggagataatttgaaaaataggaaaccttaatactggatttttaaataaatatttcatgacattctaaacttagatattaacgttttcatctttgctttcagtgctagaaatgtaaattaatatatctaaatatgcctctagaaattcttcaagatctgtaactggcgggaaataggttgacttagaataaagatttttttttttttttcagatggagtttcgctcttgttgcccaggctggagtgccatggcgcgatctcagcccactgcaacctccacctcccgggttcaagtgattctcctgcctcagcctcccccaagtagctgggattacaggtgcccgccaccatgcctggctaattttttgtgtttttagtagagacggggtttcaccatgttggccaggctggtcttgaactcctgacctcaagtgatccacctgcctcggcttcccagagtgttaggattacaggtgtgagccaccacacctggtggaataaagatcttattaagcagtgacggctttttttgtgactattagatatagaaggtaactaattccaatacagtttttcctgaagaaattgatgtttaaacagtaatggaaatttaaaactatttaaatcatttaaaatgtgttatattaaaatgataattctattttaattttgttattagctagcttcaatatgtgaaaaccagttttatccatccttcttttctcttagaagtgagctaactagccctttaggcaaggagcataatgtttagaagctcaagatcacttgttcgtttctttctttctttctttctttctttctttctttctttctttctttctttctttctttctctctttctctctgtctctctctctttctctctttcttttttatttatttttttgagatggagtctcactctgtcgcccaggttggagtgcaatggtgcaatctcggctcactgcaacctctgcctcccaggttcaagcgattctcctgcctcggcctcccgagtagctgggattataggtgcgcgccaccatgcccggctaatttttgtattttttgtggagacagggtttcaccatgttggtcaggctggtctcaaactcctgacctcatgatccgcctgccatagcctcccaaagtgctgggattacaggcgtgagccaccatgcctggtcacttgttcatttttcttacagataggtctactctgtacaaaaagaaatcatttcagagatacaggctcacaaacccctatgagttaagaaggggcaagcagcctatcgctggctcataacccaataaccttttagtcctgctggaaaaagtatgtcactacattggcctgctgatggatcagctccttaattacgtggaaaaggtggcatagtggacgtaaaacagtttgtcacttgtttagtcctctagttaggtaatattggatgtgtgtttcaattttagagcaggtacactaagattattagtactcattgcaataaaattcttaactggaaaatcgctactaattcttaattggatcttttaagttttttacttaacctaagctttctcagtctatttttccctttgagtattccatcttaaagcatgttgtgtatttaatgtggcagctatgttgcaagtcttattttggtcttaatactcagtttccagatgtaatatattacaagtagaaaaagaaatctactttccagaatgaactttgttaaattttacagatattgtttggtttatgaggttgttcataacagatgcaaatttgaggaattatgtgtagaataccagaaagactttagtgtttggcaatttatttagataaattaagataaatccatagtacaagacataaaccaaggtggtcctctctgtgtgatgaagtagcatttttttcttttcttttttaaactttcctgtatttaaaatcttttacacaaaacacattcaattgtaattaggaaaaaaaacccaaatttttaagtgtccatagtcaaaagtatgcctggatttgtcttagtttttctctgaatttcttaagaaatctttgtattagcttttttatctacattaagatatattttgttggctgggcatggtggctcactcctgtaatcccagcactttgggagactcaggcaggtggatcacttgaggttaggagtttgagaccagccaggccaacatggtgaaaccccgtctctactaaaaatacaaaaattagccgggcgtggtggtgcacgcctgtagtcccagctacctgggaggctgaggcaggagaatcgcttgaacctgggaggcggaggttgcagtgagctgagatcatgccactgcactccagcctgggtgacagagtgagactccatctcaaaaaaatacatatatattttgttgattctgatgcattttagactaggaaattttatattttaccctgctctcctaaaatgaaacagtgaagacatcattgcaaacaaccttactcagccaaaaacaaaacaacaaaaaccctccaccctctgtatgttttactataactttaattctgttctttgttcatgtaattgctttggttgggaatctaagataaactcactttatgtttaatatcctattacaatcagatgttttaatgaattagtatttgttgtatgtgtgtgtgtgttataaattatttttaattagaaattgtagttatcttgagaccagtttaaaattttaacaattagaataagatgagaaaatgatatccagggtacagaataataatgccattggggtatacaagatcacattgatttgttctttaaatgtctttcagagtggtattttagtggcctaagaacaattgttgctttcctaaataagggttaatcttactttcataggatcaggtttaattggagaaattttgttgaaaacagaggaagttaaaatgaaataaaaggtggccgggcgcagtggctcacgcttgtaattccagcactttgggaggccaaggcggacagatcacctgaggtcaggagttcaagaccagcctgaccaatacgatgaaaccctgtctctactaagaatacaaaaattagccaggcatggtggcatgcgcctgtaatcccagctacttgggaggctgagacaggaaaatcgtttgaatctgggaggcggaagttgcagtgagctgagatcatgccattgcactccagcctgggcaacaagagcaaaactccatctaaaaaaaaaagaaagaaagaaagaaagaaagaaaaggtgatgaattagatgataacacattagagccagagctaaaggaaaaattgctgataacgtatttttttcttgtgcagatacgtaggtaacctttccagagatgtgacagaagtccttatacttcagttgttcagtcagattggaccctgtaaaagctgtaaaatgataacagaggtaagatcttcccagttccatgtgctgacaattagcatgatgggttgattagcatgattttaaaatttcattgtaagcctcaagttattctggtggagagatttgtgttgtgttgacttattactttgatttggctgacaaactaggcttagaatggagttttatttaagagggcaaagtttccgtgctgttaagctcaaacggtcattcttcatggtgtggttatcttgaagtgattctgctttcagaacattattagagctcatttcagaatggtgaaaaattggaaagtatttcatacaattccaataagaatgttaacgatttagacagcatgtgttcatgtgcgagaacacgaagttattatgtgtgtagtgtgcagcaccgttcgtctcgtgtgtctgtagcaaatacttacctttttatactttcctgctaagactgtagcagcacccaattagtcatgttttaggcttttcttccttgtgtttttgttcattgatcagctttcttttttttttttggactatttcctatgtactagatactgcagtaagtgctagagatacactggtgaataaagatagttccttggcccagagaattttacagtttagtagggagacaaaggagttagcaggcacttaggaagtaggataataaatgctctagaagcagacaacttaaagtgctgtgggagcaaatgtgtatccagtgcagccttaggtcagtgagcggcttcttggaggactcactgcctaggcggaaaccttgaaaggatagtagtacatactggctagaaaggaattgagggaagaagggattccaaataaagggaactttgatccaggttggtagggagagcaggagtgcttgagacagagagggaaaaatagaacccgtagcatggttgtagttaaaatggaattagtcgtaagagatggcaggagtttatggaaagggctagaaactgtgctaaagagtttgttttatcctgaaacggagaactgttaaaaacctttaaagtgcattggccttttgattgtctttcccaagtaatgacaatcatcattttgttctggtgtattatatttttccttcctgcctttaattatttatttgtgctttcatcgatcaaaaatttcctttgcactaggcactatacaaggtactggagatataatggagagacagccaaatgagtttcccaagcaaatagggatgtaagccatgaagagaataaaacagagttctgtgatgattggagggttggtgctatataggctaggtgatgagagatgtcacctctttgagctgagatgaataacaagatggtgctatctatggtaagagctggaggcagaggaaacagcaaatacaagtcttgagttggtaatgaacttgtgtttgtggaatcaaagaccgatggctagagtctggtgagggatggaggggagttaagggaaatgagtctaacagcaggattcagaatcacaggacattatggtccatgacatagtttaggttttactctgattgctgtggcagaccagtggaggggcttaagcagggggatgaggtgccaagatttgcatatttaagcttactactctatgtagagaatgactgttttatggagaatagattgtagcgggcaagagcagaaggagaaaaaccatctggatttacttcactagtctaggtaagagatgatggaggcttattctcgaaagtgctagccgaagtcaagataaggacagaggttgatagatttggaatatattttggaggtagaattgataggactgggttggctgtgggacatagggaaaggaagaaatcaggaaataccctaagattcatgttaatgcagttgtatagttggtaatgctatttatttgctaaagtgggggtgacctgatggatgtcaccatggggagtggtgggaatcagaaattgtgttttggatgttagatttaagacatgaattagacatcaaagtggacgttagattaggcagttggataaagtagtttgcaactctagagagaccggtgctgaagcttgcagtggtatttgaatccatgaagccatgggactagatgagttcacagagagagaatgatggtaaagaagagcacagaggccgtgaggtctgagccctggacaagctcaacatttagagtttgagtaagggaagaaagatcctacagtgaggaaacaggaaaaccagagtgtggtaggagacagaagagaatgtttaaaggaggatggtggtcaactgtagtgaattctgcttggaagtaaagattaggatggaaaaggaatcacagaagcagcagagaggtcattgttgagctcaacatgcagtttcagtggcatggttagcttggaagctgacagaagtaggtttaggagagaacgggttgtgagaaagtggggaaagactcactagaaaatttttgagaaacatttgtaaagatttattttaactattttttaaaaccccatgtatacatacagctatttgaagggtagagggactcgaaatgaattttcataacatccatattctagaactcctagatttgagcttgtaaagtctcatatttctctgtcttgacatttatgtcatccaacaaaaattggtgacaacgctaaataaggtagggacataacggattttttttttttttttttaagagacagggtctgactctgtcctccaggctggagtgcagtggcgccatcatggctcactgcagcctccacctcctgggttcaagtgatcctcccacctcagtctcccaagtagctgggacagcaccgccacacctagttcatttttaaatgtgtttgtagagattggtttcaccatgttaccaatggtcccgaacttctggctggtcctaaactcctaggctcaagtgatcctcctgcctctgcctcatcctcctaaagtgctgagattataggcatgagacactgcacccagccataattgattttttttttttttttttttttttgagatggaatcttgctcttttgcccaggctggagtgcaatggcatgatctcggctcactgcagccttggcctcctgggttcaagtgattctcctgcctcagcctcccaagtagctgggactacaggtgcgtgccatcatgcccagctaatattttttatttttttattttttgtatttttaatagagacaaggtttcaccatattagccaggatggtcttgatcttctgacctcgtgaaccgcccacctcgccctcccaaagtgcttgggttacaggcgtgagcacttttttttgagacagagtctggctctgttgcccgggctggagtgcagtggcacgatcttggctcactgcaacctctgcctcccaggttcaaacgattctcctgcctcagcctcctgagtagctgggattacaggcgcccgccaccacacccagctaattttttgtatttttggtagagatgggggtctcaccatgttggtcaggctggtctcgaactcctgacctcaagtgatccagctgcctcagccttccaaagtgctgggattacaggtgtgagccactgcacccagcccataattgatttttaggatgtcacttggtggtgtaaataagaagcttccagagggtataaactctagcagagtatctagcagctatttatttttctttcataaatttcatttcagtatgtgaaaaatcctttttcccccatagttttatgattttttttttactttagatgttgttatcatagattctagctttccttatataatacaaatatatattattgattctaagtcaaatttttttagaattttaatatctgacagttgggatgtgacttagaaataagtggtgtcttaaattagatgatatgcagtgtgatgtgaatatataaaatatgtgatgtcagtgaatatatgtgtatatatacatgcacgtgcatacattgattgggagctggcctactattagatagatttgaaattggtattcacgagtagactagtttcctaaagtgtatgggattatcatagatctgctgttggacccctgtatgttttgctgtgattatcagtgttttccttagagaccattggggcaaaagagataggagtgaaaggaaaactcaactagcacaattttagcctcttatttattttgatgtcctttcttcaatgaatatttatggtaaatgtaataactcttttacaagaatttaaatgtgtgttttcatttgaagtcttcccccatttcctttctttacctcttaagaacagcattcacgtggctacaacagtaggattttgtatgagagcccatagttttgttgtcagtattaacgatcccactttttttccctcaaggaaatgccttctggttcctttgccactattgtttagacgtcttattttggatttttcttctaaaactttcctggaatgaaaaactgttgtggttgaaaagatctttattttatctggtatatttatcccttgtaagtccaactagaattccacattttaaatattattcttatagggcattttacattgaataatgatgaatgtttttagccttacataaaaatatgtatttgtacagttgtgcagctattcagtacaggttgcagtttcatagaaattcatttctagtttggttgtcaggtgagaatgttgctatagcttaggtagtactactttcttcacatctttataaatgtgttttaggtaactactgtcaagcacagggttgcagaatatatttaatatagattttttatatggtgttcttatgatgtaaacttatagctttgtcttggaatattttattcagatacattttcagaacctcttttcttgatcaccactgttatttctctgatctttggaagaccaaattcaaagtatatagaatcttcagtacattagactattttggaaggtagggaattcatttcagtagctggttataaagcttaagttttcttgtttttattttcattctttccatatccagaaaagaaatcaataaaattcagtctttgtagcagcatagaattccatcatttgtagtattgatcctaattttgatcagtagtttatgaagttggttcttgctgtatttctgtatcctgggataccacttatagaggattatgatgcataagtagaacgtaatttaaaaataatattggagaaggaaagtagtggtaaggagtggtcctcatcagatctgagtttgaggttttgtttggtttaatataatcttctattttatatttaacacacttcaccagaattctttattttcatttaatactgatgctcatgattctacaactgcttttatagttccgtttgagttcagcagtattctgaggtgcaaagtcaggtttagctttaaatcttatttaaaaagtgttaggctttcataagcttatgcagtctcaccttgtatattcccagctatcagtaatgttttttcctggattttcttctcagcaacccgatagcagaagggtcaactcttctgttggattttctgttttgcagcatacaagcaatgacccatattgctttgtggaattttatgaacacagagatgcagctgctgcattagctgctatgaatgggagaaaaattttgggaaaggtaagataataggatgatggcaccttatgagtacatatatttgcatgtcaaactagtttgtattctttctaggcaaatttttgagcagatattcggctgctgagtgatggttttgctttattcagcttagtgcttttacaaaaataaccctgcttgataaatgatttaataagtggtaagtgttgtaactcatgacatgcctaataattttattaaatataatctttatttttaggaggtcaaagtaaactgggcaaccacaccaagtagccagaaaaaagatacttccagtaagtactcctgctgcattttactgtggaagagttctgaaattatccaggaggcattaccagcttaaataggtttttttttcctcctctagagttgccttaaaaaggttttagtggctgacttcttaagtatttgattaccaaatgctctgatttcagatcacttccatgtgtttgttggggatttgagtccagaaattacaacagaagatatcaaatcagcatttgccccctttggtaaaatatcgtaagtatcataatcagtactacactcagtcatgataggcagaattgtatatgattaacttgtaattgaattaagattttctttctctagttagtatggttttgttttgtttcttatttttcatttatttattttggtttgttttgagtagtggatgttgttgaaaatgttaatgtcatttcagtgtcttggggtctcgttttcatctaatcctgtgtataatatgttaaaaaaaatttaagtgattctgtttgttatctttgaagcagatgtttgaatggtaaaacttataaagtctagctttttgtcatatgttttcaaaatttgatggtttaggataatgagttaatcaaaagtaaatgtgatctatactgtgtaagagttcaataacttttataggaggaatttataaatgggggagagtaggtaaatccttggatatattgtgattaaattggaaatgttcatgttttattatgataaatgtgtttttgatattttagctataagtgaaaagtactattatactattaaaatgtttcaatgtatgagtcataaatgtgggattaattagatgtttttgttagtgatatttgattctactagttaagaggcaaatgtggtttgatttttaacaaatttatgctcagattttactgttgttacttggtaaaaaatatattggaaaactaaaaatggttatgaattgtagaaaatgtttatcataatttatctttctgattaaaatcagtttattttgtatatttcctgtagatttaaattaaacatcttagtactactttacaggaaagtgtttcaactaagaacaacaatattttctctatacaatttgttgttctatagatttaatttctttaaaagatgtaattcttaactttctgttttgatatttgctttgctttttaatctaaatgtggtaagtagtactattttaaaaatcaatataaaaataatacaggttgctgtttttcaatctttatttatacctgagacctgcagtttttcttaagtccaagtcacaattaaaagtaatagcattctggttattttgcagaattgctcataagaatggacaggatcttgaaggctaactgcaaggaactgtgcacactggaactcagttgtagattttttttctcatttctatttattcttattatacattatttatatatacatattttagtatttacattttaacattctatattcagtggagttctatatttccaatcatttaacttactcactaaaatttctgtgtaaatttgttgttttcgtactggtgtgcttagcattgttgttagttttttattctcctttcttaaatttctgaaaatgtcaatttttcaaaatttacagctgcccaaactccaaaatgatggtagagaattgaccaagaaaaataaagaaatctgttaacaggccatgtatgcctttttaattcctattttttcctctttttcaattttttaatatttcatatattttgtatcactaggcagaagacatttaactatttagagattgcatggtaaagtagttagtattgttacagtaatttatagaatcagtaaaccttagaggacactagtaaatagaatattagaaagggaaactgttgttcctattaatcttcaaatttgagcatttagtttagaaagcacaggctatttgattaggttgcatgtttattacatgtttttgtcctactgcttttttctaacaggtaaagaagcattagggagagttcaggaatggttgtagttaattagggctaactggaattttattttaaaaatgctcacaatacagtgtgtgtggttccttttagtttttattttgagggtggctcttacttccctcatttagctgtgcttcttttcacagggatgcccgggtagttaaagacatggcaactggaaaatccaaaggctatggttttgtatctttttataacaaactggtacgttcttccatctcaatttatattttttaatactaaatttagtcattagttacttaatgtattgaatctgaaacttgaatatacttgaatgttaactacaaacacaacttttatgtaatgttatgtatgttttaataatagagtataatttcattcctctttcataaactcgaaaataaatagctagaaaaagaatgattatactataaggaagattattaaaattgtgtttgtacattggtaaaggtcagatggatttagaagtaaagcccaagtctaggacagatgagctaatctgagaatttagaggttaggtaaattatattcagttttaaccatgaaaatctcagttttaactctaccttttaaattattattcatactcttatataactgggatgtgaatgactacaacaaattatgtaaataaaaatttaagcaattcatcttgatttttgcatatattctttgtaaaaggggtaccaaagtaagcatttgcattaactgtaacattaaataataaagtgggctttgattttaaagcagtttcaataacttaaatcaatgttttgttttgttttgttttgtttttttgagatagagtctcgctctgttgcccaggctggagtccagtggtgccatctcagcccactgcaacctccacctcccgggttcaagcgatcgcgctgcctcagcctcctgagtagctgggattacaagcatgtgccaccacacccagctcatttttatatttttggtagagacatggtttcacttgggttcgccaggctagtctcaaacttctgatctcaagtgatcctcctgccttggcctcccaaagtgctgggattacaggtcatctacattttattgaagtggtaagataaagggccagagtattctgtttttgcttagattgaatctcaagttcaaatcgttttctaattggtaatagttcagtttcgttttgtttaggatatttagtaaattcatctactgatttgtatggaaccagcagcgccgatattttatttcatcttacagagtcttatttatcactcttttctttgtgattgtgctttcttttttatccataggatgcagaaaatgcgattgtgcatatgggcggtcagtggttgggtggtcgtcaaatccgaaccaattgggccactcgtaaaccacctgcacctaaaagtacacaagaaagtaagatatgtccactgtgtgtgttaaaattatattcttcacaaaatcatgtatcatgtattcatctagtctcaatttctaatttatttatgtaagagacagggtcttgctctgttgcccaggctggagtgcggtggcatgatcttagctcactgtagcctgaaactcctgggtataagtgatcctttcacctcagcctcctgagtaactgagactacagggacatgccaccatgcccagctaatttgtaatttttttatagagacagggtctggttacgttgtccaggctgacgtagtatttaattagtgttgcaagactctaattatttcattttatatttcattatctgaaaataattgggctgtggtataagtatttttggagctgtgaatcacctgattttatagatcaagtctgtgtcaaatcatagcatcaagaaaaattatgttttctcctcccattgaggcatatcttttttttttttttttttttttttttgaggtggagtctcgctctgtcacccaggctggagtacagtggtgcgatctcagttcactgcaacctccgcctcgcaggttcaagcgattctcctgcctcagcctcctgagtggctggaattacaggcgtgtgccaccacacccagccaatttttgtatttttagtagagacagggtttcaccgtgttggtcaggctggtctcgaactcgtgacctcgtgatccacctgcctcagcctcccaaagtgctgggattacaggcgtgagccaccgtgccctgccttaatttttgtatttttagtagagacaggatttcgtcatgttggccaggctggtctcgaactcctgacctcaggtgatctgcccacctcagcctcccaaagtgctgggtgcccggcctgaggcatatcttaatagtatatagtaattaacagaagagtttcatagtacaatataacagtcaacgtttttgttttgtttctgcatacagacaacactaagcagttgagatttgaagatgtagtaaaccagtcaagtccaaaaaattgtactgtgtactgtggaggaattgcgtctgggttaacaggtacaatgtttggttttctaatcacctctgaggagcttcatcactgttcatatgaatttcatgatacacatcagccatgttttatttgtatgttttgttttatagatcagcttatgagacagacattctcaccatttggacaaattatggaaataagagttttcccagaaaagggctattcatttgtcaggtaacactctacttgaaatatcattattactcttatatttgattcattcctttcacttatgttctccagggtatcagtgtttgttattttagtgcttctttgcagtatagaagtttaagctacctacctaatgtactttagaaaaaaaataccaacttgcaggtgtaaactgatgagtttccatgttatttattgtgttaggttcttaaaaaataaaagacaaaaccatatcatttttctttcttagattttcaacccatgaaagtgcagcccatgccattgtttcggtgaacggtactacgattgaaggacatgtggttaaatgctattggggtaaagaatctcctgatatgactaaaaacttccaacaggtaattcgatttttcatagcattctttaaggtttccatcttacatgtcacataaaagctttggaaactctgtaaaatgaacaataaaataaagcatatagctactttcagttgattgtatttcaaaattgattatttgcggtattaactgaatcttaatactttcttttcacaggtgtcaccaccccaataaacttagacaatgataaataacagagtcctattcacataagggtgcttacttagtttttctcttccttgtctcccactctttcttcatatacggtgtttcttatgtgttccctaaaacaatactttgctttttcctaggttgactatagtcaatggggccaatggagccaagtgtatggaaacccacaacagtatggacagtatatggcaaatgggtggcaagtaccgccttatggagtatacgggcaaccatggaatcaacaaggatttggagtagagtaagttgtttgggtttttccagtatagaaacgtatggttctgacaaaataaataaaagtgtgttttcctagggagaatctattttaattatatacattgagctatttggcattatgagcattatagaaactaatctaacaaaatatgatttatgaggctaagaaattacttctcattacctaggtggaaaggggggattggggtaacatttagtgtgtcctatgatccctgtaagcagttggtagaatttgatttacatttctgatacacttttatttatttttgcatgtaaaagatctttgtccagatatattcaaaagtttgatggttttatgcctatgtggtatgtgtgagaaatctgaggtttgtgtgatacaaagtaactggccttttttttttttttttttcttttgttgatagagtggtttcctcctttgtaattcccctgcccagggccagcccatagctttattttcagatttcttcctttgagactgtttccaacatgaacttgtttttaaaatttcttatgtaatagatgatgtgttgaatcattcacaatttttaaaaaattagtttgcagatactcctcagacatcagtgtgttaagttgtggttatcttaaaaatatcaaagactaatactggaatatgtattctacacatatatcatttatttctttgatctttctatttgttgtaggtgtgttgatttctggttttctattctgtgattaggctctgcttgatttttgtgtaaatacatatgtgattttttttttcttgtgtttgctgaagattttttctttttcttccaagtcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaaactaaaataaagtcaataaagacaattctgactac

SEQ ID NO: 36154 - DNA, 16304 bp, Homo sapiens
cgaatccctgcttaaaggccttgctttcttgtctaacgccgcaaccagtcctctgagttgccaacgtctttcttcttgtctcgacgccccgtcgtccggccacagcgattctctgcttagcaggatcggtccacagcgggacgtgagtccctttcctcctcgcggcttaccgcctctctccgcctagtgccaggtgctaataaagttgttgtttcaaatgcggccaggaacatcgcgagcggggaccaatcagagagtagctttgcctctataacggcgcgagagtgagacgtcatcggtgagcgactaacgctagaaacagtggtgcgcggagaggagaggtgagtgtgatggagaccacggggagcgggaggctgggctcctgggtctgggagaagaagtgtgtgaggaaaaaggcgggtctttacagcttggtttttgtttttttgttgtttgtttgttttgagacggagtctcgttctgttgcccaggttggagagcagtggcgcgatctcggctcattgcaacctccgtctcccgggttcaaacgattcttctgcctcagcctccagagtagctgggattacaggcgcccgccaccacccctgactaatttttgtatttttagtagagacggggtttccccatgttggtcaggctggtctcgaactcctgatctcgtgatccgcccgcctcggcctcccaaagtgctgtgattacaggcatgatccaccgcgcctggccagttgtttgtttgttttgtctgagacggagtttcgctcttgttgcccaggctggagtgcagtggcgcgatctcggttcactgcaacctccgcctcccggattcaagcgattctcctgcctcagcctcccgagtagctgggattacaggcgcgcaccaccacgcccggctagttttttgtatttttagtagagacggggtttcactatgttggccaggctggtctccaactcctgacctcagatgatccacccgcctgggcctcccaaagtgctgggattacaggcatgagccaccgctcccggccttttacagcctgtttacccaaaagtcttaatatgcgcctaccatggtgtggccctggggatgtggaaggagcaaaaattgttcgctaccctcttagagctttggttgatgcctggcagacaggctttatcaaataattacttcattaatcacaaatgtgtgaagtgccttactgtagacacgcagagcgtgcgggacacgttatcacaaagcaacctcctgtagtctagagtggggcgtgtgggtcagggaggtggaacgtgagagctgaaggctgaggagatgctgggctactaagaagtgaggagagccagacgccatggctcactcctgtaatcccagcactttgggtggcccaggcgaaaggatcgcttgagcccaggagtttgagaccagcctgagcaacacagtgagaccctgtctctacagaaaaatttaaaaattagccgggcgtgctggtgcgtgcctgtcatctcagctatcgggaggctgaggcgggagaatcgcttgagcccaggtgatcgaggctgccgtgagctatgatggcgccactgcactgcagcctaggtgacagagcaagacatggtctcaaaaaaaagaaaagaaaagaaaaaacaaagtgaaggaaagggccactttagttacaagggactcctgtacaaagacctggaggcgggaagagaccgataatgtaaccaactcaagtttctgctactcagaggcagaggaagtggggggtggtgaaagtaaagcagctttactgatcaaatgctcgcagatgagaaatggccaagctaatgtctttagaagaccatttcaagctttaggctggggagaggggcttaaaaaggggaactttgaatgggaggcatacaggagtggtgctgggtacaaggtatgtgtgtcttgctccgaaggctgtcttgagtcacgggccacctggagcatgggctggtgtcaagtcaacaatggccacgttgtagattgatcgccttgaggtgatctctggagttttgcagctgggtttccatacctagtttgtttcaagattagcccctgcggcgaggcgcggtggcttacgcctgtaatcccaacagtttgggaggccaaggtgggtcgctcacttgaggtcaagagttcaagaccagcctggcttacatagtgaaaccttgactctacaaaaaaaaaaaaaaaaaattagctgggcatggtggcaggtgcctgtagtcccagctactcaggaggctgaggcaggagaatcgcttgaacccaggaggtggaggttgcaagtgagccaagactgcgccactgcactccaacctgggtgtcagagccagactccatctttaaaaaataaataaataaagattagcccctggaacttctaagtaagcacatagataagccagcagtgcaagacagtatctagtgggaaaggagggaaacaaagaatttcaaagtatgttttcaaggctaaaggcaagaaaggaataagaaagtttgcaaatgcatttggaatctacaccacttggttccagtaagtcttagcaaggtggcggtcataggggtgtgctgcgtcttgcacaggtcggagctggagactcgccagtgaacaaaacaaactaaagcacctgttgtcgtggagcctgcatgctagtggggttgataaagaaggaccagggtcttctgggggagaatcatcgctcagtaataaggagggactttgtcggggcaagtttttagggaacgctgctgtccctccccaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatggtaagaggacaagaggtgttcctagcagggggctctagacagaatctcccagaagggggtgatacaggcttctttttgaagagtgctggattctgactgtcttctcctttcctacagtttgctgagattatgatgaagattgaggagtatatcagcaagcaagccaaagcttcagaaggtgcttcctcccactctgtgcccctccccatctcctgtctctcctgccaggccccctggctccctggctgcttgtggctgggtatatctccttctcagccttttccagagccttcttttttttttgtttcaccccaacccgttcccttttccactaaatatatattgcattgtaaagctcatgcttcttaagtccttcctgtgtgctgagcttactgatcatgataggactcagcttgaggtttcccagacttcactgattcacatgaccggttacagggtttttgccacatctataagccgcttatcctattatttgcttaacatattctttgagtctaggactttttttcttaaatttatctgagaaggaagcaaattgctaccatgaatggaaaactggtatcatttggcaaagacaaagtcactgtataaaaatagatatataattatttaggaaccacctaaggccgggcgccgtggctcacgcctgtaatcccagcactttgggaggcggaggcaggtggatcatgagttcaggagatcgagaccatcctggctaacacggtgacaccccgtctctactaaaaatacaaaaaattagccaggcgtggtggcgggtgcctgtagtcccagctactcaggaggctgaggcgggagaatggcgtgaacctgggaggcggagcttgcagtgagccgagatcgtgccactgcactccagcctgggcgacagagcaagactccgtctcaaaaaaaaaaaaaataacctaaaaccttttctcatgcccaaattgagagaacactagcttatctcatgagtgctcagactcactcttaagagggcagtcctgttaccattcctattcttttttttttttccttgagatagagtctccctctgtcgcccaggctggagtgcagtgatgtgttcttggctcattgcaacctccacctcccgggttcaagcgattctcctccctcagccttatgtatagctgggattacaggtatgcaacaccatgcctggctattttgtattttttagtagagatggggtttcaccatgttgaccaggctagtctcgaactcctgacctcaagtaatccgcccacctcggcctcccaaagtgctgggattacaggcatgagccactacgcccagccttcccattcttcttgaatggaatttgttgatgacaggaagccataggaggtttctggggaaagaagtgtagtgagagggcagagtttcgggagactcactgcttgctttctttaacgtttacctgggcacccagttgaatcgcccaggtctttgctctcaaagtactcaaggtctagtggaagaggcaggccaggttccagacagctatcagtggtggtaccaagctggggacaccggagccacaggagggactggctgaccctgccccaggtgtcaggaagaatcgatagctgaattggactgtagagcatgaatgcatgtgccaggcaaagaaagggagaagggggcccagggaaagacagcggcaggcccggggcctcagatatccggagagagaatcctgcagagttccagatgccaggccaaggaatttctccctccagagggttatgggacacagaaagtgacatttcctgatgtcaggccaggctcagggatggagtcagaccccgtcacacccggtgtctggttgaggaggcagaggtgaaacatctcacaagctgtggcagtccctgtttactggaggtgcacaagtgctgcgggtacacagaggaggcgtctgatccttccagaaagggagggaaggattctgagtcgctgcctgagtcttaaggacttaaagagccatttgagcatcagggttaggagtgcagactctgacgccgccctgcctggtgtcagatctgagctctgccttctactggctgtgacatcaggcagttagtatttgcatgacttttaaacacaacatctttttgtttgtttgttttttgagacagggtctcactctgtcacccaggccagaatgcagtggcacgatcccagctcactgcagccttgaccttgtgggctcaggcgttcctgcctcagcctcccaggcagctgggaccacaggtgtacaccaccatgcctggctaattttttttctttaattatgtgtagagatggggtctccctatgtcgcccaggttgctctccaactcctgggctcaagcagttctcctgcctcagcctcccaaagtgctgggattacaggtatgagccactgtgcctgacctcttattactaaagcacaaagaagcgttttccagaaacagacgtggggtaagggatgctctggggagagggagcagcacatgcagaggccaggaggggtctggcgcggtggctcacgcctgtcatcccagcactttgggtggtcaaggcagatggatcacctgaggtcgggagttcgagaccagcctgcccaacatggtgaaaccccgtctctactaaaaatacaaacaaacaaaaaaaattagccgggcgtggtggcacatgcctgtaatcccagctactcaggaggctgaggcaggagaatcgcttgaacccaggaggcggaggttgcagtgagctgagatcatgccactatactctagcctgggcaaccagagcgaaattatgtctcaaaaaaaaaaaaaaaggctaggaggagtgggtgtctggggcactgtgatcactcctttatggctggagtggaataaaatgaggtgtggtgagaggatggggcgggaagggcgggaggccagactgcagagctgctgagtcagcaaacaggaacgggggaactccctgtgtgccaggtgctgtcctgggtactcggctgtgggtacagccaacgcaggcacagcactggtccctgcagagcttccggagttggggaggccctgaatgtcagtctgaggactcggtcattagccttggggctgtggggagccgtaggaggtttcacacggtcagttctggggtagatggggtcaagtctagactggtgtggagggagagggattgaaggcaggaacacaagttcagggatgtctgcagacatcagcctgtccctggtttactcttcagcccctccttcctgacccctcccaacttcatcctccgcctcctccagctgcgggacccgagagggggtagggatttagatactcacacccatgcctccgtgtcctcacagtgatgggaccagtggaggccgcgcctgaataccgcgtcatcgtggatgccaacaacctgaccgtggagatcgaaaacgagctgagtgagtgctggggggcaggcggagacagccccgtgtgacgtccctcacgccccctctcccttccccactggcctttcccagggtcctgcccctaagcccaagctcagatcgaggttgacctgctgtcacagagtggctgaaataagaaggaagtgcgttctctcgcgtatgagtctgaggagcactcggggatggtgtggccgcttggctgcctgtagggccccggctctttccatcctgttggtcggccacctgcctcacggtgcgaggtgactgccccacctccagccatcacctccgcattcccaccagcaaggcgcttcttttctttaagaacatgtcactgcagctcacgttttacagaccagaactaattcccctggtcacacctagcggtaaggacggctgagaaaggctgtatgctggtgcccgtgtgccaggccacaagccagggcttcagttactaaaggaagaaggggacatgggtgttagggccaaccagcagagtctaccttccatctcacccgacaacctcctgtcccgtttaccctagacatcatccataagttcatccgggataagtactcaaagagattccctgaactggagtccttggtccccaatgcactggattacatccgcacggtcaaggtgagcgcagagaaggtggggtgcttctgctggcgtgaaggggcaggcggggctcactctcggaccccctcccagaggcctcagggtctggagacgatggagaggagtggacgagggctcagtggtctgctctgcccagcgtgggagggacggagcctggacaggactttctcagggctcccctccaaccccagtctcccgagagggcttccccgctggcctgacccacgctgctcccgctgtggttggagccggtggcattggagttgacatccgaaggttgacacagggcaggcacacggagatttggggcagagagacgtctaagtgcagagagctggagagggaacaagtggggaggaagtgaggcggggaaggaggggacggggaagaggtcggatcacgtccagcctttgggtcttaggagaaagccaaggaagggtttcggaaaagaggggcaggtgtgcgtgagggcggggagaggaggaggtccccacgcatgtccaggaaaggattaggatggcggtggggaagcccctgcagggaagcgaggccgcggatttgcactccgacttgacgcaggccagaggcttgtgaggccacagtctttccagacgccactctgcccgggctccgtttccaggtcagcgaaagcagggcagatggtgtggatgcttgacgtggtggaggcaggaatggtgtggatgcttcaggcggtggaggcaggagaggcccccagtgcagagaccctgactgtcccagtgtccctaagaagagacctgaggaggtgctgagcaagagaggttctcgagccttcctgagttcccgagcctcccctatcttctctgctcgcccccaggagctgggcaacagcctggacaagtgcaagaacaatgagaacctgcagcagatcctcaccaatgccaccatcatggtcgtcagcgtcaccgcctccaccacccaggggtatgtccgcttcgagggaggcgccgggccctaatgggattggggattaggctggagctacacacgcaggtgtacacacgcacacacacatacacacatgcacacacacacacagaaccgagagggctggggctgggcacaccaggcaggcgggagatccaggaggctgggcccacccgcccctgcaggcagcagctgtcggaggaggagctggagcggctggaggaggcctgcgacatggcgctggagctgaacgcctccaagcaccgcatctacgagtatgtggagtcccggatgtccttcatcgcacccaacctgtccatcattatcggggcatccacggccgccaagatcatgggtgagtccccgggctgggtcccatggagcgggggtctgctgacactgtgaccttgggaaagctacatccttttctgtagaatgggggctttggcacctggacctcagcaccccgtctccctggacatcacagaggtcagccagcctggcacacagcaaagcctcgtctgtgggaaaaacactcacccacagctccttctccctcccctgtgccggaaacccagagatgaccacacccaggccctgttgtcagggagctcctggtttggtgaaaatggttccaaaacacagccatccctggaacggcgttagtgtggcttagcacaaacgtggtggtcagcttcctgttgggggcctcctccctgcacccccaggccagctgccctccctctctgagcctcctttgcatctgccccttgcggaatgggccaggtcgcccgcctggcagggccatcgaggaatccaaccagaacttcatgtaaaggtgcccagcacacgtcgagcccccaggcagatttactcacccccacctctctgctttcttctgaccgcccccccttcctccctccctcccaccgcaggtgtggccggcggcctgaccaacctctccaagatgcccgcctgcaacatcatgctgctcggggcccagcgcaagacgctgtcgggcttctcgtctacctcagtgctgccccacaccggctacatctaccacagtgacatcgtgcagtccctgccaccggtgagcccactgcgtcatggcccctcccccggcccccctggagccttccgctgtgcccagacagcctgagcagccacccaccatctggcccagctgacggtagcactcaggagctgggaacagggtggcatgggacgtgagagccagggctctgcagcagaccagctccagcacccaccagtcaggtgactgtgggcaagaggcatgagcgccctgtgcctcagtctcctcccctatcaaatgggagcacagcgcctgcttcatgagttgggacgagggctcagtgcacatgaagcacttacagttcaggcctagctcacgacaagcagcgtcgggttagcgtgcaactgctccgaagaccaccctcaggtttgaccattcactagaaagactcacagaatccactgagggctgcacatcagccatggggagagacacacaggaggggcaggagaggtcaccaacctcggagcttcccgggtcctctccctgcagtcgggacacatcaccatcccagcatcgacgcctgacagcacacacacaggcccgctagcctggcggggcgcagtggctcgtgcctgtcatcccagcactttgggaggccgaggcgggcagatcacctgaggtcaggtgttcgagaccagcctggccaacatggtgaaaccccatctctaccaaaaatacaaaaaactagctgggtatagtggcacacacttataatcccagctacttgggaggctgaggcaggagaatcgcttgaacccaggaggtggaggttgcagtgagctaagatcataccactgccctccagcctgggtgacagagtgagactctgtctcaaaaaaaaaaaaaaacaagacaggttctgggacagacaggcctgggtccagaccctgctctgtccgactgtggcgagttacctcaggctcacggccctgtgccctgcctggcctcccccagggatggggagaacaatagcactgatggccaaggctgggcaggcacttcctggccccaccccccagccctgtgtggggttttttttgtggtcttttctgcgaccctttaggtcaggcactgctactggaacacacccagggaggctggcaggtcaccccatcctgggaggagagagagtgggcgatagaacccaggacgggtgggcctggggctcggggctccagctgcctcactgcacccctgccatcgccaccgcctcacagccctgggcatatgggttaaacctgccccagggagcctgatgtcttgtcacccaggcctctgcctcttcatttggccatctcacatcggtccaggcacaggccgtagacaccacaggcctgtaagggaggccagggctggccatcgcttcactgtggctgacagctgggctctgtttgcagtttggattggaaccctggctccatcacctgctggctgtctccctggccacatgacttgaagccttggtttccacatctgaaaagggggtgcaatgatcacaccagcccaatatttgaatatttgatgagatgatccgaggggcgtgcttagcatggggctggcatccaggccgagtgcactccccccggcgtctccacagtcaccaccgtcctcgttgtcagcgtgccttactgtcatccttacctgatggccacttatcagctgggacatggctctgtgccctgccctcatcccctcttcctgtgaagtaggagctgagagcacacacctctagagcccaagggtggaaagcccccttccaggaccccaggtagagccagaggaggagcgcgcgcggttgctttgctgttacctctgtctgtctgtctcacacagattccacccccgttttccgttgctccaggatctgcggcggaaagcggcccggctggtggccgccaagtgcacactggcagcccgtgtggacagtttccacgagagcacagaagggaaggtgaggagggaaaggtgaggggcggccgggcgtcttttcctctgggcctggggtgtctctgcagggagaccctcagcagggagcccaccccagcgagcactgtcctaccaaggcggaggcagtgcttctgcccaccctccctggggtcaggcacccccttccccagtggggtttcctaggtctgctgttggaaggtagcatgaacctactggcttcaaacagtgcaggtgtggccgggtgcagtagctcacgcctgtaatcccagcactttgggaggccagggtgggcgggtcacaaggtcaggagtttgagaccagcctggccaacatggtgaaaccccatctctaccaaaattagccgggtgtggtggcacgcacctgtaatcccagttactcaggaggctgaggcaggagaattgcttgaacctgggagacggaggttgcagtgaactgagattgcatcattgcactccagcttgggtgacatagcgagactccatctaaaaacaaaaacaaaaaacagtacaggtttattatctgtggtcctgtaggtcagaagtccaaaatgagtttcactgggctgaagtcagggtgtcatcctggagcgttccttctgggggattcaagggataatccattcccttgtcttttccagcttctaggggtcactggcaccccttagctcgtggccctccctctgtctgcggagccagccacatagcaccctcagacctctctctgactctgcttctgtcttcatatctcggcctctgtttttgttcccctcttctattttaagggcccctgtggctatactgagcctactcagatggtccaggatagtcttcccagctcacaatccttaaaatccttcttaacctcttcacgtcccttttgccctgtgattctgggaattagaacatgggcctctttgggcatgtgtgtgttggtgggggcgtaatttgccttccacaccaggatctgtccccgctgcaacaggggatgttattcaagtaattattcagttaccttctgtcttccttggtagatgtactcgggagaggagacgttttctgtcttgtgaactgtcgtttgccaagcacccggcctggcacagcgttcaggtgttccgtgtccccttctcctttccctctccccatctcacccctggtctgggtgtgggggtgcagctgtgagtagcacagacaggacccctgccccgtggcgtggacattcttgttggggccgggtcaaagagacagtcaacaggtgaactctgtcctgcgtctagcggtgctaagtcaacaccaagaagaaaaagaaagggggtggcggtgaggcagcattaggtgctgatttaactaaggcacgtggatactcggggggtccgctcagaggaggcctgggtgggcagcccacgcgagcagctgcaggacctccccctcgccctccccaggtgggctacgaactgaaggatgagatcgagcgcaaattcgacaagtggcaggagccgccgcctgtgaagcaggtgaagccgctgcctgcgcccctggatggacagcggaagaagcgaggcggccgcaggtgaggggccctgggggtccggtaggcatgggggtcatggaggggagaagccggcgtcctcctcccagccgactccctggcgccgcccacccacccgtccccaggtaccgcaagatgaaggagcggctggggctgacggagatccggaagcaggccaaccgtatgagcttcggagaggtcagactcccagagcgccctcctcaaccccacagccagccagccgccaccgccctctgcctcctgccaccgcccctcctctcgtcctgtggccctggctcatgtctagggcgctgccccagcctcctcccccccggcctctattctcgtttccatccattcagccccaaagcgaccctcgcggcccttggagcctgtgtctccgctgcttagagcccccgcggcttcccatcgccccgggctccttggccggttcctccctgcccagaggctccttagtgccctgctgcacggccgccccgtccctgggccccgccagtctcctctgttatcccagcgtcatccccttggtcctgcaggaccgaactcagaggccacctcatcctattaaacctgttctggttcctgacatcccccgacccacacgagtaaggaaggaatggcctcccaactctgagctcacagagcagtgctgggaccgggcccctctcaggctccccggcatcccccgcgtgtgtgggcccccaggcctcagccgggccgagtgggtaccggagcaggtgcccgtgggaccggccggctggtgaccgctgggcttccggctggtggagggggtgcctcggtggctggagggcagggcctggtcgctgaactgcagggcgcctcctcttccccctagatcgaggaggacgcctaccaggaggacctgggattcagcctgggccacctgggcaagtcgggcagtgggcgtgtgcggcagacacaggtaaacgaggccaccaaggccaggatctccaagacgctgcaggtatgggccagacccaggtggggctggggaccgagggacacaaggtggggggagcccagatcgcagcctccctgtcctccccacagcggaccctgcagaagcagagcgtcgtatatggcgggaagtccaccatccgcgaccgctcctcgggcacggcctccagcgtggccttcaccccactccaggtacctcccctgggccggctctgtccccagccctgagaccttggcaaggccccttgccctctgcccctgtgaagaaggccaggatgagtctcctcatggggctgttgtggagggtgtggtgacgaggtatgcagaggacgtagacagctcctggcacacaggaagaggttagcagagacgagagcccagcgctgagcagtcctcgtgagcacgcactgctttagaaccaggcccacagctgtgttcagggcacccagttcctctgtcgggctgtgagcgggtaacactgctcagcctccaggccctccagttcaaaacggccaggacggttaaggtaacctcaggaccccactcgagaaagttcccggctaggcgggcttggatgtcaagtgtgggtccaggccccagccagtcagcagtgagcagcgtggagcatggcagtcaccgcatcgtcggagcctcggtttaccatccacagagcagggcgagcctgcaccacggaggcgagacagcagcgagctcatctgcccagtcagcgggtgtctacgcagcacctgctgagttctgtcagtgttcccggctctggggatgaagcaacgaatgagagacaagtcttaccttcttggagccagtgggtggccgggcgcagacagctcagtaagatgtccagtgtaggagaaggcagaaatgccaggccgggcgcagacagctcagtaagatgtccagtgtaggagaaggcagaaatgccaggctgggcgcagacagctcagtaagatgtccagtgtaggagaaggcagaaatgccaggccgggcgcagacagctcagtaagatgtccagtgtaggagaaggcagaaatgccaggccgggcgcagacagctcagtaagatgtccagtgtaggagaaggcagaaatgccaggccgggcgcagacagctcagtaagatgtccagtgtaggagaaggcagaaatgccaggctgggcgcagacagctcagtaagatgcccagtgtagtagaaggcagaaatgccaggccgggcgcggtggctcacgcctgtaatcccagcactttgggaggccgaggcaggtggatcatgaggtcaggagatcgagaccatcctggctaacacggtgaaaccccgtctctactaaaaatacaaaaacttagccgggcgtggtggcgggcgcctgtagtcccagctacttgggaggctgaggcaggagaatggcgtgaacccgggaggcggagcttgcagtgagccgagatcgcgccactgcacttcagcctgggcgacagagccagactctgtctcaaaaaaaaaaaaaagaaggcagaaatgccagggaggggaggaggtggaaggtaggaggtgggacaggggaggctctcgtttcggagcagccagggagggcctctttgagaagatgaggccagtggctgtgcctttccaagcctcccctcctccatcatgaggtgctcaggactgaaaagaacgcacaggaagcacttggcactgggctcaccattagagcccaatgactgggtcctgttattatttttagagacgggggctcgctctgttgccttgaaaatatttaggaagtgccagccaggtgttggctcccattgctgccactatgatcgtcagtggtgttggtgtgatttgtgctaggacctcgggccagccatgtcccccagggactcagtttccttatgcagaaactgggcaggattggctgtcctcaagcattggttgtttttagcacccctgaggaacttcgtacaaatccaggcgccctggttcctccccaccctctccctctagacccactgagtcagaatctcccaagacagggcaactccagggacaggcaaactgtctcatgcccaccaaggcctgagtgccatggggaagggcctggggggctctgatgggtcacagttggggccttctcctcacctaacccatcatcctctctccctcacctgcccagggcctggagattgtgaacccacaggcggcagagaagaaggtggctgaggccaaccagaagtatttctccagcatggctgagttcctcaaggtcaagggcgagaagagtggccttatgtccacctgaatgactgcgtgtgtccaaggtggcttcccactgaagggacacagaggtccagtccttctgaagggctaggatcgggttctggcagggagaacctgccctgccactggccccattgctgggactgcccagggaggaggccttggaagagtccggcctggcctcccccaggaccgagatcaccgcccagtatgggctagagcaggtcttcatcatgccttgtcttttttaactgagaaaggagattttttgaaaagagtacaattaaaaggacattgtc

SEQ ID NO: 36155 - DNA, 18690 bp, Homo sapiens
caggggccgaagagtcaccaccgagcttgtgtgggaggaggtggattccagcccccagccccagggctctgaatcgctgccagctcagccccctgcccagcctgccccacagcctgagccccagcaggccagagagcccagtcctgaggtgagctgctgtggcctgtggcccaggcgaccccagcgctcccagaactgaggctggcagccagccccagcctcagccccaactgcgaggcagagaggtgagtgtctcaggcaccctgaggcctggcagagagggccacaggctctgcgcgggagtcttcgaactgggatctcccccttctgcaagcagctttggctcagagaggctggcgtggattcagtcacacagctgggatctggagttccgtggttggctccaggtgcttccgtctaggggccagagcaggtgtgggcagagcaggttccccgcagtctccacggcaccgaggtcctggcaggggagctcctgggagacgaaagagggcaaagaaggggagaggggcagggagagagcgggcagccaaaggggagaagatggggggcagaaagtgggtagagagggaaaaagggaaaatatcattggggaagaacctaaaaacccaaggaaagctgggctctgctgggggctgtgagacccccgggttctccccgccccaggctgctggccatggggtcttgcaccaatggcctgacctttctgtcggtctgtatttatcaaagtgggtgacagtctcaggcctcctggctgttcagaattgaggtaataaccagaggccttctgagcaaagggcctaaggggctccggcgtcaggatcccattgtggtcaggagcctgcggggcttcccgtgtgcaagaggggtgaaaggtggctagaaaggcccagccagtggcctctgcctcagccagagggagctctgtagtgggggcagcacccattcactggtcaggcactggggtgacaggggaggctccaggacttggggagcgttggagctggaggcacatggattggagtccctgtacctgccccacgacagggcctgcagggagggatccagcaggtgactcttcaggctgatttgcccatcccagatagaagccgggagtgttctttcaaaggtgtctttaccttagacactcaataaaatggtaacacagtggcgccgcctcagtcctttggagtgtgcaccgtctgaacccctctcccagggccctctcccaagcaccccaacctggacccatatcccccacgtacttttggctttgggcagattgagcagccttggggtggtctgtgctgtctggtgtggagggttgcagttcgggtccttagtcctacttcccaggccggccgggctgacgccagcgagtgtgtccttccccagcgaggggagtgagcgcaaggtcagcgcctcgtctgcggcgccctgcagggggtgacggaggggcgctctgaggacccttggagaaaggagctgggtttgtaaaatgctgggcttggtcccacggacggcggagcggtgagctcagagccagagctggggaggaaatgggaatgagaaaggcccacttcagggctggtgagcgaggggatggggagcagccacaggccgaggctggggcatgggccaggctccatggggtgagtctgagtccttgaggggatgttcatcctctgtggaatgtgggtttgccagtggagaggagaccagcgttgccctggtgaggtgctggttcagggctggggggcggacgctgcttggggctaaagttcctgccggccaagctctgggtgggaggagaccctggccccctcccaacacccttggactgctggcgggacccttcctacctccgggggctggaagtagtgggggaggagccagtcttgaggaagaaccccgatgctggtcttgactagaggggagccggtgtgcttttcgagcctcagggtgacccgcgtctgccccagcctccagcctgccctggtcacttctgactaaataaggagagcactcagcaggcagccccacgagggagggggaacatgtgtgcacccccactcccccacctgctcctccctccctacagggccactacaccctgctgtgggcaccccaaggtgaccctcagccttcttcctaccttaaaaagtccaggcatgcattttcaagcatgagcggtggccccctgggggaaggcacctcggcagggcagaacaaagggaagggacccccaaacaggtcactggtgtaattgtccccagcacccccaaagaggaggagaacccacaactcggaactggggctcacccccgatgcccaacctgtccccagcctgggaagcaggcgtggaggagaaggtggggggagcctagagctggccctgggggccctggttttgtccatgacgggagcctcggcaacctagtccgctctcccggggaccaggtttgcagacaggcacctttcaaatgctcctcacccccaaatttacaagtcaccctgcagaggaaaacatcaacacagccaggggttctctgctggaggctcccccttctataggcacagccggagaggccagagagctggggacacggggaggctgcagaaggctggtgggaaggggggcagtgatgggtggggagagatgggccagatgttcttggaatgggacatgggggtgattgatgcagacagaaatttgaaggggacattcccacgtgtcttgttctgtgggtggaaaatgggctgtttttcatggtgggggcgggttctccctgtcttgccaagctaatgtgaaagagatgcctcatcctgcccagctccccacacctgtccaaggccattaacttctgcctccccagtgtcaggctttgagatgccccccttctagccggggtcctcctatggggtgacaatggggacaagcaatgcccactgtagttgccccaggatcccccaccattctgctggtccccagcggtgccccctctctggcagtacccccacccaccccacaggtccccttagggccactgccccatcgcccgacattgcccaacgccaaggggtgaccttgttcctgccgacagggccgttgggcgcctgcatgcgggtttaatatttgcctataaggaactgggctttccccagccggagtggacagactttccctgaaaattcgcttggagagaacgaaaagagacccctggcaccccagcggcgtgcagccctgcacccccctcctcccgggccccgtgtttctcattttcctccccacttcctctgctcttcagtgttacccaaacaaaactggtttcacccttgtttggtgctggcgaaggcccgaacggcgcgcgcaaagctccggggcaggccggaggtggccaccgggggtgctccgggcccccaagccaagccggggactagcctgcccccggtggcggctcggccgcggcttcgcctaggctcgcagcgcggaggcgagtggggcgcagtggcgagggggagcctgcggacctcccacgcggggaccgagcaggtatctgggagtcccgggagcgcccgggaagcagcgtcctggtcgctccctcgcggcccttgggtttcttccttacacccggacgcccgctaagctcgggctgccgccacaaacgcgctctccgtgtggagaaggcaaagaaaaaaaaaaataaaagcaaaaggaagaaaaaccccaaagaacgaaaagcagaatttcagccggccgtgcgcgccagggcgctccgcgctacctgcccgcgccgcccgcgctcgggttcccggggagggcgccagtgctccgcgcgcgccccagccaaggtgaatccccggcagcgccttccttccgctgcccgggaagcttgagctcaacaattagcccttgatcctcgggggattccaatccacggaacaacttccctgctttccccgaactcggacattttactttttctgggatcctctaaatttaagcattgcttcccaagtcttctaaatatactcaccatttcgacgggtcacaataattttcttggacgttaatttccggggacgtcaaaacacatcagtcccggcgggcttttccagacttacactatgtggcctggggccccagatgtgctttctcccaggctctggacagttttatacaccccctccaggtcccacagatttacaggccactaacccggcttccctaattttaaagacgaagcccttggtccgtggtggtcgcgctgaccaatttgcctggctccccaggatgtggacagtgccttttccacatttaggcattgtttccaaaacaagtggaactttcccgcataattttgaatattaactccagggtctcctaagcttactgtttccggcacacgtccgccccattccgcgcccccccaccccacccccgcgccccttcccgttcacctcagcatgggacatttgctgttgggtcccgcaaatctattcacactaacctgggttccctaaactttacacgttgaatcccaagtccctcatgacactcagcagggctggaaggttggaaccctcagagtatgaaaattgcttcccataccttcccccaaattcggtcattacacccagagcatgttgaatccttttctgaatcataaacgacctgccctctgattgcctgagtttcataaaatggagggatttccccagtgattccccaaagctattgagaatgttgtgggtgtgtgagtcacaaagctttggggcattaacgtctatggctctatatgctgcctggccacgaatcaggtcccttaagatgtagacagtgccacccaggtccctggagcacactgagcagttaccaggaggtgctcaagtgtgacccaggattctccaggtccccccaaatcacacagggtctcccgggtccctctgggctacaccaagcacaaaaggaccccttgggcagagcctacttttatttctgttatgccaggtgttgctaacggccccagttcccaaacattccgagcactttctctgcatcacaacatattgactattaaacaattctctgggtcccaggagcttcataacaagaatcttgcttttctaaaattcaggcattggtctgaaaccccaacggccaggatcacactggacccttttcctggtcccccatacttggatgttctggacgctgccctccaggccctctaggaacattcagcattgccctcggatcacaggacagcactgatttcttgggctccaaacaacccactgagtcatctcaaagttaagcaatatttccttcaagcacactgcacactccctatcacaaaatctgaaaattcctaagtcctaagacctaggaattctgaatcccctttctttaaaatgtacatatggacccccaagtcctccaaggactctgagcaacttccctagatctttagattcaaaaacgattttcctggagcccccaaattgcggtattgtctcccagccttccaaagcaaattgagatttttttcccttcacaaaacaattgaggtttttttttttttaatactgatttatgagtctcctgactttatggtccctgccctgggtccccctacatttagaaaatgttccatggacccccaaagcacactaaaaaatgtccctgggtcccaagaaatcccaggcatggaaaaacctgcgacctataagtttcctagctactaactaggtttccagaaatttagatatcaaatctccattgggtaatttccatgtgtcccaaaaacttgaaatgtgtttcactggggctcccccaaatgcagacgacatccaggaaaatatatagtctttttcttatttaccaaaaataagctaatggaaatcatttaaaaattagcatagaaaaataatactgattttttatttttttattttttattttgctttccccaaatgtactgatcacactccaggctcccccaaaatctagacagtgctttcttccatctctgaagggtgttaaaacctttccctgaagccacagtaattatgaaggttattttttccccggctgctgccagcgtccaggccactaacttatattcttaagatgtgaaaattaatctcagcttccccctaacacaccaagaatgtgtttggatccccaaaatgtgttccttgctttcatctgccaattttacgtaatatggctctacggcaaaattcccaatttcatatggagaattttctttaactacccctcctcacaaattggtcccccaagctagctggcccctatttgagacctctttctctatgttcccaattgcatggagcaacttctctcatcccccaaacctgtaatctatttttctggagtctcgagtttagtcattaatcacggttcccacattaacggagtccccggggtcccctcctccaggacacccattcgctaagcccgcaaggcagaaagaactctgccttgcgttccccaaaatttgggcattgttcccggctcgccggccacccactgcagcttccccaaccccgcgcacagcgggcactggtttcgggcctctctgtctcctacgaagtccccagagcaactcggatttgggaaatttctctctagcgttgcccaaacacacttgggtcggccgcgcgccctcaggacgtggacagggagggcttccccgtgtccaggaaagcgaccgggcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgcccgcggacgcagcctccagcttcgcggtgagctccccgccgcgccgatcccctccgcctctgcgcccctgaccggctctcggcccgcatctgctgctgtcccgccggtgctggcgctcgtctccggctgccgccggggaggccggcgtggggcgcgggacacggctgcggacttgcggctggcggctgcgctcgctcctgctgggcgccccgaaatccgcgccactttcgtttgctcattgcaaagatctcatttgtggggaaagcggctggagggtcccaaagtggggcgggcagggggctggggcgagggacgcggaggagaggcgctcccgccgggcggtaaagtgcctctagcccgcgggcctaggactccgccgggaggcgcgcgcggagcgcgggcgaagtgattgatggcggagcgaggggggcgaggggggccaggggggcgcgagattccgccggcggccccttccccttggctaggcttaggcggcggggggctggcggggtgcgggattttgtgcgtggtttttgacttggtaaaaatcacagtgctttcttacatcgttcaaactctccaggagatggtttccccagacccccaaattatcgtggtggcccccgagaccgaactcgcgtctatgcaagtccaacgcactgaggacggggtaaccattatccagatattttgggtgggccgcaaaggcgagctacttagacgcaccccggtgagctcggccatgcaggtaggatttgagctgtgtttcccgccctgatcctctctcctctggcggccggagcctccgtaggctccaagcctggcccagattcggcccggcgcagccggccttccgcgcgtcccgcacctggcgggggctccggggctccggcgcggcaccggggggcgctcgggatctggctgaggctccaagcgccgcgtggccggctcctcctgctggggcaggtggcggctgcgcgccccgcccgagcccaggggccccctcagccgcaacaaccagcaaggaccccccgactcagccccaagccacctgcatctgcactcagacggggcgcacccgcagtgcagcctcctggtggggcgctgggagcccgcctgcccctgcctgcccggagaccccagctcacgagcacaggccgcccgggcaccccagaaacccgggatggggcccctgaattctctagaacgggcattcagcatggccttggcgctctgcggctccctgccccccacccagcctcgcccccgcgcaccccccagcccctgcgaccgccgccccccccccggggccccagggcccccagcccgcaccccccgccccgctcttggctcgggttgcgggggcgggccgggggcggggcgagggctccgcgggcgcccattggcgcgggcgcgaggccagcgaggcccgcgcgggccctgggccgcgggctggcgcgactataagagccgggcgtgggcgcccgcagttcgcctgctctccggcggagctgcgtgaggcccggccggccccggccccccccttccggccgcccccgcctcctggcccacgcctgcccgcgctctgcccaccagcgcctccatcgggcaaggcggccccgcgtcgacgccgcccgctgcctcgctgctgactcccgtcccgggcgccgtccgcggggtcgcgctccgccgggcctgcggattccccgccgcctcctcttcatctacctcaactccccccatccccgcttcgcccgaggaggcggttccccccgcaggcagtccggctcgcaggccgccggcgttgtcacccccccccgcgctccccctccagccctccccccggcgcgcagcctcgggccgctcccctttccgcgctgcgtcccggagcggccccggtgccgccaccgcctgtccccctcccgaggcccgggctcgcgacggcagagggctccgtcggcccaaaccgagctgggcgcccgcggtccgggtgcagcctccactccgccccccagtcaccgcctcccccggcccctcgacgtggcgcccttccctccgcttctctgtgctccccgcgcccctcttggcgtctggccccggcccccgctctttctcccgcaaccttcccttcgctccctcccgtcccccccagctcctagcctccgactccctccccccctcacgcccgccctctcgccttcgccgaaccaaagtggattaattacacgctttctgtttctctccgtgctgttctctcccgctgtgcgcctgcccgcctctcgctgtcctctctccccctcgccctctcttcggcccccccctttcacgttcactctgtctctcccactatctctgcccccctctatccttgatacaacagctgacctcatttcccgataccttttcccccccgaaaagtacaacatctggcccgccccagcccgaagacagcccgtcctccctggacaatcagacgaattctccccccccccccaaaaaaaagccatccccccgctctgccccgtcgcacattcggcccccgcgactcggccagagcggcgctggcagaggagtgtccggcaggagggccaacgcccgctgttcggtttgcgacacgcagcagggaggtgggcggcagcgtcgccggcttccaggtaagcggcgtgtgcgggccgggccggggccggggctggggcggcgcgggcttgcgccggacgcccggcccttcctccgcccgctcccggcccggggcctgcggggctcggcggggcggctgagcccgggggggaggaggaggaggaggaggaggacggacggctgcgggtcccgttccctgcgcggagccccgcgctcaccctggcggcggagctgggggtggggtgggggcgtcgggaagggccgagggaggtgtgaggtgtctgcaggggcgacttcccggtcggtctgtgggtgcagggggtgccgcctcacatgtgtgattcgtgccttgcgggccctggcctccggggtgctgggtaacgaggaggggcgcggagccgcagaagcccaccctggtatgttgacgcggtgccagcgagaccgcgagaggaagacgggggtgggcggggccaggatggagaggggccgagttggcaggagtcatggcagacgccacattcgcgacatctcccccacaccccctctggctctgtccgcaacatttccaaacaggagtcccgggagagggggagaggggctgctggtctgaggctaagaagggcagagccttcgacccggagagaggccgcggcccctgcccagtgggcagcgtggaagtttccatacaaggaggtgggaaggagacccccccccccttcactgccctgtgcagagatgagccgggggtgcaggatgggagcccatggcacttcgctacgggatggtccagggctcccggttgggggtgcaggagagaagagactggctgggaggagggagagggcgggagcaaaggcgcgggggagtggtcagcagggagaggggtggggggtagggtggagcccgggctgggaggagtcggctcacacataaaagctgaggcactgaccagcctgcaaactggacattagcttctcctgtgaaagagacttccagcttcctcctcctcctcttcctcctcctcctcctgccccagcgagccttctgctgagctgtaggtaaccagggctgtggagtgaggacccccgctgccatcccactccagcctgaggcagggcagcagggggcacggcccacgcctgggcctcgggccctgcagccgccagcccgctgcctctcggacagcacccccctcccctcttttcctctgcccctgcccccacctggtctctgctccctcacctgctccttccctttctgttccttcccttcggccccctccttgcccagctcaggacttttcctgggccctcacctgctccgcaccgctgcatgcttcctgtcctgctttctgccggtcccctgacccggacctccaagttcagagtggtggggcttgttgcggaagcgcggcgagggctagagtggccagctggcggagtgtgctcttagaatttggaagggggtggcagagggggcggtgagaggactggccagggtccagtcaaggagatgaccaaggaggctttcagatcctcggcgcagctgcccactagtctttagagagggcatgcaaagttgtgcttctgtcccactgcctgctcagtcgctcacataatttattgcatcaaaaactcccctgggtctgcggagcgaaggctggggctgcccgcctggagggttccaccttctgcaggggcagggccaacttgctgtggtggctcccggcctcccacccccgagtgggttaacccggccctgtggccctgcagcctgtggagggggtgtgtcctaagactggcctccccttccagattgtagtctggggaacctggtgtcggacttcccaggtggcctgagctggtctctccagctcccacggggagagtttggtagcgcaaatagggagatgttctggaggcccctggccttactggttcgatttgaggcctggaaaggaggctctgggcgtgtgtgtgtgtgtttgggggtacccaaggcagactggagttggagaactgggtgactgggaaaacaaggtttctagagcatgggtggcgtggttgtgttaaccattggagtccttgacccaggcctggctcagctgcagactggaaaggtggaaaagccagggggaggggcggggctggcccagcaggactggcctgctgctttgagggcgatggtcctcctggaccccccctgctcagctgggggttgtggggaggaagggactggtcctcctggatgcacatgctctgtaggggtggggctgtctgccatcttggctggcgctggaggcctgagaagtggcgatgtgacgctgggctggccctgcccccatggtgtcataggacggaggccaggtcgggtgtccagcctgggcccctgcagctgtggatgccgctgagctcctgcaataatgaccgtggagatggtcacccctcgtgtaaaattactagtgcttcttgcaaatggaaggaactgggccttttctgtgtgcttctggacgcttcattctgcacatggccctgcgccctcacctcggcattatgacctgtgtgttacttttgtaataaaaataatgtttataggaaagccgtgctttcaattttcaactgaatttgtaggttggcaaatttggtttgggaggggcacctctggcctggggcttggcctggctgccccgctcacgccacttctctcccgcccccagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagtaagtagctgggaggggcttcctcagacctggtcaggcccctagagtgaccggtgaggacgcccaacctcaagccaggggagcacactcctaggtcagcagcccagccgcttgctctgagactttgaccttcccgccgcgtttctgagcacgtgcggtgtcccagggcatccacaccagctgcctttcccatcacacgcctccttcgaagggtgggccagaggtgccccctagacgtcaggggcactcacaggggtctccctgggcatcagaatttctgttgggggccgtgaggctcctgctcctgaggcaccgcacgcctagtgcagggcttcaggctctggaggaagagcctgcctttcttcctgcaccttttggacattctgacaagggacgtgcgttcggtgaatgatcagaattaaaatcaataaagtgatttatataattaaaatcaataagacaagtgcagttggtgggtggcaggggtgagcggtgcatgcgcctccttgggccccaaggctgccgtggggggtgcccacctgctgacctcaaggacgcttcagcctttcctcatgtttctctcttggttctccagcctgggggctggcaggtgggtgcatggcccattgtccttgagaccccacccccagataggggggctgggtggatgcagaggcaggcatggtgcctgggcatgcctgatggggcaggggaggggccgctccttactggcagaggccgcacggcttattccacctgacactcaccacgtgacatctttaccaccactgcttactcacgctgtgaaatgggctcacaggatgcaaatgcacttcaaagcttctctctgaaaagttcctgctgcttgactctggaagcccctgcccgccctggcctctcctgtgccctctctcttgcctgccccatttgggggtaggaagtggcactgcagggcctggtgccagccagtccttgcccagggagaagcttccctgcaccaggctttcctgagaggaggggagggccaagcccccacttgggggacccccgtgatggggctcctgctccctcctccggctgatggcacctgccctttggcaccccaaggtggagcccccagcgaccttccccttccagctgagcattgctgtgggggagagggggaagacgggaggaaagaagggagtggttccatcacgcctcctcactcctctcctcccgtcttctcctctcctgcccttgtctccctgtctcagcagctccaggggtggtgtgggcccctccagcctcctaggtggtgccaggccagagtccaagctcagggacagcagtccctcctgtgggggcccctgaactgggctcacatcccacacattttccaaaccactcccattgtgagcctttggtcctggtggtgtccctctggttgtgggaccaagagcttgtgcccatttttcatctgaggaaggaggcagcagaggccacgggctggtctgggtcccactcacctcccctctcacctctcttcttcctgggacgcctctgcctgccagctctcacttccctcccctgacccgcagggtggctgcgtccttccagggcctggcctgagggcaggggtggtttgctcccccttcagcctccgggggctggggtcagtgcggtgctaacacggctctctctgtgctgtgggacttccaggcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggtgagggtcctgggcccctttcccactctctagagacagagaaatagggcttcgggcgcccagcgtttcctgtggcctctgggacctcttggccagggacaaggacccgtgacttccttgcttgctgtgtggcccgggagcagctcagacgctggctccttctgtccctctgcccgtggacattagctcaagtcactgatcagtcacaggggtggcctgtcaggtcaggcgggcggctcaggcggaagagcgtggagagcaggcacctgctgaccagccccttcccctcccaggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaacccccttcccccccccccacaacaaccctcttaaaactaattggctttttagaaacaccccacaaaagctcagaaattggctttaaaaaaaacaaccaccaaaaaaaatcaattggctaaaaaaaaaaagtattaaaaacgaattggctgagaaacaattggcaaaataaaggaatttggcactccccacccccctctttctcttctcccttggactttgagtcaaattggcctggacttgagtccctgaaccagcaaagagaaaagaaggaccccagaaatcacaggtgggcacgtcgctgctaccgccatctcccttctcacgggaattttcagggtaaactggccatccgaaaatagcaacaacccagactggctcctcactcccttttccatcactaaaaatcacagagcagtcagagggacccagtaagaccaaaggaggggaggacagagcatgaaaaccaaaatccatgcaaatgaaatgtaattggcacgaccctcacccccaaatcttacatctcaattcccatcctaaaaagcactcatactttatgcatccccgcagctacacacacacaacacacagcacacgcatgaacacagcacacacacgagcacagcacacacacaaacgcacagcacacacagcacacagatgagcacacagcacacacacaaacgcacagcacacacacgcacacacatgcacacacagcacacaaacgcacggcacacacacgcacacacatgcacacacagcacacacacaaacgcacagcacacacaaacgcacagcacacacgcacacacagcacacacacgagcacacagcacacaaacgcacagcacacgcacacacatgcacacacagcacacacactagcacacagcacacacacaaagacacagcacacacatgcacacacagcacacacacgcgaacacagcacacacgaacacagcacacacagcacacacacaaacacagcacacacatgcacacagcacacgcacacacagcacacacatgaacacagcacacagcacacacatgcacacacagcacacacgcatgcacagcacacatgaacacagcacacacacaaacacacagcacacacatgcacacacagcacacacactcatgcgcagcacatacatgaacacagctcacagcacacaaacacgcagcacacacgttgcacacgcaagcacccacctgcacacacacatgcgcacacacacgcacacccccacaaaattggatgaaaacaataagcatatctaagcaactacgatatctgtatggatcaggccaaagtcccgctaagattctccaatgttttcatggtctgagccccgctcctgttcccatctccactgcccctcggccctgtctgtgccctgcctctcagaggagggggctcagatggtgcggcctgagtgtgcggccggcggcatttgggatacacccgtagggtgggcggggtgtgtcccaggcctaattccatctttccaccatgacagagatgcccttgtgaggctggcctccttggcgcctgtccccacggcccccgcagcgtgagccacgatgctccccataccccacccattcccgatacaccttacttactgtgtgttggcccagccagagtgaggaaggagtttggccacattggagatggcggtagctgagcagacatgcccccacgagtagcctgactccctggtgtgctcctggaaggaagatcttggggacccccccaccggagcacacctagggatcatctttgcccgtctcctggggaccccccaagaaatgtggagtcctcgggggccgtgcactgatgcggggagtgtgggaagtctggcggttggaggggtgggtggggggcagtgggggctgggcggggggagttctggggtaggaagtggtcccgggagattttggatggaaaagtcaggaggattgacagcagacttgcagaattacatagagaaattaggaacccccaaatttcatgtcaattgatctattccccctctttgtttcttggggcatttttccttttttttttttttttgttttttttttacccctccttagctttatgcgctcagaaaccaaattaaaccccccccccatgtaacaggggggcagtgacaaaagcaagaacgcacgaagccagcctggagaccaccacgtcctgccccccgccatttatcgccctgattggattttgtttttcatctgtccctgttgcttgggttgagttgagggtggagcctcctggggggcactggccactgagcccccttggagaagtcagaggggagtggagaaggccactgtccggcctggcttctggggacagtggctggtccccagaagtcctgagggcggaggggggggttgggcagggtctcctcaggtgtcaggagggtgctcggaggccacaggagggggctcctggctggcctgaggctggccggaggggaaggggctagcaggtgtgtaaacagagggttccatcaggctggggcagggtggccgccttccgcacacttgaggaaccctcccctctccctcggtgacatcttgcccgcccctcagcaccctgccttgtctccaggaggtccgaagctctgtgggacctcttgggggcaaggtggggtgaggccggggagtagggaggtcaggcgggtctgagcccacagagcaggagagctgccaggtctgcccatcgaccaggttgcttgggccccggagcccacgggtctggtgatgccatagcagccaccaccgcggcgcctagggctgcggcagggactcggcctctgggaggtttacctcgcccccacttgtgcccccagctcagcccccctgcacgcagcccgactagcagtctagaggcctgaggcttctgggtcctggtgacggggctggcatgaccccgggggtcgtccatgccagtccgcctcagtcgcagagggtccctcggcaagcgccctgtgagtgggccattcggaacattggacagaagcccaaagagccaaattgtcacaattgtggaacccacattggcctgagatccaaaacgcttcgaggcaccccaaattacctgcccattcgtcaggacacccacccacccagtgttatattctgcctcgccggagtgggtgttcccgggggcacttgccgaccagccccttgcgtccccaggtttgcagctctcccctgggccactaaccatcctggcccgggctgcctgtctgacctccgtgcctagtcgtggctctccatcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcaactcctttaacgctaatatttccggcaaaatcccatgcttgggttttgtctttaaccttgtaacgcttgcaatcccaataaagcattaaaagtc

SEQ ID NO: 36156 - DNA, 15253 bp, Homo sapiens
caggggccgaagagtcaccaccgagcttgtgtgggaggaggtggattccagcccccagccccagggctctgaatcgctgccagctcagccccctgcccagcctgccccacagcctgagccccagcaggccagagagcccagtcctgaggtgagctgctgtggcctgtggcccaggcgaccccagcgctcccagaactgaggctggcagccagccccagcctcagccccaactgcgaggcagagaggtgagtgtctcaggcaccctgaggcctggcagagagggccacaggctctgcgcgggagtcttcgaactgggatctcccccttctgcaagcagctttggctcagagaggctggcgtggattcagtcacacagctgggatctggagttccgtggttggctccaggtgcttccgtctaggggccagagcaggtgtgggcagagcaggttccccgcagtctccacggcaccgaggtcctggcaggggagctcctgggagacgaaagagggcaaagaaggggagaggggcagggagagagcgggcagccaaaggggagaagatggggggcagaaagtgggtagagagggaaaaagggaaaatatcattggggaagaacctaaaaacccaaggaaagctgggctctgctgggggctgtgagacccccgggttctccccgccccaggctgctggccatggggtcttgcaccaatggcctgacctttctgtcggtctgtatttatcaaagtgggtgacagtctcaggcctcctggctgttcagaattgaggtaataaccagaggccttctgagcaaagggcctaaggggctccggcgtcaggatcccattgtggtcaggagcctgcggggcttcccgtgtgcaagaggggtgaaaggtggctagaaaggcccagccagtggcctctgcctcagccagagggagctctgtagtgggggcagcacccattcactggtcaggcactggggtgacaggggaggctccaggacttggggagcgttggagctggaggcacatggattggagtccctgtacctgccccacgacagggcctgcagggagggatccagcaggtgactcttcaggctgatttgcccatcccagatagaagccgggagtgttctttcaaaggtgtctttaccttagacactcaataaaatggtaacacagtggcgccgcctcagtcctttggagtgtgcaccgtctgaacccctctcccagggccctctcccaagcaccccaacctggacccatatcccccacgtacttttggctttgggcagattgagcagccttggggtggtctgtgctgtctggtgtggagggttgcagttcgggtccttagtcctacttcccaggccggccgggctgacgccagcgagtgtgtccttccccagcgaggggagtgagcgcaaggtcagcgcctcgtctgcggcgccctgcagggggtgacggaggggcgctctgaggacccttggagaaaggagctgggtttgtaaaatgctgggcttggtcccacggacggcggagcggtgagctcagagccagagctggggaggaaatgggaatgagaaaggcccacttcagggctggtgagcgaggggatggggagcagccacaggccgaggctggggcatgggccaggctccatggggtgagtctgagtccttgaggggatgttcatcctctgtggaatgtgggtttgccagtggagaggagaccagcgttgccctggtgaggtgctggttcagggctggggggcggacgctgcttggggctaaagttcctgccggccaagctctgggtgggaggagaccctggccccctcccaacacccttggactgctggcgggacccttcctacctccgggggctggaagtagtgggggaggagccagtcttgaggaagaaccccgatgctggtcttgactagaggggagccggtgtgcttttcgagcctcagggtgacccgcgtctgccccagcctccagcctgccctggtcacttctgactaaataaggagagcactcagcaggcagccccacgagggagggggaacatgtgtgcacccccactcccccacctgctcctccctccctacagggccactacaccctgctgtgggcaccccaaggtgaccctcagccttcttcctaccttaaaaagtccaggcatgcattttcaagcatgagcggtggccccctgggggaaggcacctcggcagggcagaacaaagggaagggacccccaaacaggtcactggtgtaattgtccccagcacccccaaagaggaggagaacccacaactcggaactggggctcacccccgatgcccaacctgtccccagcctgggaagcaggcgtggaggagaaggtggggggagcctagagctggccctgggggccctggttttgtccatgacgggagcctcggcaacctagtccgctctcccggggaccaggtttgcagacaggcacctttcaaatgctcctcacccccaaatttacaagtcaccctgcagaggaaaacatcaacacagccaggggttctctgctggaggctcccccttctataggcacagccggagaggccagagagctggggacacggggaggctgcagaaggctggtgggaaggggggcagtgatgggtggggagagatgggccagatgttcttggaatgggacatgggggtgattgatgcagacagaaatttgaaggggacattcccacgtgtcttgttctgtgggtggaaaatgggctgtttttcatggtgggggcgggttctccctgtcttgccaagctaatgtgaaagagatgcctcatcctgcccagctccccacacctgtccaaggccattaacttctgcctccccagtgtcaggctttgagatgccccccttctagccggggtcctcctatggggtgacaatggggacaagcaatgcccactgtagttgccccaggatcccccaccattctgctggtccccagcggtgccccctctctggcagtacccccacccaccccacaggtccccttagggccactgccccatcgcccgacattgcccaacgccaaggggtgaccttgttcctgccgacagggccgttgggcgcctgcatgcgggtttaatatttgcctataaggaactgggctttccccagccggagtggacagactttccctgaaaattcgcttggagagaacgaaaagagacccctggcaccccagcggcgtgcagccctgcacccccctcctcccgggccccgtgtttctcattttcctccccacttcctctgctcttcagtgttacccaaacaaaactggtttcacccttgtttggtgctggcgaaggcccgaacggcgcgcgcaaagctccggggcaggccggaggtggccaccgggggtgctccgggcccccaagccaagccggggactagcctgcccccggtggcggctcggccgcggcttcgcctaggctcgcagcgcggaggcgagtggggcgcagtggcgagggggagcctgcggacctcccacgcggggaccgagcaggtatctgggagtcccgggagcgcccgggaagcagcgtcctggtcgctccctcgcggcccttgggtttcttccttacacccggacgcccgctaagctcgggctgccgccacaaacgcgctctccgtgtggagaaggcaaagaaaaaaaaaaataaaagcaaaaggaagaaaaaccccaaagaacgaaaagcagaatttcagccggccgtgcgcgccagggcgctccgcgctacctgcccgcgccgcccgcgctcgggttcccggggagggcgccagtgctccgcgcgcgccccagccaaggtgaatccccggcagcgccttccttccgctgcccgggaagcttgagctcaacaattagcccttgatcctcgggggattccaatccacggaacaacttccctgctttccccgaactcggacattttactttttctgggatcctctaaatttaagcattgcttcccaagtcttctaaatatactcaccatttcgacgggtcacaataattttcttggacgttaatttccggggacgtcaaaacacatcagtcccggcgggcttttccagacttacactatgtggcctggggccccagatgtgctttctcccaggctctggacagttttatacaccccctccaggtcccacagatttacaggccactaacccggcttccctaattttaaagacgaagcccttggtccgtggtggtcgcgctgaccaatttgcctggctccccaggatgtggacagtgccttttccacatttaggcattgtttccaaaacaagtggaactttcccgcataattttgaatattaactccagggtctcctaagcttactgtttccggcacacgtccgccccattccgcgcccccccaccccacccccgcgccccttcccgttcacctcagcatgggacatttgctgttgggtcccgcaaatctattcacactaacctgggttccctaaactttacacgttgaatcccaagtccctcatgacactcagcagggctggaaggttggaaccctcagagtatgaaaattgcttcccataccttcccccaaattcggtcattacacccagagcatgttgaatccttttctgaatcataaacgacctgccctctgattgcctgagtttcataaaatggagggatttccccagtgattccccaaagctattgagaatgttgtgggtgtgtgagtcacaaagctttggggcattaacgtctatggctctatatgctgcctggccacgaatcaggtcccttaagatgtagacagtgccacccaggtccctggagcacactgagcagttaccaggaggtgctcaagtgtgacccaggattctccaggtccccccaaatcacacagggtctcccgggtccctctgggctacaccaagcacaaaaggaccccttgggcagagcctacttttatttctgttatgccaggtgttgctaacggccccagttcccaaacattccgagcactttctctgcatcacaacatattgactattaaacaattctctgggtcccaggagcttcataacaagaatcttgcttttctaaaattcaggcattggtctgaaaccccaacggccaggatcacactggacccttttcctggtcccccatacttggatgttctggacgctgccctccaggccctctaggaacattcagcattgccctcggatcacaggacagcactgatttcttgggctccaaacaacccactgagtcatctcaaagttaagcaatatttccttcaagcacactgcacactccctatcacaaaatctgaaaattcctaagtcctaagacctaggaattctgaatcccctttctttaaaatgtacatatggacccccaagtcctccaaggactctgagcaacttccctagatctttagattcaaaaacgattttcctggagcccccaaattgcggtattgtctcccagccttccaaagcaaattgagatttttttcccttcacaaaacaattgaggtttttttttttttaatactgatttatgagtctcctgactttatggtccctgccctgggtccccctacatttagaaaatgttccatggacccccaaagcacactaaaaaatgtccctgggtcccaagaaatcccaggcatggaaaaacctgcgacctataagtttcctagctactaactaggtttccagaaatttagatatcaaatctccattgggtaatttccatgtgtcccaaaaacttgaaatgtgtttcactggggctcccccaaatgcagacgacatccaggaaaatatatagtctttttcttatttaccaaaaataagctaatggaaatcatttaaaaattagcatagaaaaataatactgattttttatttttttattttttattttgctttccccaaatgtactgatcacactccaggctcccccaaaatctagacagtgctttcttccatctctgaagggtgttaaaacctttccctgaagccacagtaattatgaaggttattttttccccggctgctgccagcgtccaggccactaacttatattcttaagatgtgaaaattaatctcagcttccccctaacacaccaagaatgtgtttggatccccaaaatgtgttccttgctttcatctgccaattttacgtaatatggctctacggcaaaattcccaatttcatatggagaattttctttaactacccctcctcacaaattggtcccccaagctagctggcccctatttgagacctctttctctatgttcccaattgcatggagcaacttctctcatcccccaaacctgtaatctatttttctggagtctcgagtttagtcattaatcacggttcccacattaacggagtccccggggtcccctcctccaggacacccattcgctaagcccgcaaggcagaaagaactctgccttgcgttccccaaaatttgggcattgttcccggctcgccggccacccactgcagcttccccaaccccgcgcacagcgggcactggtttcgggcctctctgtctcctacgaagtccccagagcaactcggatttgggaaatttctctctagcgttgcccaaacacacttgggtcggccgcgcgccctcaggacgtggacagggagggcttccccgtgtccaggaaagcgaccgggcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgcccgcggacgcagcctccagcttcgcggtgagctccccgccgcgccgatcccctccgcctctgcgcccctgaccggctctcggcccgcatctgctgctgtcccgccggtgctggcgctcgtctccggctgccgccggggaggccggcgtggggcgcgggacacggctgcggacttgcggctggcggctgcgctcgctcctgctgggcgccccgaaatccgcgccactttcgtttgctcattgcaaagatctcatttgtggggaaagcggctggagggtcccaaagtggggcgggcagggggctggggcgagggacgcggaggagaggcgctcccgccgggcggtaaagtgcctctagcccgcgggcctaggactccgccgggaggcgcgcgcggagcgcgggcgaagtgattgatggcggagcgaggggggcgaggggggccaggggggcgcgagattccgccggcggccccttccccttggctaggcttaggcggcggggggctggcggggtgcgggattttgtgcgtggtttttgacttggtaaaaatcacagtgctttcttacatcgttcaaactctccaggagatggtttccccagacccccaaattatcgtggtggcccccgagaccgaactcgcgtctatgcaagtccaacgcactgaggacggggtaaccattatccagatattttgggtgggccgcaaaggcgagctacttagacgcaccccggtgagctcggccatgcaggtaggatttgagctgtgtttcccgccctgatcctctctcctctggcggccggagcctccgtaggctccaagcctggcccagattcggcccggcgcagccggccttccgcgcgtcccgcacctggcgggggctccggggctccggcgcggcaccggggggcgctcgggatctggctgaggctccaagcgccgcgtggccggctcctcctgctggggcaggtggcggctgcgcgccccgcccgagcccaggggccccctcagccgcaacaaccagcaaggaccccccgactcagccccaagccacctgcatctgcactcagacggggcgcacccgcagtgcagcctcctggtggggcgctgggagcccgcctgcccctgcctgcccggagaccccagctcacgagcacaggccgcccgggcaccccagaaacccgggatggggcccctgaattctctagaacgggcattcagcatggccttggcgctctgcggctccctgccccccacccagcctcgcccccgcgcaccccccagcccctgcgaccgccgccccccccccggggccccagggcccccagcccgcaccccccgccccgctcttggctcgggttgcgggggcgggccgggggcggggcgagggctccgcgggcgcccattggcgcgggcgcgaggccagcgaggcccgcgcgggccctgggccgcgggctggcgcgactataagagccgggcgtgggcgcccgcagttcgcctgctctccggcggagctgcgtgaggcccggccggccccggccccccccttccggccgcccccgcctcctggcccacgcctgcccgcgctctgcccaccagcgcctccatcgggcaaggcggccccgcgtcgacgccgcccgctgcctcgctgctgactcccgtcccgggcgccgtccgcggggtcgcgctccgccgggcctgcggattccccgccgcctcctcttcatctacctcaactccccccatccccgcttcgcccgaggaggcggttccccccgcaggcagtccggctcgcaggccgccggcgttgtcacccccccccgcgctccccctccagccctccccccggcgcgcagcctcgggccgctcccctttccgcgctgcgtcccggagcggccccggtgccgccaccgcctgtccccctcccgaggcccgggctcgcgacggcagagggctccgtcggcccaaaccgagctgggcgcccgcggtccgggtgcagcctccactccgccccccagtcaccgcctcccccggcccctcgacgtggcgcccttccctccgcttctctgtgctccccgcgcccctcttggcgtctggccccggcccccgctctttctcccgcaaccttcccttcgctccctcccgtcccccccagctcctagcctccgactccctccccccctcacgcccgccctctcgccttcgccgaaccaaagtggattaattacacgctttctgtttctctccgtgctgttctctcccgctgtgcgcctgcccgcctctcgctgtcctctctccccctcgccctctcttcggcccccccctttcacgttcactctgtctctcccactatctctgcccccctctatccttgatacaacagctgacctcatttcccgataccttttcccccccgaaaagtacaacatctggcccgccccagcccgaagacagcccgtcctccctggacaatcagacgaattctccccccccccccaaaaaaaagccatccccccgctctgccccgtcgcacattcggcccccgcgactcggccagagcggcgctggcagaggagtgtccggcaggagggccaacgcccgctgttcggtttgcgacacgcagcagggaggtgggcggcagcgtcgccggcttccaggtaagcggcgtgtgcgggccgggccggggccggggctggggcggcgcgggcttgcgccggacgcccggcccttcctccgcccgctcccggcccggggcctgcggggctcggcggggcggctgagcccgggggggaggaggaggaggaggaggaggacggacggctgcgggtcccgttccctgcgcggagccccgcgctcaccctggcggcggagctgggggtggggtgggggcgtcgggaagggccgagggaggtgtgaggtgtctgcaggggcgacttcccggtcggtctgtgggtgcagggggtgccgcctcacatgtgtgattcgtgccttgcgggccctggcctccggggtgctgggtaacgaggaggggcgcggagccgcagaagcccaccctggtatgttgacgcggtgccagcgagaccgcgagaggaagacgggggtgggcggggccaggatggagaggggccgagttggcaggagtcatggcagacgccacattcgcgacatctcccccacaccccctctggctctgtccgcaacatttccaaacaggagtcccgggagagggggagaggggctgctggtctgaggctaagaagggcagagccttcgacccggagagaggccgcggcccctgcccagtgggcagcgtggaagtttccatacaaggaggtgggaaggagacccccccccccttcactgccctgtgcagagatgagccgggggtgcaggatgggagcccatggcacttcgctacgggatggtccagggctcccggttgggggtgcaggagagaagagactggctgggaggagggagagggcgggagcaaaggcgcgggggagtggtcagcagggagaggggtggggggtagggtggagcccgggctgggaggagtcggctcacacataaaagctgaggcactgaccagcctgcaaactggacattagcttctcctgtgaaagagacttccagcttcctcctcctcctcttcctcctcctcctcctgccccagcgagccttctgctgagctgtaggtaaccagggctgtggagtgaggacccccgctgccatcccactccagcctgaggcagggcagcagggggcacggcccacgcctgggcctcgggccctgcagccgccagcccgctgcctctcggacagcacccccctcccctcttttcctctgcccctgcccccacctggtctctgctccctcacctgctccttccctttctgttccttcccttcggccccctccttgcccagctcaggacttttcctgggccctcacctgctccgcaccgctgcatgcttcctgtcctgctttctgccggtcccctgacccggacctccaagttcagagtggtggggcttgttgcggaagcgcggcgagggctagagtggccagctggcggagtgtgctcttagaatttggaagggggtggcagagggggcggtgagaggactggccagggtccagtcaaggagatgaccaaggaggctttcagatcctcggcgcagctgcccactagtctttagagagggcatgcaaagttgtgcttctgtcccactgcctgctcagtcgctcacataatttattgcatcaaaaactcccctgggtctgcggagcgaaggctggggctgcccgcctggagggttccaccttctgcaggggcagggccaacttgctgtggtggctcccggcctcccacccccgagtgggttaacccggccctgtggccctgcagcctgtggagggggtgtgtcctaagactggcctccccttccagattgtagtctggggaacctggtgtcggacttcccaggtggcctgagctggtctctccagctcccacggggagagtttggtagcgcaaatagggagatgttctggaggcccctggccttactggttcgatttgaggcctggaaaggaggctctgggcgtgtgtgtgtgtgtttgggggtacccaaggcagactggagttggagaactgggtgactgggaaaacaaggtttctagagcatgggtggcgtggttgtgttaaccattggagtccttgacccaggcctggctcagctgcagactggaaaggtggaaaagccagggggaggggcggggctggcccagcaggactggcctgctgctttgagggcgatggtcctcctggaccccccctgctcagctgggggttgtggggaggaagggactggtcctcctggatgcacatgctctgtaggggtggggctgtctgccatcttggctggcgctggaggcctgagaagtggcgatgtgacgctgggctggccctgcccccatggtgtcataggacggaggccaggtcgggtgtccagcctgggcccctgcagctgtggatgccgctgagctcctgcaataatgaccgtggagatggtcacccctcgtgtaaaattactagtgcttcttgcaaatggaaggaactgggccttttctgtgtgcttctggacgcttcattctgcacatggccctgcgccctcacctcggcattatgacctgtgtgttacttttgtaataaaaataatgtttataggaaagccgtgctttcaattttcaactgaatttgtaggttggcaaatttggtttgggaggggcacctctggcctggggcttggcctggctgccccgctcacgccacttctctcccgcccccagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagtaagtagctgggaggggcttcctcagacctggtcaggcccctagagtgaccggtgaggacgcccaacctcaagccaggggagcacactcctaggtcagcagcccagccgcttgctctgagactttgaccttcccgccgcgtttctgagcacgtgcggtgtcccagggcatccacaccagctgcctttcccatcacacgcctccttcgaagggtgggccagaggtgccccctagacgtcaggggcactcacaggggtctccctgggcatcagaatttctgttgggggccgtgaggctcctgctcctgaggcaccgcacgcctagtgcagggcttcaggctctggaggaagagcctgcctttcttcctgcaccttttggacattctgacaagggacgtgcgttcggtgaatgatcagaattaaaatcaataaagtgatttatataattaaaatcaataagacaagtgcagttggtgggtggcaggggtgagcggtgcatgcgcctccttgggccccaaggctgccgtggggggtgcccacctgctgacctcaaggacgcttcagcctttcctcatgtttctctcttggttctccagcctgggggctggcaggtgggtgcatggcccattgtccttgagaccccacccccagataggggggctgggtggatgcagaggcaggcatggtgcctgggcatgcctgatggggcaggggaggggccgctccttactggcagaggccgcacggcttattccacctgacactcaccacgtgacatctttaccaccactgcttactcacgctgtgaaatgggctcacaggatgcaaatgcacttcaaagcttctctctgaaaagttcctgctgcttgactctggaagcccctgcccgccctggcctctcctgtgccctctctcttgcctgccccatttgggggtaggaagtggcactgcagggcctggtgccagccagtccttgcccagggagaagcttccctgcaccaggctttcctgagaggaggggagggccaagcccccacttgggggacccccgtgatggggctcctgctccctcctccggctgatggcacctgccctttggcaccccaaggtggagcccccagcgaccttccccttccagctgagcattgctgtgggggagagggggaagacgggaggaaagaagggagtggttccatcacgcctcctcactcctctcctcccgtcttctcctctcctgcccttgtctccctgtctcagcagctccaggggtggtgtgggcccctccagcctcctaggtggtgccaggccagagtccaagctcagggacagcagtccctcctgtgggggcccctgaactgggctcacatcccacacattttccaaaccactcccattgtgagcctttggtcctggtggtgtccctctggttgtgggaccaagagcttgtgcccatttttcatctgaggaaggaggcagcagaggccacgggctggtctgggtcccactcacctcccctctcacctctcttcttcctgggacgcctctgcctgccagctctcacttccctcccctgacccgcagggtggctgcgtccttccagggcctggcctgagggcaggggtggtttgctcccccttcagcctccgggggctggggtcagtgcggtgctaacacggctctctctgtgctgtgggacttccaggcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggtgagggtcctgggcccctttcccactctctagagacagagaaatagggcttcgggcgcccagcgtttcctgtggcctctgggacctcttggccagggacaaggacccgtgacttccttgcttgctgtgtggcccgggagcagctcagacgctggctccttctgtccctctgcccgtggacattagctcaagtcactgatcagtcacaggggtggcctgtcaggtcaggcgggcggctcaggcggaagagcgtggagagcaggcacctgctgaccagccccttcccctcccaggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaacccccttcccccccccccacaacaaccctcttaaaactaattggctttttagaaacaccccacaaaagctcagaaattggctttaaaaaaaacaaccaccaaaaaaaatcaattggct

SEQ ID NO: 36157 - DNA, 5955 bp, Homo sapiens
gggaacacatccaagcttaagacggtgaggtcagcttcacattctcaggaactctccttctttgggtaagactgggagggtgggcaggagctacccttcccgtggccccggaccttgggtgggctgtgggctcagggagcggaggggaggccttaagcatccactctctgcccggtgtttttgttctcatcagggagcctcagatgggaagggactcgagccccacctgtccctggactctggaatgtaaggacaattagctttgtccttgcccaggttttcctcaggccttgagggcggcttggggtaaagtgggcaaggggaagagataagtgttaggaggaaccaagtcgaagccattgcaagtccatgcctgggcggggtgttgcttccctatggaaagcttctgacctggagcaaatcactgagccagatcgcgctccctcatctgtaacatgcggaggaggagggtcccatctttttcacgttagtgaggagattacataagagcaggcacctcgcctgctgtatatgccttaaaaatgcgattggttctgatttcttagttttggtgctttttcaattgctccgtggagagataagggagtcccggaagtgtctaagacattggcgctgggactttcaggagaaagaaagcagcccccctggggaaataaagtccctcagggccctgacctaacacaggtcctttggtagccccaactccccaacatccctccctccctcaccccaggatcctttcaaggcctgctgctccacaagctcagagcagcctccctagccccctggagcccgtcacatttttcaggacagtgggaagcaagtcaggttgtgtgcccatcccgtcctcagagctccatcccttcggcaggtctggctgaagttgaggatctcttactctctaggccacggaattaacccgagcaggcatggaggcctctgctctcacctcatcagcagtgaccagtgtggccaaagtggtcagggtggcctctggctctgccgtagttttgcccctgggtgagtgttcctgggaggggctggtgctgggggcgaggaggcggctgggaagggcgggggtcctgtcccgggacccgtgggagagaaaatgggggacacccgcagccttgctgccctgtcctgtcttctcacagcaggcgtccaccctaactttccatctgggagggggcccggggcaggcagactctggccagatgcccagccctgggtgttccacaggtcctctcccctctgggcccgggcctcctcctgcctagccggaaagggtctatctaccactgagtcccactctcttcagctctcccttcccccagattcaccatcagaattcatctcctttaggagtttaccttgtcaatagggccccgtgtcctatgggatctcacatccagagtatcgattttaacaaaattcttcagctcacttttttcattagtttctgggagatctctttctggttttatttattctcattttcttccttttcaccctcgattcccctccctcaaagtcaacctttctaatatatttaatgtgtgtctgtttttcatatgtatttttgcagaatgggtattgtgttttgtttgcgggcattttaactgacatgcaggatggtgtgctgtagatcccattctattgcttttttccacactgagaaccatattcttgagatccatcagtgtcattcgatgagcatctaatcctggcttctacctgctgacaagtgctcctctgtgtgtatcccctgccctttacctttctgtctccgtgggtggacatccaggggttcccccaactccgccagcacaaatggcacaggcttgaatgggggcacagggcccctgactccgaccctgacttctgacccctgccccaacctctaacctctgtttgagcctgcactcaccctttgctgaccctgtcatcctcagctgccctgagccccaacatctctctcctcagacccttgctgggggcactggaggctagctccttcatgctggggtccctcactggcaccctgttttgcaacttggaggtaactggccctcggcaacacacaccactctgggctcccaactcagtacagagaagtgtgatgagcaagcaagggcctgggccacgcccagcagtcctttctgtttgtcagaaatgcagatgacttctcagtttaagatcaagcaattcataaaattaaaataataacagctcaacttaagcaagcgcttttatgttctagtcacttaccctagcacttgaggtttgtcaatttaattctcataacaaccccagaggaagataagaagataatatcgtcccttatttaccaactgggacaatttactgttgtccaagtgctctgggcaggacagaagggtgtgggtgtgctgcttccaggcttggaacaggaggtagaacaatgaacaatgacagaaagtattaataggccaggcacggtggctcacacctgcaatcccggcactttgggaggccaagaagggcggatcactcgaggtcaggagtttgagaccagcctggccaccacggtaaaaccctgtctctaccaaaaatacaaatattagctaggcatggtggtgcatgcctgtaatcccagctacttgggaagctgagtcagaagaatcacttgaatccaggaggcagaggttgcagtgagccgagattgtgccactgcactccaggctgggtgacagagctaagattctgtctcaaaaaaaaagaaagaaatattaatagaagtaggaaaaggttggagggaggtctcagggtagggcaggttctgaatggcacgaaataatggccaggctactccgccgtatgaatgcccatcagctgagcctaacaggcaggcctccagacacaccgcagccagttcctgagggcttttgtgtgtcagggtgcaggtctgctgggctgccagccaacttgacatcacctctcttgcctgccaataaaactgaaccttctaacgaggttatccattcctgattccctgggctcataacccttctaggtggcctttctggtcactcaggggtgggccttcatacctgcgtctctttacttcctcccaccatcactctaaggcctctccctgggagctggctgagctcactcctgcacatttggctgtctttagaactcctggtcccaaattgcagttctggcccctctggctgctggggaacataacctctgcctgctccccaggggctcaccgtgtgggggagcaaatcatgtatatccagtgctgtgagtggctccagtcatggaggagcaaggatgagttctgcctggaagaatctgggaaggcttcctggaggagggaacaatggcatggaccttgaagagtcagaagctttcaattcattccattcaagcattgctctcatgtggcattcaagcattctatagtgcttgccgtgactcaggcgcacagtgcaaaaggaagcacatctttctctgccatgaggacttattagtgtctgaagagctttttctggactataggagaaagtcatggtctccctcactaataaacactgaccctgcttcggatgagctaacagccctgctcagaaagcatgacacccatcctgttcacttttccctgccccggtcaaaccaccaagccctagatttcattgccaagtatcctgtatttactgggaatggacatcacagtagcatgccttcctagccacatctatgaggttttgttcattttcattctgctttttgtttgagctaaacctgccttgggaggcagaaaagaaaagataacatctgattcccccgatcaaccaaccaatcaactaggtcagggccacgtaaattcattcaggacaagcactgaggtcaaactccccagtgatcctcaccctcctccagaatttccacttcccgaaatgaagcaaagagcggtagacaggagtcatcccttcttgtggctcccaacctggggcagccccctgcctccctttagatgggcaatcggcttagaaagtggaggggaagccagtgtggatctactcacagaatgttcttttggtttccagccaggattgctacagttgtgattggaggaggtgagtctgtggggaaggggctcaagtaaccacctgcccctagggaggtggacttggggagcagctggccttgtccatgccaatgtttccctcacatgggtggtcaggggaggaggtggggatgaggggctaagtatgaaccaaggagctagaaatacagcactggaagctggaagcagggggcttggagactgggagctggagtgcgtgtgggcagggtgtggcagcagccggcagaggccatttccccttggcagaacattcaccatgtgaccctgagcatgtctttgaactcctctgagctcctgtttcctctccagagaaaaggctggtaatgcccattcagggttatggtcaggattgcatagggtgaaacaatagagattgaacacagtagacatgaaagagatgccagggctcagctccctttggtttagttgcttccagtgtgctctgtggcaacaccacggagccctagagctgtctctttgagccgctctgaatgtgcctcttacataatctcctgggcaacatctgctcccctaatgagatttgctccccagcaaagataagaaacttgccaaccactcccctggtccagcatttggccaaggcagacactgaggctctgaggacaagtggctttcccaaggaaggtcctgctgcccagaagagcttggcccagagccctgtgcccagtgaccccactagcttttccctctactttccccgcctggctgtgctccccttgattcgtgcctattggccgtgcccatagtctctcccaagctcaaagttcacctctttctccagatcccctggggtccccaagcctgactcagtgtatctgggggggtcccttctgagcccacgcaccgacccagctcctcttccctgcagttgtggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggtaagtatcctggcggggcttgctggggagggcgatgaggagggcaagagcctccaaggacccagtcccaatctcaaccctatgaacctcaatctccctgttcctctgtctctctctacacattctctcagggtttctctgagggagatggaggagggagggaaggagcccaagccaggaacagtgcactcaggaagactcagcccgaagcagatttgctgggttacctggggcgtctcctcccctctggggtgcagcctccttccctgaagagcgaggctgcttctagctctggagttcaccatgggggttcatgcctgcagcagcctctccccaaacaaagaccccgagggtactgggaaacagagaggggaactgggtggggtctgtaagcctcagcccctgctgagggtcactggagtctctgaccccacagtcctgcccacagagcttccccgacaggcatgtcccactctgtccaccctctgcttcttcccaggagcaactggactctccggattgaccaagttcatcctgggctccattgggtctgccattgcggctgtcattgcgaggttctactagctccctgcccctcgccctgcagagaagagaaccatgccaggggagaaggcacccagccatcctgacccagcgaggagccaactatcccaaatatacctggggtgaaatataccaaattctgcatctccagaggaaaataagaaataaagatgaattgttgcaactcttc

SEQ ID NO: 36158 - DNA, 4538 bp, Homo sapiens
ccggcggggtgggggacgtgtcgcgcggccgggtggcctcggtcggtaccctgggcgcggagcagctgcctcattagtattcgtacccacgaggcggcgcagcgggccctcggggacagcgagcgtcgcggccatggcttatcactcgggctacggagcccacggtgcgtggggcgcgggcggggcgcggcgcggccggcggggggagagtcggcggcgtggcccgctcaccccgagggagatagcgactgggaccgccgcccagggcgggggtgtcactcgggttcctgcccctcgtaacactccaacacgtcccggacttcgccctctcggcccagtcctgggaatcccatgccggagtcgggcaaaaacggggtccgcctcctcctccagaaactcctttgactgttgtgaacctgatgaggtccctgatcactgtccagggcctccaggtagccagctgtcgcctctcccagctttgttcacggaaggatgccctcccagttattttcacctagcacacttctactcactgtggctcagttcagaggtcacttccagtgagaggccttcagaaaccccaagtgggcaaccagttctaggcgctgcctcagctctttctttgcctacatttagcaacggatttctcgcaaaggatccctcatcacagttttttctcagttagctccccctcacccagcttggggtcccctcactgatcggtgcctccaggacccgtgcagggctgtccagccagggaaggggcggtggtttgggctcatgcttggtatttctgtcatctactctgatacctccaaacccacaggctccaagcacagggcccgggcagccccggatccccctcccctcttcgatgacacaagcggtggttattccagccagcccgggggatacccagccacaggagcagacgtggccttcagtgtcaaccacttgcttggggacccaatggccaatgtggctatggcctatggcagctccatcgcatcccatgggaaggacatggtgcacaaggaggtgtggcctgcccccggggcacgggtggcagaatttttggctagggctggggcatcatgggattccacccgattcctcacagtgccctcagggatggagcacacagaggggcaccctgaggcctggggtgcggcttgcccacagcttcctctctcccctcccagctgcaccgttttgtgtctgtgagcaaactcaagtatttttttgctgtggacacagcctacgtggccaagaagctagggctgctggtcttcccctacacacaccaggtgagcttcctaccaagggagctggtgggccttcctcattctgcccgagtctggcccccagacctcaacccccttctctcctcttttctcttcttcccctcctgatgtggccgctgctgccactgccactgccagaactgggaagtgcagtacagtcgtgatgctcctctgcccccccggcaagacctcaacgcccctgacctctatatccccagtgagtctccaacctgggctggggaacgtggtggggtggggtcgggggggacttgtgccttgagggatgaatgggaagagaggcgcagctactgagtcagcatctgttcttggtgctttgtgtatgtgtggcagttgcaagacaccaggcaggcagtgcagggtgaccagtaaggagcttcctgaatgcgccttcagtgtccccaggacacccttttgagaccttcctgtttcttgatttggactgtatccctccccagcctggagctctgggtttagacctggctttgcagactccagctatgggatttcaggctggttatttgtacttttcagtaaaacaggactaatgtagtccctaccccaaaggactgttggagagattcagcaaggtgatgtttgctcagcacctcacctggcacacaggaaggacgtaggaaacattaactcttatcatcgttattgcttgtcctccaaggcgtgctctgttatcccttcttccaagaagcctttcctgaccccctgagcaagtggtggctcccttctgggttcccacaactgcctgtccacatggcatttttcaggctgcccacacatacagctgactcttctctgtcctgttggctgcacagggccaggcccatcgtggacacccagggtgagtgagtgtgcagggaccagcccgcagatgagcttccagtgagggcagccagtgggactgagggcaggcagccagcctaggtgtgctgggcagcacaggggcttccatccttcatcccgtgtgcccatcgtagccaccgtgtaaggctggaactggcatccccattttacatgttgaagccaagcctcagaggagcttcagtatcattgaggcctcaaagttgacaggtggtacagctgatttcctgactccagaactccagacactccccgctggtggtcatgtcagtgctttttttttcttcttcttttgagacagggtctcactctgtcacccagtctggagtacagtggtgtgatcttggctcactgcagcctctgcctctcaggctcaggtggtgatcctcctgcctcagtctcctgagcagctgggactgcaggctacaggcgcctgccaccaggcccagctaatttttgtatttttagtagagacagggttttgccatgttgcccaggctggtcttgaactcctgggctcaagtgagctgcctgcctcagcctcccaaagtgctgggattacaggcgtgagctactgcgcccagccaattctagtgctttaagcggggcagaagacagagttaaaactgctgctaatgcccggctcccactggctctgagcttttatgaatactgcccaaagttaaacttggagttccctgcattgttgggcagccagagccctagccagtgctgagacttagaattgctgactgcggtgaggtcatctccatgaccccagactcaggacagcatgggtgtccactgaacctggcttctggtcttgccagaaaccagtttggtccctgtataggcggaacaatggccttggcccatgatacagtttctgagatgcagcagaacactgatgagcttcccagcacagggacaggaaaggtggcttgtggttctggaagaagggtcaggtggcatttacacagtgggagagggctgatcggagacaggcattccaggcagggcatttggaagcagaatgtggaggtcaggccatgctgggctattcagagaaggaagtatgggacatgtcggtgaacccgaatgcctagtaaggcagctctgatggaggaagccaagctgatggcatctctctggcacttggcagcgatggccttcattacttacgtgctcctggctgggatggcactgggcattcagaaaaggtcagtgccaagcccctcccttaccctcccctccctgtgagctcttctcccaacctccctagggcatatgtggtggtccccagctcaccctctgttgccccagtctctcttcctcacccctgcctcaggatgcctggctctgagccacccctgctttggcgcaggttctccccggaggtgctgggcctgtgtgcaagcacagcgctggtgtgggtggtgatggaggtgctggccctgctcctgggcctctacctggccaccgtgcgcagtgacctgagcacctttcacctgctggcctacagtggctacaaatacgtggggtgagcacttgtgggccagggggaggtggccttggatctgggcctgcatagctgtagcctcgaactgtgaccctggacatgtctcggcccctagtgacctctagcactgctctgttaagagggagcagctgtctccagcagtctcctgaggatctgcgtgccatgcagaggttggggaggtgttgagagtcactctgcgagtcttggggagagaagggggtctcagatccaggtcctggggctgagtcctgggccttccatatccctttggggtctgggtccctgtggggacagattgagagtaaaaggtgctgtgggaggtggggtctagctgggctctgggcgttgggggtagggccaatctcaggcctagacccctgggggtcaccaaccctttcctcctcccacccccagaatgatcctcagtgtgctcacggggctgctgttcggcagcgatggctactacgtggcgctggcctggacctcatcggcgctcatgtacttcattgtgagtctggtgcacccccccattcccctgccttcacttgagggcaaacctccccctcctggccaggcttcagttctcctttcttccaggtgcgctctttgcggacagcagccctgggccccgacagcatggggggccccgtcccccggcagcgtctccagctctacctgactctgggagctgcagccttccagcccctcatcatatactggctgactttccacctggtccggtgaccccctggccccagatggcactgagtttttcattcattgaagatttgatttccttg

SEQ ID NO: 36159 - DNA, 33805 bp, Homo sapiens
cccctgcctctcggactcgggctgcggcgtcagccttcttcgggcctcggcagcggtagcggctcgctcgcctcagccccagcgcccctcggctaccctcggcccaggcccgcagcgccgcccgccctcggccgccccgacgccggcctgggccgcggccgcagccccgggctcgcgtaggcgccgaccgctcccggcccgccccctatgggccccggctagaggcgccgccgccgccggcccgcggagccccgatgctggcccggaggaagccggtgctgccggcgctcaccatcaaccctaccatcgccgagggcccatcccctaccagcgagggcgcctccgagtgagtgggcaggggtcagccggaggcttggggtgcacggggcagggagccctcggggaaggacggggcgaggggacgggggttcgcgaggagtgcacgaggcaggggggtcacgggggaggacggggtgagtggtgcacggggcagggggttctcgaggggaggacagggcaggggaccctcgggggaggacggggcagggggccctcgggggaggacggggcagggggccctcggaggacggggcgaagggtgcacggggcaggggggtctttgagcagtgagattgggcgaggggaggtccttgtggtggaaaagatggggtgtggggttcctgaagagtggaattgggataacgggagtctctgagtagtgaagttggggtgaaggatgtctctaagaggagaggatggggacaggggtccctgagcagcgaggttgagtgaggggaggtccctgcagtgcagaagatggggtgtggggcttctgaaaagtgaagctggggtgaggggagtccctcagtaggaaaatcggaatgaggggtgtccccaaggagagaacaggatgaggctccccaagcagtgagatcggggtgaggggtatctctaagaggagagaacacagtgtggggtccttgagtagtgaaatgagggtgaagagttcctaagaggaaaggacggagtaaaggttgccgtagtcatgagatgagggtgaggggagaccctgagtagggaaatcggggtgcagggcattcctgagaggagaggatggggtgtggggaggtcaggcagcccctgaggaggaaatctgggcaagggggctccagaggggagaggatggggtgaggggtccctgagtaatgagactgagatggggtagggtccctggtaggaaaagacggggtaagggtccctcaataatgagatagggccaagggaggtccctgtgggaaaagacagggcatggagtcactgagtagcagaatggtggtaggtctctgagtagtgaaatggggtgaacggtccctgaatagtgaaatcggggagatggtggggtccctgagtaatgagattggagtgaggggagatccctttgggaaaagatggggtttggaatccctaagtcgtgagatcaggccaaggagatgtccttgcagagagaagatggggtgcagggcccctgaattgtgagatggggttgagggggtccctgggaggagaggatgtgtcggtgggggcctgtgggggaaggataggcaaggggtgttctgcatattgaaatgatagtgaagcgagtcccttgggggagagatggggtgagggggtccctatgggggaaagatggggtgggagggttcctatgggggagagatggggtgagggggtccctatgggggagagatggggtgggagggtccctatgggggagagatggggtgagggggtccctatgggggagagatggggtgagggggtccctgtgggggagagatggggtgggagggtccctatgggggagagatggggtgggagggtccctatgggggagagatggggtgggagggtccctatgggggagagatggggtgggagggttcctatgggggagagatggggtgggagggtgcctgagccacaggttgagagtgcagcacctgggtggggaggacaggctgagaggtcttgggggggcggggagcggtccttttggggaatgagtccctgagtaatgaggttggcatgggatgaagagggcacctagggtgccaaggtggggcaggggggtcccttaggggagaggatggggtgaggaggtccatagacaaccagggaaaagggaagagaggggaggacagggggctcccagaagggtcaggatgtgggagaggggtgtcctagggggtcacgatggggtgggagaccctagaaaggtcaggatcgggggactttgggggggtcagggtgggagttctggggtatctgaggacaagggggtgtcttaggggtgtcaggacatgggggggctttagcggggtcaggatgggagttctagcgggttccagatggaggggtttctgctgggggaggtctagtgggatcaggacaggggttccagggggttcatgttgtggggggggtcaggttgggtcctcgggggtcatgttgggggattctgggggggtcaggttagggggtcctcggggggtcatgttgtgggggttctgggagggcagagcagggggtcctaggggtctcatgttggggttctgagggggtcaggatggggtcccagggaggtcaagatgtcaagatgggcatctctgagagggcatctcctgcttgtggcggtgcccagtgtgtggagtccctgaagctggaagtgtgaggagacagggaagccagagtgtgaggaacgaggaggcgtggggatcaggggaccctgctggcccctgaaagcagaggtgcagattctgaagtgagtggaccggaaaacccttgtgaggggctgacccagtgcagaagctttgaggaggtggagggcgaccagaggcctgggtgaagggatctgagaaaggggtatgctggggtccgggtggcgtgctggcagaatcgcactgctccaggacgagggaggggactgggtgttgggggcacacactggtggggtcatgccagggtgatctctgcactcccgttctgcaggccgaggcagggcagggcgatccccggggcccttggctggggtccgggtgccgtgcctgcggtgtgacccctcaagaaccaggtgtcagggactgtggcatgtctggtggcctctcccgcttgggggtcggccttctgtgacccagatgaagactcttgatgccaatgtgtgcaagtcaacacgggcacagccagacacggggacccgttcctcattctctgcacagaactcgcccttcacatttctcttccgtgtggggtttgattcccatctcttgaaggattcccccaggagaggaagctggctgtagggacgccaaggttttgttttgttttgtttaataaccacagttgggttgccagtaaatttaagatggattagtcagctgactccagaatgcattttcaatgttttgagcagtacttgagaccttccaagtctgccatcagaagtgttcattcatggctgggtgtggtggctcacgcctgtaatcccagccctttgggaggccaaggtgggtggattacttgaggcccagagttcaagaccaacctggccaacatggcaaaaccccgtctctattaaaaatgccaaaaaaattagctgagcgcggtgatgcacacctgtaatcccagctactcaggaggctgaggcaggagaatcgcttggacccaggaggcagaggttgcagtgagctgagatcgtgccagtgcactccagcctgggcgacagagcaagactgtctcaaaaaaaataaatattcatttattcattgatgttattcattcattcattcatgttcccctccttaccttctgtcccactcccagggtctcgccatttctgcttcttctgggtccttgttcagcagctcctcagtgagcacctactagggccctgtttcccctcatgggggacactaagatgagcaggggttgtcctgacctcaggcaggtgttgttacctcgggcaggttcccccacccctgtgagtctgttccctcctgcctgggcctccggggacgatggtgagaatggaatgagatggtgtttgtccagcccaggaagcggtgcccaggcccctgccttccagcgagctctttgcagcaccagctccagcgccatcgcctcggttctggcctgtgtgccccgtggcttacgccacttccagctgtaggcgaacagtggtcgaactttgggattggaaatttccagatggaaggagcagtccacgccttcattccctgcttcagtcccctctctggctgtccaccttggctttagctccttcctgaattgggacctctggaggtggcctgttcttccagagagccatttaaagctgcactgcctggttgagtagcccctggctacaggcaacacataaaacaagaattgcccaaacccacgagagcataggcgcaataatgccattgtagatttcaaaggcttaagacggaaacagtgtgaaacattcattcatttttcatactggttgtacgttgaaaatgataacatttttgatgggttaaatcaaatgtgttattaaaattaatttcagccaggtgcagtggcttatgtctgtaatcccagcactttgggaggccaaggtgggcaggtggcttgaacccaggaattcaagagcagcctgaccaacatggcgaaaccttgtctctactaaaaatacaaaaattagctgggcgtggtggcgggtgcttgtaattccagctacttcggaggctgaggcaggagaattgcttgaacccgtgaggtggaggttgcagtgagccaagatcacaccactgtactccagcctgggcgacagaatgagactttgtctcagaaaataataataataataaaaattaattaattaaaaagagccagacatgatggctcacacctgtgatcctagctactaggaaggctgaggtgggaggatcacttgaggacaggagttggaggctgcagtgagctgtaatcgtgccgctgcaccccagcttgggaggtagagcaggaccctgtctctaaataaatgaagtgagttcacctgttctttttaaacatgggtactagaagattttaatttgtgcgcatggtttacattccattgcttgtgcacagcaatgggttcctgtgtgcattgcgcttagttgtctgttactccaggatctggttctgagtcaaggcatttgtgaaaatagcttactgtcgaaatttcctctgaagattccttgaatcacccaataaagtgcaatgtacttgcttgtttaaattgttagaaattttttattgtgtagaaacaaggtcttgctctgtcacccaggctggagtacattgtcacgatcatggctcactgcagtctcgacctcctgggctcagcctcctgagtaactagaactacaggcatgagccactgtgctcggctataggtctcactttgttgcccaggctggtcatgcttattttttgttttttttgttttttggtttgttttgttttgagacagagcctccctctgctgcccaggctggagtgcagtggcaagatctcagttcactgcaatctccccctcccgggttcaagcagttctcgtgtctcagcctcccaagtagctgggactgcaaacgtgcaccaccgtgcctacctgatgcagcttttgtgctgagccttctgccctctactcttggttctcattctgtgctctgaggctgctcagaacgcttgttcctctatctcctgcaaagacagacatcttggcccgggctccgttcacccgatcccagcttcctcgtctcctcccgacatggtccggagctcgtgcgttaggaaggaggtctcccggccgcgtgcaatggctcacgcctataatcccagcactttgagaggctgaggcaggcggatcactcaatgtcaggagttggagaccagcctgaccaacatggcgaaaccctgtctctactgaaaatacaaaaattagccgggcatggtggcgggagcctgtaatctcagctacttgggaggctgaggcaggagaatctcttgaacccgggaggccaaggttgcagggagccgagatcgcgccactgcattccagcctgagcaacagagggagactccgtctcaaaaaaaaaagaaaaagaaaagaaaaagacggaggcttcctgggtcctttgagctgcagcttatccttgaggtcctgaggtctgctagacttgttgagacaggatcaaggcagcgtcctcagttcccggggagccgccctggattctggtcattggtgtgtctatgggggtacacagcatggatcctttccttctacaccatgaacccctcaagtgcaggaatccagtctgtgtcctcctgggggccgatgcaccacggccacatagcaaacggccagatggagtctccctaggtagctaacccctaccctggggggtctctgcagggcaaacctggtggacctgcagaagaagctggaggagctggaacttgacgagcagcagaagaagcggctggaagcctttctcacccagaaagccaaggtcggcgaactcaaagacgatgacttcgaaaggatctcagagctgggcgcgggcaacggcggggtggtcaccaaagtccagcacagaccctcgggcctcatcatggccaggaaggtgagcactgcggggtcggggaggtcggggagtggtggggaaggtccccctggaaacaggaggcaggttgggaaggcagccgggtctctgcattctgattagctccaggctctgtccctcatccccaccagggactctaggtcctgagaaagggcccagcttctgggcagatgggagccgtgccagccacaccagccacacacagctgtgccctccagtgactactttctgccctggagggcacttgaaatccatattcccagaaagctagcacgtgggggtttcagaaatgcgagtgtgttatggttctccagagaaacaagcgatgaagacgaagcgtgtgtgtgtttgcgcctatgtgtacagccacctcagggcgatggctcagccagtgacagaccgcctacgcagcggtggcgacgtaagatgatcaggccatgtttttgctgtgccttctgtatgtttatttttatttttatttttactttttgagacggggtcttgctctgttgcccaggctggagtgcagtggcatgatcttggctcacttcaacctccgcctcctgggttcaaggattctcttgcctcagcctcccgagtagctgggattacaggcacacaccaccaggcccagctcatttttttgtgtttttagtagaggcagggtttcgccatgttggccaggctggtctggaactcttgaccccaggtgatccgcctgcctcggttctctatatttaaataaacagacagcagctcagcactgcgctgtacagagcatgggagcctgggtgtggaatgggctttccagtgtttgcacagtgacgacatcgcccagagagggatttctcagtgtatccctgtccttaatgatacttgagtgtatgtgtagagagagatttattctaaggaattggctggagtgcagtggtgcgatcttggctcactgcaacctctacctcctgggttcaagggattctcctgcctcagcctcccgagtagctgggattacaggtgcatgccaccacacccagttaatttttgtttttttagtagagatggggttcaccgtgttggccaggctggtctcgaactcctgacctcaagtgatcctcttgcctcggcctcccaaagtgctaggattacaggcatgagccaccgcgcctgggcaggcttttccctgaaggccttcagctgattggctgagactcacccaccctggggtggagtaatctgctttgctcagagtctgccaatttaaaggttaatcacatcttaaaaacataccttcccagcaacctctagactggcgtttgacaactgggcaccgtggtctcaccgaggagacacacaaagctgactgtcacccaccctttgaaagtctgcaagccctggtgctgacggcccccgtgcttagtcatcccgggctcctgggccatgatgcagcctctgtgctctgtgtttgagaatagtgcccaggggatacagggaggatgtgaccacttggggacagtggctcttaaacacagaagtaggggacttagtgttgacagggtgttcagctcctcaccggtgttctttcagacctagaacgctgcctcttcctggaagcccaccatcctgtagttccccaaactgggggaacgtgactgcacctagtcccgtgggtctgcgcaggtggcagcagtgcttgagggccctgccttcctcgggagcagcggctcaactcctgcggggatttagctctgcagctctgtcttctggcctctagagtgctgccctccctccctcctgaagtgtgcagccgcggacttgctatttctgtccccgtactgcaggcagcctcttccaaaccggagcagccttggaaagctcaggtccgcctccgcccgaagcactgggtggaaaaaggcaagcgtgtggttcacacagccacagcagggccttgagacagtgccagtcctcgtgtgtgccagggaccctcaggcttctgggggagcctccagtggtccctgatgggctgggcagtggacatgaacccaatgcttgctgtatcagcagctcctgctcctgctgacaggcgcaggtgaagccgggcccacctgcagctttactgtagcggggaaagggagatcggggcctttgaacctgagggcaggcgtggctgggcaggttctgtggtctggtgggtggagatgtcccagcatcagctctgggtgtcagtactgtccttccgtcatgtaagatgtcagtcatcttgggggaggcggggaaagggcgcacgggactctcgttactatttttgcaacttcctgtgcttctataattctttcaaaattaggttttctttaaagtgcccgaaaactcgggtgggagaggatgcattgagctcgtgggctcagcggctctggctgctatgcaggtagggctgcaagggctcctttcatttcatcttatttatttacttatttttatttatttatttttttgagacagagtctcgctctgtcacccagactggagtgcagtggcacaatctcggctcactgcaacctccacctcacaggttcaagcgattctcctcccttagcctcctgagtggctggcatgcctggctaatgtttgtatttttagtagagacggggtttcaccatgttggccaggctggtctcaaacatctgacctcaaggaatccatgcatcttggcctcccagattgctgggattacaggcgtgagccaccgcgcctggcccagtctcggtatttgaggtcatgctggtttgtaaatgtctttttggcttgaccgtggcctctgacccctctcccattggagcagcgtccccgcgttacctgggccagggagataggtgaagaacttgctgcttgttacgcgtgtggggcttctttgaattgtccatgctcatagcagagatgagagtgtttgttctcgcctctgagttcctccactccgctgtagcttacttccagggtggcggtcacacggcctgcccaaggccacctcacagtaccagctgctgtctcacaagtgacgacctgagtcgaagccgctgccaacacctttgacgcgtgttctcattaaaattgaacagcagcctcgttttacagttgaagaaaccgaggctgtgtggggtcagtgcctgaatcggattcgaaccctcttggatctgctcggacttgggagcagctgccggggctgagcctccagatccactgcactgcggtcccctagctggccaccgctcccagcctgtgtgttaatttttaaaatctcttgtagagatgaaggcttgctacgctgcccagtgttgaactcctggcctgaagcgatcctcccgcctcagcctcccaaagcactggaattacagatgtgagccactgccccggctctcttccaatttttgacaacacctaattcaggatgtttggaagcgcagtgtgggctgcacgtgactcttggctacatccagcttgggagctgtcagtttctgatccatgatttacgaggttgctgagatcattccaggcctgcggggtggcggccggggggcggctcggtcctcctcttcccctcctgctctcgctgacactcagtgaagctctttcctctcttttcctactccgaatcccccaaccccacccctggctcaaattcctcattcttctgtagcaaccgtctccacctccgagccaggtctggcatttagttttaacaccctgacaccatccacatttaatcagctattagagctggcacggcctgggctgtggtgtcctggaaagaatacgggctccagtgttccccgaggcagccccagtcctgacttagcagctaatgccactgggaacatggctccgaggctccgaacctgagcttgctcagtcagcaccagtggggcagtacacccatcccccgggcttgtcagggtgaactttagagggtgcaggtgctcaggaacgccccctcccctcctgtccatctgtctgtctgtctgcctttccccttgcacaccctcagtggtggctgcccgtttatctggaatgctcgctcgacaggccccaggtattacagaaccattaaaactgagatcacgccgcagccgccctgtgcagactggcctccctcgcctctgctatttactacagccttccagaaggcctctcgcttccgacggcctcatttcacgttcggagctcctgggttccaaggcctctgggattcctcccagtagcccatccgccacttcctctcctaaattacgacttgcgacggccagccgaacgcgcgctctttcctgcttcttgtcacccatctgtggctcctttgaagtttttggtcaggaactgagccgtccaagacagcagcccccgttcagatgtggctaccgggctcttaaaatgcggtcagtccggacgtgctgaacatggaaaacacgcaccaagcttcaagggctcggtgtgaaaacaaatgtggccttttccagtaaatctcccaacctccacgtgaacatccaagcttcagtaccaggcccttgtgcaacgggagtgagcaccagcacctctcagttacagcctggctggaggggagagcatcctggggtgctggggtggccctggggcctgtggggtcaccatgagggagtggagtagcccaggggccaccgtctggagctggattctgcaggctggcctgaggggagaagccagcgctacaggggcaggcaggggcgggcaggcaggggcaggcagcgccagggctgcggtcaaggtgggagacgcttagcctgaggagcggccgggcggggggaggtgggcaccgtgccccgggccctgccatgcttctcaaggtcacaggcctagagcaggggccactccccacacacgccctgtgctgtggccacggtcagcctcctgctgccctgaacacagcgagggctccttcatgcctccgtgcccgctgacaggcggctctttgtccctctgcctggaacaccctcccccatctcctcctcatggtgactctgtccttcctcaaggcccggccccagtgtcacctccttgttgctgctccccaggcacctgggttgattctccttggtggactttttgccacattgaggtggtcttacccattcctgttcccgtcctgaccccaggtctcctccaggaaggagctgtctccgtgcttggccgccccttcactgactgcacctgggcctggctttgcctctgtggcggatgagtggaaaccatgtctttttcttgtcttattgcagtggctggagcgggatgctgtgattctccagggtgccgtcccaaagcctcaggctgctccttgccatgctgggggtcctggctcttctggggcttgtccatggggttaggggttgcccgtggtgtttttgttgttgttgttgttgttgttttgtttttttgggggtttttttgagacaaagtctcgctcttgtcccccaggctggagtgcaatggtgcgatctcggctcactgcaacctctgcctcctgggttcaagtgattctcctgcctcagcctcccgagtagctgggattacaggcgcctgccaccacacccggctaaatttgtatttttagtagagacggggtttcaccatgttggtccggctggtcttgaactcctgacctcaagcagtccgcccacctcagcctcccggagtgcgggattacaggcgtgagccacacaccaggcctcctttctgcatctcttgagcggatctttggcttcttgcctttttaaagtggcaccggggtcaacttgatgaaaatttcccctgccgtcttgaacttgggttgaaggagagggagaattctcaggggcgcccgcggctctgtgtggctaacgtctccacggggtgtctccagcttgagggtgggaaggggctcgggatagacccaccccaagtggagagaggcctggaggggagccattgccctgcctccctcctgggaaaggcaagcactttgtcaaagtctgatttgatggggaaaaatgctttcacacagctcccactacaactgagtgggaattaagtgtttgcttaattggtcttttttgaaaacaggtttattgaggtgtaattcacataccttacagtgtcccctttgaaagtatgtgactcagtggattgtaggatattcacggcatcgtcctcatcaccacagtcaattttacagtattccatcaccccaaaaagaaccctgtccacatcagcagtcacccccatcccctcctccagcccccggcacccacacatccccttcctgtctctggatcagcctgtcctggacatttcacagaaatgggatcacatattatgtggccttttgtgtctggcatctcgcactaagcatgacatcctcagggttcacccacgctgtggccggggtcttggcctggttcctctttacggctgagtcctgtttcagtgaggggtgggctgcgctgggttggcctgttctgccctgggtggacgcctgggttctttccacccttgcctgctgtgagtcgtgctgctgtgagcacttgggacacgtttctgtgtggacgtatgtgtccacttctaggcagacacctaggggtggaattgcggagggggtactgagttggtcttgaccactgttgggaacgcctgcagagcagaggccccaaatgccttcatcccgttttcgggcaccccccaagccagtctcgcccctctccccttgcagctgatccaccttgagatcaagccggccatccggaaccagatcatccgcgagctgcaggtcctgcacgaatgcaactcgccgtacatcgtgggcttctacggggccttctacagtgacggggagatcagcatttgcatggaacacatggtgagtgcgtccggggcaggggcaggggcagggcctccacggaacagagcatgttggggagaaggaagaccccctcacggcccctttcctcagaggcaacagtgcgctggcttccaggggatccttctcaaggcagtcgatgccatacaagtatgtatatgtagatgcctttggttttgttttgttttctttttgtttttttgagaggcagtctcactctgtcactcaggctagaatctagtagtggcacaatctcggctcactgcaacctccacctcccagattcaagtgatacttctgactcagcctcccgagtagctgggattacaggcgcccgccaccactcctggctaatttttgtatttttagtagagacagggtttcaccatcttggccaggctggtctcaaactcctgacctcaggtgatccacctgcctcgacttcccaaagtgctgggattacaggtgtgagccaccgcgcccagccaatgattttgttttttaagcactcatgtcttcctcccagctttgctttttctcttgctgtatcccgggcgtccttatgacagcagagagggaaaacactcccgttttggggggtacgtaggttgtttccagtctctgccctatctcaaataacatggcactgactcgcaggcacacctgtgaggtaagctgtgtgagggaattgctgggttccagggtagatgcaattaaaaactgatccctattaggccgggcacggtggctcatgcctgtaatcctaccattttgggaggctgaggtgggaggatcatttaagcccaggagttcgataccaggctgggcaacatagtgagaaaccatctctataatttaaaatattaggtgagtgtggtggcacgtgcctgttttaaaattgttaacaacatttaaaaatggggataaaaatagcaccagctacatgagaggctgaggtgggaagatcacttgagcccaggaggttgaggctacagtgagctttggtcacgccactgcactccagcccgggcagcagagcgagatgctgtctcaaaacataacaaagctgatgactgtttttaaatggccttctcaggaaagtgtggcagtctgagcttgtcaaggcaggcctgtgcctcccccagctcagatctgtgggaccacagtctctagggtggggtacaggcacccccttcattgactctgacgtgcccccttgttaagacactctggcctcgaagcccagaagtgggtgagattgggtggaacaaaaggagaagtggccagagctcaaaaccccggaggaaatgctgccgaccccgccacaccgagctcatcaggtatcagaccgcctgccgcacagcgtcgtttgcaaaaccagaatgcttgggtgacaccctgcaaacgtgcgatcccctttgacagttttgtaatgaaggcaggaagtgaatttgagcaaggcccccacgtagccatgtgacccgagcaaggcagcacccgccttggagcccctttcccgcctgcgagggagacctggcgtctgccccgctgctcgcagagtcacgttgccggcggcatcaaagggcgaggaaaggatgaggaagcgctttgtggtctgaggcagcccctctgtcatgtggtgctccctattcctcctcctcgtcttcctcgtcttccccctcctcctcgcgcccggcaggcaccctcgctactcaggagttctgtccatcctcgttttgtgtggctgactcagttctcgagcccccttcctcccatgcagaaaggggacagtgtggcaacccgcccccaacctctattcttggtgaatttaaaatgggggttcccagagtgggtgctggcaccccaggggacaccacacagaccaccaggctgcaggagggagacacaggccgtgctgtctgtgttatggagtgcaccctttaaaagttccgaggtggtctagccaggggcggtggctcacacctgtaatcccagcactttgggaggccgaggcgagttcaggagatcgagactattctggcttggctaacgtggtgaaaccccgtctctactaaaaaaaaaaaaaaaaatacaaaaaaaattagccaggcatggtggcgggtgcctgtagtcccagctacttgggaggctgaggcaggggaatggcgtgaaccctggaggcagagctttcagtgagctgagatcgtgccactgcactccagcctgggccacagagcgagactccatctcaaaacaaacaaacaaacaaaaacaacgtggagcacgttgatttttaaagcattgggtgagccctgacagggcagcatccgtggaagtaaagtcatccaagggggccatccctgccatcctcgccggccctgtgaattctctccatgctgaacgatgctctcggaattcacctgagtgcccataggtttccatggaagggcctgcccagcacctgattcattccctcccaggccaccccagtgaggcaaaggggcagcttagcaccggggctgaggatgggcgtccgggtcaggtctcggccccaccgctcacccttaccacgggttcgggacaggactcttgccgcttctgctgtgaagctgagggaggtcgtagtccctgctggggtgaggactgtgtgagctcctcccaggatggcacccggcacgcacaggtgttgcatccatgtcctggctgctgcagccatttccctgtatttctacgctgtttcctcatatttctatgtcatctttattttgcatttttttccttctttttttgtggggggtagggggtacaaggtctctctctgtcacccaggttggagtgcagtggcatgatcctagctcactgcagcctccacctcttgggctcaaacgatcctcctgcctcaaccttccaggtagccgggactacaggtgcaccagcacgcttgagtagctttttaagtttgtttttttttttttttttttttttgagacggagtctagctctgtcgcccaggctggagtgcagtggcacaatcttggctcactgcaagctccacctcccaggttcacgccattctcccgcctcagcctcccgagtagctgggactacaggcgcccgccaccacagccggctaattttttgtatttttagtagagacggggtttcgctgtgttagccaggatggtctcgatctcctgacctcgtgatccgcctgcctctgcctcccaaaagtgctgggattacaggcgtgagccaccgcgcccggcaagtttttttgtagatatgggatggcactatgtttcccaggctaatcttgaactcctgggctcaaacgattctcccgcctcagcctcccaaagtgctgggattacaggggtgagccaccgtgcccagtgatgtatttatataaaatggcaagcacttgttggtgactggaacttaggaacagtggggctggctgcttccctggggtctgaacctattactggataactcggggcaagaacccagtggacagtggggcctcatgggatggggaaaggagagccagtggcttacggacctcgtagaggtgccccttggcctttctgggggtctcgtcctatctgctgaagaatgcccgtcttgttctactgtaatggaaactggacatgtccatcagtaagggagtgattaaagaatgatatttggctgctttgcagtggcaaagtgaaatccacaatggtgtactgaatgggagtatccccacagtacaacactattcatgtagtggaggggtggttgtagaaaataaacatagcatgggctgggtgcagtggctcacgtttgtaatcctagcactttgggaggccaaggcaggcggatcacgaggtcaagagttcaagaccatcctggccaacatggtgaaaccccatctatactaaaaatacaaaattagctgggcatggtggcgcacgcctgtagtcccagctcctcaggaggctgaggcaggagaatcacatgcacccgggaggcggaggttgcagtgagccgagatcatgccactgcactccagcctggcgacagcaagactccatttcaaaataaaagaaaaataaaataaacatagcattggcccattcatttgtttattgtattttcaagtcagggtcttgctcagttgtccagcctggagtgtactggtgctgtcctcccacgtcagcctcccgagtagttgagaccacaggcgtgagccaccatgcacagctaatttatttgcttatttgtgtagagatagggtctctccatattgcccagactggtcttgaactcctggccacaagtgaccctcctgcctcggcctcccaaagtgctgggattacagacatgagcccatttcgatgttgttttaaactctggctgggcaagcatgctttaatcccagtgctttgggagaatcccatgagcccagtaggtcgaggctgcagtgagctatgattgagccactgctctacagcctgggcaagagagtgagtcccgagtctgtgtttccaaatacacagcaagatgcgggggccaggtgctcactcctgtgatcccagcactttgggaggctgaagtgggaggacctcttcagccaggacttcgagagcagcctgggcaacatgaggaacccccgtctctacaaaaaattagcaggacatggtggcgcgcctgtactcccagctacttgggaagctgaggtgggaggactgcctgaaccaaggaggtggaggctgcagtgagccaagatcacagcactatgctgcagtctgggcgacccctgcctgaaagaaagaaagagagagatgaagaaagatctggaacaatataagtcacacttgaggggggaatggtggaagtgatgcggcgtccaggttatttatcctcatttgaattttttataagaaaaatgtgtttgccgggtgcggtggctcaagcctgtaatcccagcactttgggaggccgaggcgggcggatcacgaggtcaggagatcgagaccatcctggctaacaccagtagtgaaaccccatctctactaaaaatacaaaaaattagccgagtgtggtggcgggcacctgtagtcccagctactcaggaggctgaggcaggagaatggcgtgaacccgggaggcggagcttgcagtgagccgagatggtgccactgcacccccgcctgggcaacagagcgagactccgcctcaggaaaaaaaaaaaaagaaagaaaaatgtgttcacctactacctacgtaacaaaattacagttacaagaccattttaaacatcacacacacacacacacacacacacacacacacacacacacacacacacggtagacgtgtatggtcatgcacagagtgagatttggggtcagcagtacacagctgcaataccccctgcaccacatcctgtctctgtgactcagacaaattgcttaccctgccagactttggtctttatagctggagatcagcccttctcaaccaggggcagttctccctcccaggagacacctggcactgtctggggatgtgtgtggttgtcacaactgggggatgctcctggcgtggagtggatggaggccagggacgctactcagcgccctgcagtgcccaggtcggccccaccccagagagtgacctggccccgatgtcacagtggagaaaggcggctgcagagagagcgatgctcctgtgaggcgtcttccaccagctcctgaggctgcagcacagcgctccgcccgccctcatctccggggagaggctctttgaattttctcactaaacaaacattgattgcggccccaggagaaacgaagacggaaggagctgtgctggggagcaggggttttagggttgcgtttggtgcgtctgtttggttttcgccaccctgcctctttcgagtcgttggtctctttctggtttttgtttttttgagacagggtcttgctctgtcacccaggctggagtgcagtggtgtgatctcggctcactgcaaccttgacctcccaggttcaagggatcctcccacctcagccttctgagtagctgggactacaggcgtgcaccaccacgcccggctgattttggtatggggtctcactgtgtggctcgggatggtctcaaactcctcagctcaagcattctttttgctttggcctcccaaagtggtaggattataggtgtgcgccaccacgtgcggctttttttttttttttttttaattgaggagtcttgctctctcgcccaggcgagagagaagtggcacgatctcgactcacagcaacctctgcctcccaggttcaagtgatcttcctgcctcagcctcccgagtagctgagattacaggcatccaccaccacgcccagctaattttttttatttttagtggagatggggttttaccatattggccaggctggtctcaaactcctgacctcaagtgatccgcctgcctcagcctcccaaagtcctggcattacaggcgtgagtcaccgctcccagcccatgtccggcctcattttaagtaattcttttaaggtagattgataaaaactgagaatagaagcagcttccacctggccctggctcactggagctcccgtcctggcacctcctcctgggctgtctgagccctggccatacctgccctctcaccctgtgtgtctgcgtcttcagcctggagctggtggatggagtcacgtgtatgctttagaggtctcaaagcgtgttgggttttctagaactgccttcggcctttctctccaagcctagctgggcagaagtggccagagagcggcaacccgggcacccctgagtcccaggatttctcccccggctcctcccacccatgtgaatgaaagccatcccagggaaggctgggcttttgcaggagtcctggagcagcatggtggggaaatccaggctccccagccagcctctccaggctcctccagcccgccctctctagcctcagttccactttcctctctgctgagcacagaagagacgcacgccagacggtggcagtgggaacttggcctgtcacccctgctgtcctgggggtggcctggcaggtgtgtccggagcctctgcctctgaagaggcaccttgggtggctcccagtgcctggggttttggcatttgggggttttggtccccaggtttgttgccaggcagccttgggcaagacatggaatttctgtttcatcatttatgacatggatgtggggccacacccggggaccagcctacccatgatgactcgtttccaggccctccgcaggatgcccggcacagtggcgaggagaccacaggctgtggggaggggccgaggttaccgtcacctgggctggcgtcactgggatccctcctgcagtccatgcaccccctggcccctggtcctactcggcctggcctttctgccctaggtggcagggacaggcgcagggcagacgcccagcagtggagccgcagggcttggcgagggagccccctgggggtctggacgggcacacagcgacccgccgcctcctcccacgcggggcagcacccgcgtctcctccgcgccctcaccctccccttcccttcgtgtgctgggaagaggacgcaggcccaagacgctggtctccagcctggccgcctcccgtggcgcacagacaagcccaccacgtaggctgcagggagtgcgggccccacagctgcctgagcccccggccgcggcttgggctggcccggagcagagcctctgccgtggcgacctcaggagggccgagtcacgcaactgattcgaggatgggacgggaggcgggggaaccctgggccctgttccttccccaccttgtgggtgggtgttcagacccaaaggcagaactgtcagaagacgccctgcccttggcccgtgggtggagttgggctccggcccctgcttcccgtcaggaggcagaccaccccctcgccgggagtggggggacgcatccgtggcttcccggccacctgcgcagagcctgcactcactccttgtgtgccctctaggacggcggctccctggaccaggtgctgaaagaggccaagaggattcccgaggagatcctggggaaagtcagcatcgcggtgagtccaccgcagacccacatcgcgcccccaccgcactctgcacggacctcttccacacggccagggttccgggagccactcacagtgtggtgggggttagggtggcccctgcagaaagagagtggccaaggctgtgcccacctgctgtggagcttgaacaagtgacgtcccttttggggcctgaggtcaccatctgccaagtgaagacgttataggtccctcttcactcttagtatcctctgtttgccacactggtcccctctgcccctcgtggcagggggatgttggcagctggcacgttgcaggggacaggagcttgttgaaagggagactctggggtgggatgtgggacgccaggacctccagacacactcaccattgctgttagaaatgtcaccggggccaagggcgtctctgctgcccggtctccagcacagctgctccgtagagccgtgtggtttcagcagaccgtgcgtgttgcttcttggagcttgcaccttgtccatagcaggggccgagtcccgcctgcccataccagtgttggattaagacacaggacgcatgctgccagacacgcgtttccgagttgaaagctgccgtcacactgcctgtgctgcttgcttcacttctcgggatgctgcttccagggcgggcctgggggaaacatcgtccttcccaggcacccttagcccgtcccatctgggggcccttagcacagtccctgggaccccagatgctgcctttcaggctgatgtgggcaaactcggcagcccagcctactcccgggccatgggccaccatctcagcttccctggggctaagccgtgtgctctgaatcaaaggcagtagtggcatcggcggcactgcggccatgggaaccggggttgacttgcacacgccagcacagggctgtcagcactgtctcgtctctggcctcgcttgctccaccccagcgagctcctcacagcctgaaatggttcctgccgcagctccctcgctccagctctgactgctcagctctgacccccgggctcggtcaggagctaagccctggtggccttgtcccgtgactccctccgcgctcccctgcaggttctccggggcttggcgtacctccgagagaagcaccagatcatgcaccgaggtaaggcccagcccgccctccccagagccccgggggccggcaggcaactgttgggcgcccctcacccgcagcctgccgcctccagatgtgaagccctccaacatcctcgtgaactctagaggggagatcaagctgtgtgacttcggggtgagcggccagctcatcgactccatggccaactccttcgtgggcacgcgctcctacatggctgtgagtccccgctggctctcccctccagctctcctccctgctgctctcccccaagctctccccacccagctctgccagccagctctccccctcagctctcacccccatgtctcctgcgcagctgtccctcccagttctcctgcgcagctctccccgcctcccacgaggctttcccaactatttcgtgggcacacactcctacatggctgttagcacccccgggacagtcccaccccagctgcaccctccccttcatcagctctccccacttgccacaaggcacgtctaaagctggtgcctcctgggagcctgcttttcggattccccttgctctttattttttatttgttaatttactaatcttttgtagacacggggtctcgctgtattgcccaggctgctcatgaactcctggactcaagtgaccttctttcctcagcctcccaaagtgctgggattccactagcagtgagcctgagccaccacgcccggccagatctccccttcctgttggaattctctcttaggtttttgtctctagcagtgcctaccaggtttctttcttttttttttttttttttttttttttgagacagagtcttgctctgtcacccaggctggagtgcaatggcacaatcttggctcattgcaacctccgcctcccacccgggagcaattctcctgcctcagccttccaagcagctggggctacaggcatgtgccaccacagctgggtaatttggtttttgtttttgttgttgttgttgttttttgagacacagtctcacactctcacccaggctggagtgcagtggcgccatctccgctcactgcaagctccgcctcccggattcacaccattctcctgcctcagcctcccgagtagctgggactacaggcgctcgccaccacgcccggctaattttttgtgtttttagtagagacagggtttcaccatgtcagccaggatggtctcaatctgaccttgtgatccgcccgcctcggcctcccaaagtgctgggattacaggcgtgagccaccgtgcccggcagccttggctaacttttaaaaaaatgtttttagtagagatggggtctcgccatattggctagcctagtcttaactcctgggcttccacctcaacctcccaaagtgctgggattacaggcatgggccactgcacccggcccttagttaatttctggaccaaggaattggaatctggggtctttcaggaaacgactggggattcagcaacctgccaaattgagccttggagcagcctctgagatgttagctgtggaggaggaggcccctgcttcctggggcccatcatccattcccaaaagtgctgagcattgcaggctcttcaagagctgcggtcaacaccagctccaggcctcgggctggaagcctcttcagcaagtgccgcagggaggccctgggtgggtgagccgggaggtagaattgcgtaacagctctctatccattgctgcggtcattagccatggagagggtgacgggggctgtaacggggcaagcctcccgggttccagctgccatcctcgcccctctgggctctttcctccctggctctgctgcagccggagcggttgcagggcacacattactcggtgcagtcggacatctggagcatgggcctgtccctggtggagctggccgtcggaaggtaccccatccccccgcccgacgccaaagagctggaggccatctttggccggcccgtggtcgacggggaagaaggagagcctcacagcatctcgcctcggccgaggccccccgggcgccccgtcagcggtacggcctgaatctgcaacttccggtctggacgcgcagtgccctgcgcggggcctgctgtgccagggtcagcagctgcctcccctctgcccctggcgcaccacctgtccccctggatggtgccgactgtggtcagcagtcctcccatggtcctggggtttccggggacagagctggaagcagtgagcaccccaaacctgttctgtccggggcagctgcacctgttgttgccagctggagggatctgggagcgcagctttgccaccaagcccctgggcagttggattttccaacattttatcccgaaagcattcaaacgcacagaaaagtggaaggaattggccgccacagagcctgcattctgcaggtgacacgctcctgtgctgcgggccaagccttccagggagtcctgaagtggagattggacttggcatggccctcagtggcctgttggctccggccccaacacacacaggaggggacacagcccgggagggggcgggagggctcaggccccagggacagctgggctcgcagaggacaatccggcacttagggcgggcacctcgggagcgggagctccctgacgccagtcagagagggccgagcggacacttccaccgcctgagggaagagccgggggcggaccctgcttggtgcagaatcacaggagggtcctgtgattttttttaaagtcagacatcagggagagttggtggcgtcagaccccaaaggaccctgtagcggactgtggttggttttaaaaccatgtttccgaactacaaagcacacaccccacaactcatttcaggtgagcagttcagtggttttcagtcacagtgctgcgccccatcacctctaattccagaaccttctcagctccccaagaggaaaccctgtccccatcagctgtcactctccatccccttcctgcctctggactggcctgtcctgggcatttcacagaaatggggtcacacacttgtgtggccttctgtgttttgtgtgtggcttctctcctggagcgcagtgtcctcaagggtcatccacgccatggtgcgtgtcagagcctgggtccttttgaaaggctgagtagtattttatgacacgaacaggccacgttttgtggtcctacccggatggattggggctgtgagaaggagattttcatagcactggcaagcccacctcctcctctccagccagactgctgggatgtcttgatctcatcccagggagaggcccccaagtccttatcctcaggcctagcctcagcctctcccagtcccaactctcaggtggtataccatccccagcccagggccccagcccacctgcccatttcaggacgggcagaaggcgaaagtccagctgccaagcccaggcctggccagctggttctcagacaggggtcagccacccctagccagtctcccgtcctgagtggcacttggggcctgcccccatcaccgccagcagctccatgcaaggtcacgcggctgtccttgcctgcggtcagcaccgtccctccccctgccctccagagaggaggggtgatgactttggcacgtccggcaagcctcaccgagccaaatgtgtgacttctcaaaaaatgttcttgttccttttgccttttttttaattcactagaggctcaggcaaggagtagctgtcccagggaatggaacccagagtcaggcaggggagctttgtccagtgcctctgcacacccgcctccaatttaggctggcatgtggaggagggcgcctggtggtgatcagccccctgggagcccaacccccagcagaagtgaggtggccatcggcccatctcacctccatctctctccctgtgcaggtcacgggatggatagccggcctgccatggccatctttgaactcctggactatattgtgaacgaggtttgtgcttgatgccttttggcttttcttttccttttctttcttctttctttttttttttttttttttttttaggcagagtctctctctgaccagagcaagagtcaccaaggctggagtacagtggtgccttctcggctcactgaaacctccactttccaagctcatgtgattctcgtgcctcagcctcccgagtagctgggattacaggtgcgcaccaccacacccagctaatttttttttttttttttgagacattgtctagctttgtagtgcagtggcttgatctcagctcactgcaacctccgcctcccaggttcaagcaattcttgaaccaattccacgtgtgtcgcgtctcccatcttctactgtgctgcacaagcccagctccttcccaagggcattgtttttttatgaagacgaacccagaattcccaccgcagcctctcaccctgagtccagagggaggtgtgtgccagcagccctgggctcaggccgaggagccagcctgccccttgagcagtggcccagtgtctctgcatcagagcgtcctggcgcccgtgggcgtggactcataaatcaccccgcttccacggagaaaggtacaggaatggcccttgcctcttggaaggaggcccagagagcctagaaggacctgtaggtcccggggtggctcctgctccgtcagtccccataacaacccagtgagccacagtatgagggtttccaccgcccagatgagtaaaacaaggcacaaggagggacgcggcctccttccaggcctgcagctgtcagggaggcacaggactgcaccccaaggtcctgttggccacgtgaccaggccgggccacctccctgggccttctgtgggtttctgtgtctttggtggccctttggagctggggcagagaaacgggcatttgagctgcctgcagactgggctaggcctggggttgggtggcgagatgatgacggagccaggtggggtggccctggtgacccagctctccctgcacctagcagccacacccatgcccagtgagcacatcccccgacctctcccccgcctcttcccgcccctgcccctgcgcgggaaaggcctgcccctgccctgctggcaccgcttacacggccactcccgctccggggacgtgtgtcaggccaggctccccagtgcttgggcttaaaactgtggacccagtttggccgggcacggtggctcaggtgtgtaattccagcactttgggaggccacagtgggtggatcacctgaggtcaggagttcgagaccagcctggccaacctggtgaaataccgtctctactaaaaatataaaaattagccaggcgcagtggtgggcacctgtcatcccagctactcaggaggctgaggctggagaatcccttgaaccccggaggtggaggctgcagtgagccaagatcacgccattgcactccagcctgggcaacagagcgagactgtctcaaaacaaaataactttggatccagatgtccctctgtggggcccagtcccaaagctcatccttcagccagtgacactggggaaggaagcaagtgacgacactcgagaggttgtcctgttgataaaagggggacgcaccccactctttccctctaagcagccgtgactctcaaacgagagctttcgggagaaggccacctctgacagggtgcagcccagttggcatgtggtgtcggccaggcctgcagggtgggtgaccggacaggacagtgaggggtagagagggctgcagccgagggtccctgacgatgcccagggctgaccccaccctctgttctcctccacagccacctcctaagctgcccaacggtgtgttcacccccgacttccaggagtttgtcaataaatggtaggtggagccgggctgcccacacccctggccgggacccagatgtgccactccttccgggtcctgggtggggcccgtggcccagcctgcccatccagaatcccagtgcagcgttaggcaggactcagcccaacgggaagccagattccttttcccagagctgtggggctgcagctcccggctgccatgccatcctgtccgtgagcccaggggtgaagcaggattgcaggccctgtgcacatgacggtgtccccagctcactgtctgcagcaggagaagcctctgtctggtccccggacccctggtgtgctgactgtgggctccccgggatccgcccgcaggttctgggagggtcgccagccccactccattctcctgcccccaagcacccagcagcacctgtggcgtgggcttcacaggcatgtgccgcagaccacggggaaggagctgcggacaccccgctgcccacagggccggtccatgtgtgtgagctcgggacgccgtggaacggcaccgcactcctggtgccggagttgccccgggcccttggcgtgcgctccggcgatgttgccccgggcctggggttttattagacagttagctggggttgcgtccaggcttctgacccaccaggcggggtttcccaccctctttccctctcaccctcccgctggggggtgtcctgcccctggcaccaaagtgcagaggtggatccctcgtcctctgccaggaggcagaacagagcagccactctgtgccactctctctggtcggagagatccaggccccctccgaccacggcccacacgcgggtgccccggggccaccagctgactgccctgtcttgtctcctccaccgcctcccggtcctgcctcttggaacccccagcctcatcaagaacccagcggagcgggcggacctgaagatgctcacagtgagtgatgccagcgggttctgggaccgggagggtgcaggctgccacccaggccccaggaaataaggctgctgggcctggccctgcccggggagccagcacctgcgaccaggatgtgggcaggccgggtgtgccaggccacgccgaggaccctctgtgggtctctctcatccatgagagaagccatcctgggctggctgcggggagcagagggtgtgtgcgtgggaacagctctgggctctgagctccgccgctcctgcctggtgctggtcccgcacccacaggatgagaccccgggcttctttgccctcatgagaggctggaggcagctctcagccccccaggctcctttccctgcaaactagagggtgaccatccctgttctgcacactggcaagcaggtcccccgaggccgtgcgtacttcggtgtccccttaaacccccatcctctgatatcctcggaagcccagctgttcaccaaaactcgcctccccagcggggactacaccctcagaggagggccccgggcatcatcctcctgccctcagcccagcctgcatcccgagtgctttcccataccacagccaccgtcagcgaccttcaaacccctcgacagctgattggcggattggagatgccacccccctagacagcccgttactttctgtgcctgtaagaaaagaagagatgccagctacagacacccaaccgggtgccttctaatactggaatgtggctttcagttttgtttttttcttgagagtcggacagagtctcactctgtcgcccagactggagtgcagtgaagcaatctcagctcactgcagtctcagcctcccaggctcacacaattctccagtcagcctcccaggtagctacgattacaggcacccgccaccacacccggctaatttttgtatttttagtagaaacaggctttcaccatgttgtccaggctggcctcaaactcctgacctcaggtgatccacctgcctcagcctcccaaagtgcagagattacagatgtgagccaccgcacctggtcaaaaaaatttttgagatacagccttgctctgtcccccaggctggaatgcagtggtgcgattgtagctcactgtagccccaactcccgtgctcaagtgatcctcccactcagcctcctgagcagctggggctaccgatgtgtgccaccaagcccagctagtttttgtgtgtgggttttgtttttccccgcaaagatgaagtctcactcttgtcacccaggttggagtgcagtggtacgatctcggctcactgcaacctccgcctcccaggttcagggaattctcctgtcttagcctcctcagcctcctaagtagctgggattacaggtggctgccaccacgcccagctaatttttgtatttttagtagagatggggtttccccgtgttggccaggctggtctcgaactcctgacctcaggtgatctgcctgcctcagcctcgcaaagtgctgggattacaggcgtgagccaccgtgcccgacctgcccagctagttttttttatagagacagggtcttgctaattgtccaggctggtctcaaactcctgggctcaaatgattctcccaccttggcctcccagagggctgggattacaggtgtgagccactgcacctggcatgtgtgactttttttcttttttaatgaggcaggctgggcattgtggtgggcacttggaatcctagtgccatagggggatggctctctgaggccaggagttcaaggccagcctgggcaacatggtgagactgtgcctctccaaaataaataaataactaaaaagagaggggtactaatgttgaaataactttttttttccctcagacggagtcttgctctgttgcccaggctggagtgcagtggcgcaatctcggctcactgcaaactccatcttccaggttcaagcggttctcctgcctcagcctctcgagtagctgggattacaggctcgtgccaccacacccggctaatttttgtgtttttagtagagatggggtttcaccatgttgaccaggccagtctcgaacttgtgatccacccacctaggtctcccagagtgctgagattataagcatgagccactgggcctggctgaaatagccatttttgaaccagcttcttaaaaatgctcccctgttgggtatcctggacctagccaagatgtgtcctatcaagttggttggtttttcacccatacctacaccgacttttaggaagataggcaccttggcctgcctccagctgcaaaagaggcagcattcaggggcccaaggtcctggacaccaccctcctgggaaccccaaaggcctctactcacccactgtggggtggcccagcacagcctcttccccaagggcacccgccctcctcccccagcccttccaaccaagaggcttctcatgttgtgctgtcctgtacaggaaccgctggtcacacgtggctgttgaagtgtgttcagtggggccgggcacagtggctcacacctgtaatcccggtactttgggaggccgaggtgagcggatcatttgaggacaggatttcgagaccagcctgggcaacatggaaaaacccggtctcaactaaaaatacaaaaattagctgggcatggtagcacgcacctgtaatcccagctacttgggaggctgaggcgggagaattgcttgaacctgggaggcagaggttacagtgagctgagatcataccactgcactccagcctgtgcgacagagcaagactgtctcaaaaaataaaaattaaggccagttgcggtggctcacacctataatcccagcacttcgggaagctgaggcaggaggatcatttgagttcaggagttcgagaccaacctggccaacatggtgaatccccgtctctactaaaaatacaaaaattagctgggtgtggtggcacatgcctgtaatcccagctactggggagggtgaggcaggagaatcgcttgaacccgggaggcggaggttgcagtgagctaagatcacaccactgcactccagcctgggcaacaagagtgaaactccatctaaaaaaaaaaaaaattaaagtaaaagtatttaattaatttgttaaactgaaataaaattgaggcttttgttctcaagccatgggagccacagtccaggggctctggagcctcatgtgctggcgagtgggacggtgcctgtacaatgctcttcgcggagttctgtggaacagcccgttcttgcctgggctgtcctgctccgggggaccctggcaatggctgaggacattgtggtgtcacgacttggggaagcccctggcatggagtgggtggaggccagggacgctgctcagtaccctgcagtacccaggatggccccacgccagagaatgatccggccccggtgtccacagcggccggaggaccctgggcttgcgcgagcgtagaccctcccctgggagcgcaggctgccgtgctggtggtgtccccgccccaggtggagtgcagcatcctgagacccctcccaggcctggcacacgccgctgcccctttctgggtttctttccctctcctaccccgagtgcgtcttcctgtggggaagggagggtctcctctgttttttgctttctgtcccgtaccatctgccagggctgggcagacgctggccctccccgtcctactgtgactccaggcccgggtgctcacggctcccctttccttgcagaaccacaccttcatcaagcggtccgaggtggaagaagtggattttgccggctggttgtgtaaaaccctgcggctgaaccagcccggcacacccacgcgcaccgccgtgtgacagtggccgggctccctgcgtcccgctggtgacctgcccaccgtccctgtccatgccccgcccttccagctgaggacaggctggcgcctccacccaccctcctgcctcacccctgcggagagcaccgtggcggggcgacagcgcatgcaggaacgggggtctcctctcctgcccgtcctggccggggtgcctctggggacgggcgacgctgctgtgtgtggtctcagaggctctgcttccttaggttacaaaacaaaacagggagagaaaaagc

SEQ ID NO: 36160 - DNA, 17923 bp, Homo sapiens
acagcgggcagggaaagccgcgggaagggtactccaggcgagaggcggacgcgagtcgtcgtggcaggaaaagtgactagctccccttcgttgtcagccagggacgagaacacagccacgctcccacccggctgccaacgatccctcggcggcgatgtcggccgccggtgcccgaggcctgcgggccacctaccaccggctcctcgataaagtggagctgatgctgcccgagaaattgaggccgttgtacaaccatccagcaggtaatggaccctgaatggctccttatcgagaccttccttctcgcttcctctaaaatggaccttttagaggccctctgacaactgcctctagaggcatccacagccccaatcccttcccttcaagtgaagccgtctactctcctagcctgtgcatttcaccctctctcctgcaacatctcttcctaagccaacgtatctcaagtcagctcccttccccacctatgtgacatccgctcccttacgcacgactccaacccaaacctgatctccagatttgagccttctcaacttctgcggccaccaaactgtctggggccaccatgaaacactcattctctttctcttttcgaattgtggcatattaacccactctaggcagagctggatgggtggtttgtcgcactgtagggtttggagtaaaggtcactttcttcagctgctgctggcagaggcctgcagactgagccctcccccaaactgcatgctttacttcatccaggcttgagtcagtgtcatttctcatcccataggtccagtgtgtttttttaagtctatccttatttatgaaattgttgaacaagctctacccagagctttttgtgtggacagacctggatatcattctcttctaccacttatagttgtgaccttgagcaaaagcctagatctctgtttgtgtaatacgcggtctatgagaatgacagataacatatgtgcttgactctttgtaaatgctcagtaaacgttacatctctctttgcctactggaaaactgtgttcttgtggttgaaaaaaaaaactgtaagaaactgaaagattccaatccctttattaaagatctagaattctgttacctcttctataaagtgagttgtaataatacttatttgctaggggctaacatcagatatattctgaggtctgtttcaagcctaagacttggcaaactagaaaatgtgttgtaaattgaaagactgaagtgctacccgaaaagtggcttttattctcctacatagttaaaatctgtattctgtagttggtatcattaggaaagttgtctagttcccccattatctgattatgaaccagctctctggagtctgaactggttactaaatctgatttccagtttgataatggaatgaattgaacatctggattatactctaacccttaatattatttactgcaacattgaacccattataaaactgatcattaaggacagtttgttactgatttaaaaagtttttgtttatttgccttttagttcttttaacattcaatttttttggaattatgctgtgttttgtggcaaagattttcgggaaggagggttgagctatgctttttgtaataatctgggctttacagagtcaactgaatgtgaagtcaaccctgaccttcataagctttgtgttttagctgtaggataagggcatgacagagtaagagtaattttaaactacttaaaataatacaaaattggagggtagtcttaccttgatcctttccaagcctttagtttttagccacctgtaattactgcttaaaatactactcagctttcagaatgaagagggattacctttcacttgcaggatgtgcatttcacctgaaaatccttggattcgttcagttattttaaccccctttttcagtgtagtaaaaggagctaggctttgaagggaaatagacctacgtttcagtcttggctgtgtgaccttgaccctaaattcctgccttagttatctcatctataaaatgggagtaattgtaatcatttcaggattgttgtgaaaatcagatgatctaatgtctctaaaacatgtagcacagcgtttgcacttagactctcaataactgtcagttctaaaatttgagcaacatacagagtaaggatatctattacagcagaattatttatgatcgacaagttggaggcacaccagtgtagaaatggaggagcttgaaaaatacgttgactgatgagtattgaataaaatctaaggaaacactgattattgtcttaagagtttatccagagtgaatattcaaggattttgcatactattttgcctaacagtatttgttattgaattgtcattgaaacatttttctagattcacctacaaggagtttattaaatgatatgaaatgctacaatattaacagttggaaatcatacattgctgattctagatttttgagatttaattttatcactgacactgtatgtctcgacaggtaacaagaatgtgtttttagccaggcacggtggctcacacctgtaatcccagcactttgggaggctgaggtgggtggatcacctgaggtcaggagtttgagaccagcctgaccaacatgatgaaaccctatctctactaaaatacaaaaattagccgggtgtagtggcgggtgccagtaatctcagctacttgggaggctgaggcgggagaatcacttgaaaccaggaggtggaggttgcagttagccaagatcgtgccattgcactccagcctggcaacagagcgaggttctgtctcaaaaaaaaaaaaaaaaactaatgtgtttttatgtatagatacatattttagttacagtattgcatctctgacctgtgagccagaattttgaggctctcattatccatttgcctatgtgtttttgctggcatgtcatgatctgccactgtagagaaggaatagagttctagccaaatgtgtgtcctggtcaagttcctcaactcacaaaaaaggatgtcagtccccgcattatcccccacctgactataaaaatatgtgactccaccctagccagttgcatagctgtactccagtgtttgtcaaagaaataatcttgaagttatgttgcccagtgttattttttcttttcttttcttttctttttttttttttttttttgagacagagtcttgctctgttccctaggttggagtgcagtggtgtgatctgggctcactgcaaccttggcctcctgggttcaagcgattctcctgcctcagcctcctgagtagctgggattacaggcatgtgccaccatgctcagctaatttttgtgtttttagtagagatggggtttccccatgttggccaggctggtctcaaactcctgacctcaggtgatccacctgccttggcctcccaaagtgctgggattacaggtgtgagcaaccacacccggcccaatgttttcttaaaagcttagttaaggaaaacaaaaaaattatcagtggaggagtgtcatttatttgtatttgtgagttccaaaatggggtaagtcatcccaaggggtgcacacaatgaaacactggaatgtaggaagaaaattatagaacttccagtaacgtttactgttatttcatccacttaaatttttcattgtgtatacattctgtaatacaaaaatatattattgcagtaattctatataatttataaatatataaatgatttataaacaggatgtatactcaaattgttttttactgatagggcatatgttcaagaggagctggaagaccacagctctaaagagtctaaaaactatcctttggtgaagttagtcccaaaaacagctatctgaaccatatcattttaacgcattatagctctccttttactgaattacattttggcttacatggaagagcttttgaaaaaatagttctgtgaaacttgttgcagtgcttaatgtgctggtgctgagaatatcattcttaacattacatgggttccctctgaagactcatgggaaaagttactttaaagtctaaataagaataatatttgcatttttcctagataattagcttgtttaattttaaagacctagaggatatttctttttaaataaaaataaactaaatgaaccaatgttatcagtgtttataaggaaatatctgtatcataaaaattttatattcaatgctaagagaattgatgttacaatagatggttaaatacaacttagtgcaaatatatattgttctattatatgtaaataaaatctaatatggatcaaataatgagtgtacgtacctacatagtttgaattacacagttctttagcatctctgttagaacttattttgttgccacagattgtcagtgaagaatcttaatgccagtctaagatattaatatatgtccatatatattcttaagtgtatatttaatatattaagtttaaatacactaaatatacatatattattttttaaagtaataacttatttaaagttaagagataactaaaatagatgtaagattagaatttcaaatacaattgtaaaatattggtgaaaaatagaatatcttcaaacaatcagctaccaagaaggttgaattattcaatatttattgagggcctattgtatattagacactgttctggcactcaggataaagcagtggataaaataacgaaacccacccacacagagtttgtattctcagaagaattcataaaaaggaatatcagctgggcgcggtagctcacacctgtaatcccagcactttgggaggccgaggcgtgtggatcacctgaaatcaggagttcgagaccagcctggccaacatggtgataccctgtctctactaaaaatacgaaatttagctgggcatggtggtgcacacctgtaatcccagctactctggagggtgaggcaggagaattgcttgaacccagaagatggaggttgcagtgagccaagatcgtgccactgcactcaatccagcctgggcaacagagcagattatcatccttgatgcagttgttcaacacttaacatattttttgtgtgctatcctgcttttaaactaactttaagaaattagaactgtttatgcagatgtgctaaaggagaagaaagccctaagctataaatagtttatcatttccaggtcatgtaaaaatattaattttgcttataacagagaatgaaatatgtttaaagtgctgtatggtacagtagaaagaggactaggatcaaagaaactgtgttctagtcgttgctctatccagaactctcctgagtgtaagacaaattacttaacttgtaagtgcctcatctttttcatttataaaaatgagggagcttggactttccttaaagtcttttccagctaataatctataatttggtattctcttaggacttttcttacattcagaaccttcaggaaactcagatttcattggggaaagtcatataattattgttagattaggatttagggatctagttttttatccttgttggattatttattttaaacaagtaatttgtttactgggcctcatttgcctgatttatgagtgcctacagtagatgatttcaacagtctttctaaatctaaaagtaactgattctttgtacctgaagaaataagtaaatttaaaacgtatcatccctacaatgcatcttagctattttagtctctttacctgttctttactctggaatttcaaaccaaagtgtattttcagtcaacatttttaaaaacattatctacccatgatgttttgggtactattttagtgatagctatttccaaggcattgtggaaaatattaaaattatatggctctaaaatggtagcttagtcatgttcttagtgttaaatcagaactagctttggcacaaataaaaatgaatgattttttggccgtcagtatccatgtcaaagattaacctttacatattctaaggatttgtatctagtttgtcacatgatagcaaacaggtgaacttgtgtaatgtaaggaattaagaggggtgttaaaaagtaacaaaccataaaggagtggcatgaaagggatgggaagaggtagggaaatgtagtgattttatgacctcttagcattcagtaagaaactttatttttcacagagggatatagtgaatacctcaatccagtatttgtaagtgtgtatatgtgcttgagagtaaaaattacctattctgttccaaaaagttagtctttacttagggagggaatcatatatacgataggtggcctactttctgggtaggattcatataatattttattaacagtaatttctctcaaataaggaaattaggaagtaagtttatgtcagtttattaataggttcattgaagttcaaggcaactaaatttgtttatttgaaaatttatgtctgttattatttgcttatgatattcacttgtagaatttctcaaattctatgaaaagttagaatttaaaaacatgagtttcactttaaaaataaggcaataaaacacaaaataacttatagtcagtatttttcattcttgaacatagttcatagtttaaaatgtgtagacttttttttttcttttttcgagacggagtttcgctcttattgcccaggctggagtgcaatggtgcaatctcggctcactgcaacctctgcctcctgggttctagcgattcccctgcctcaaccttcccaagtagctgggattacaggcatgcaccaccacgcccggctaattttgtatttttagtagagatggggtttctccatgttggtcaggctagtctcaaactccccacctctggtgatccgcccacctccgcctcccaaacggctgggattacaggcatgagccaccacgcccggcctaaatgtatagacattttaaatacttgtttaatgtttctaaattgtcagcattggaggccttcttcaacatccagtagtactgttcaaagaaacaagatgaaaatgtattaattctttttctaaaagaatatatagtatgtttgatgtggacaatttctttcatcttgggctataaattaatgtcttatgaggagatttttcttcagtatattttcagcagttcaaattttccacctaatcaagttatttcatttatcataatggatgttagccaggtatctgttagtttatacttctgcttattctaatattaaggtattataatcacttcacgtgtcataattatctatttttatgctctcctatgagaatagctgtgtcattgtacagaacataagcctgtgttttccaggtctagaatgacacatgtgacattgtattgtcactatttgagtgatacctatttctaaatgctttgttttgtcaaaactttatgtttagaaatgttgaagtaagttggaatgttttttcgctaccatatccactgttgatcaattgctgttttctggaagacagcctctgtatctgttttatatatgtctaaatttacctgtctagctttatttgacatattatttactcttacaggaaaaaaaagctaagaaatgttaattgaatgttaattagctacaatgaaagggttaagttttctttaaaattttgttaacccattgtgtgacttttttttttttttttctggagtgcagtggtgcgatctcggctcactgcaagctccacctcccggcttcacgccattctcctgcctcagcctcccgagtagctgggactacagccgcctgccaccacgcgcagctaattttttgtatttttagtagagacagggtttcaccgtgttagccaggatggtctcgatcttctgacctcgtgatccgcccatctcggcctcacaaagtgctgggattacaggcatgagccaccgcgcccggccgacctttttttttaacagttaagaaaacactgtttgcagttatagatattaaactgatttttttgtcacttgtccacatcttttagtatctcagaaaaattagcaatttagaaggccttatgtattggctactgctatttttctgtttagtacatagcagttgttaaactaaaattagagcttgttttcatagtttaaaattattcactcactaaaatacctctcttggtccaggttctagcaaccataatttgatgtttgaagttttttcagttgtttggtttggtggggaagggctgttgttaatattgtaaaactattacctagctctaggcagtttagtaaattagttaccaggcaaacctactgaaaagatcgactattaaccccaaaggatcaaccatttaagcctgtcagccatttaagcttgaaaccagaatctagaggctttactcagaaaacaattttggggtgacagaaacttcagctttcaaatagaacaagagaagtctgctgaagagttcagagtaaaaatgaacacccattcagccagagactaaaacaatacatggactgactcttgattgatgaagcgaaactccatgcgaggataaaaactaaacttagtaattgatactgtgtatgagccagagacactgtgtatgacaaagaaaaatgaaccaggtgtaatgataggaatcccagaatctcaccctaaatttccagagagtttgagaagactgacttataggattaatgcattatggcatcagactcaggggaagagagctgtggtctaagagtagagtaactaatgagtgaaatctaatatatccttggcataaagggaacctgatgtccctagagatgagaaaacagcaaattccagccttgaggatgaagcagtgtcgaggcaaatctgggtcagacagaaagtttgaatatctttgattagcatctatcctgaacatggtggatccaattcagttctgttggcacatacctattatttgtcaaggaagattaagaaaaggaccttgtcttcgggttaatgtgacagatgcataaataatcattttaacagaaaatgatagaagaatatacaggctgctttggtagttaagagaaggagcaatttagcctaacctggagtttttttgtttgttttttaaggcttccttgaggagatgcaacctgagatgagtttctgatggataggagttaggtaaagactaagcaggatattgagaagggacagcatgaactgaagagccataaaatagcatgaaactagttgaatgtttgcctagcttatcagtcgccctaggccaggatttcttaaccctctactttctgggagcggctgtcctgcgcattggaggatgtttaacagcatcccaggcctctacccactagacggcagcagcagcggcagcagcagcagcatctgcagcagttggggcaccacagttggggcaactaaaaatgcccctggggggacactcctggttgagaaccgctgacttggctaatatttagttaaattaggattatatattctgaaactcagtggcttcatgttttcttttatattcccctttttcccttcgtaaaaatgtcttcaattccaaccttaaccaaagaagaaactaaattattttctatcttgtagagagaaaaagatgtggctagagttctatgtgtgtggtggctgtgcccagaacaatactgcttagagaactggataacagaaactgaatatagataggtttttcactcagttgtaagaacatcaaaatttagaactccttgatagtttaaattctctcaccagctgtttcagcactgtttttagatttattctacaacttaaaatacggaaaattcgaacgtacacaagaaaatgtaaaaatggttagataccagatgtatgtgagaaaataaagtttaacattataatgggctgagtagtcccacaaggaaccacagggtttgtgccgtgatcttctttctagtgtttgaagaattattctaatgatacccagcttctctgaagaatgagaaaatgaaacttagattgctgtaggactttaggattaaattagaaaatcagcaaacatattttaaaactattaaaagcataagacagacttatcaatatttaagtatcaggctgataaaaacaacttatgattttaaagtactttaaaagttatttgtggccgggcacggtggctcacgcctgtaatcccagcattttgggaggctgaggcgggcagatcacaaggtcaggagtttgagaccagcctggccaacatggtgaaaccctgtctctattaaagatacaaaaaaattagccgggtgtggtggcaggcgcctgtaatcccagctacttgggaggctaaggcaagagaatcacttgaacccgggaggtggaggttgcagtgagccgagattgtgccattgcactccagcctgggcaacagagtgagactctgtctcaaaaaaaaacaaaaaaaaccaaaaaaaaaaccaaaaaaaaaaaacgttgtttgtatgtgtatatatatatgtgtgtgtatatgtatatgtatatatatatatatatatatatatatatatatgtgtatatgtatatctgtatattatatatacacatacatatatattagggtaataaatgttagtataaactgcttccaactctactggctaactttcctttttatttattattctacattctattaggtaataggggtacaagtatgaatagtattgagccactagcttcgagaaagtcataatcttgataggtacatagatttacaaataactggagtaaaatatgtaaaatgtactgtggtagattttaaaatgacattgaattaatgaattttgctgtaagaatactgtgaattcgagagggacaaaaatatcaaggactatgttaaattgtggaagacagaatgtgtagcattaccatcacttaaggctaaaggcaagtagtttgcactatctggtgatacttttcaaaacctgcatactaagcaaaaattggagggaagcaactgccatttttacatttttcaaattttgctgcttaatgttaagattacccaactatttgttatagtaattcagccaaaatgcacaaaaatggggtgttatcactgggttcattttcatttgggatgagagtgttacttgagtgtaaaactagtatgaaagtacattagaatcaaggttccctaaaatatttttatatggcagtatatttactgaaaaaaatttgcatacagttgaacctatcagttcaaacctgtgttattcaagggtcaactgtactgtgatactgtggtgcctctctaaatgttaactgaaatacaaagtatgcaaaaagcatagtaaaagtggttaaaaataggttgataaatcctttggtttttaaaatttggtgacagctgttaaaagacgtgtataatatatttggtttattcctgaatttttcttttcttttttttttcaggtcccagaacagttttcttctgggctccaattatgaaatgggtaagtcttgagtttttacggaagctactgaaagacaaattccttaataggaatttactaatttgaagtaacttttatgaaggatatactttagagtattcttggtatgcctctagatgatttcatggcaaatattctcagacatatcgttttctacataaagcaactatctactttagtttttctgaactctttagataagaggccttctgggaacatacttgttatcaaaaaacttacaattgtgcaccacatggacatgaaatttcattctaaaatgttattactaagtaaaacattaagctagttagaacccccaagttaacttttattattaatttagtatgagaactgaaggtactatcaccaaaatataggtgaggaaagttactctcaaaaagtagatggatttattcgaatataaatattagcatttggtaaatgagagaacctaggacttctgactccaagcccagtgcttttactcttccccaaagttttctttcttaaagttcttacttagctgaaaagaaacaattgtggtggctgtttgtagcaaatcattgattttatgttgaaagggccagtttgggtctataactgtgcttctcaaagtgtcatctctctggacctgcagtggcatcatttgagaacttgttaggccccatcacagacctactaaatctgaaactctagatgtggagtccagtgagctctgttttcataacctcttcggatgattctctaatgccctctaaagtttgaaaaccactggtctgtaggcttttttttttttaatgtggtaaaatacatataaaacttactatctgaaccattttcaaagtgtacagttcagtagcgttaagtacatttacatcattgttaaccaatctccagaaccctttttatcttgtaaaagcaagtctctgtacccataattccccattctccttctcccagtccctggcaaccaccattctaccttctgtctctatgaatttcactactctaagtacctcatgtaaatggaatcaaaatgtatttgtctttttgtagttggcttatttcccctagcataatgtccacaaggtacattaacgttgtcacatgtgtcactttcctttctttttaatgctgaatagcattccattgtatgtatttaccacattttgtttattcttctatatgttgattggacaattggtttgcttccacatttttgctgttgtgaataatgctaccatgaacattgatgtacaagaatctgtttaagtcaatacttttaattcttcttagtatacacccagaagttgaattgctagatcatatgataattctgcttaatattttttgttttcctcagcaactacattattttacatttctaccagcaattcataagtgttctaatttctccacatcctcaccaacacttgttacttttgatgggggagcatttttgtttttgtttttatgataggcacctaatgggtgttagatatctttgtttttatttgcacttccctaatgattagtcatgctgaacatatacttattgtacttattggtcagttgtgtatattctttggagaaatatttattcaagtcctttgcctgttttttaatttaatcaaggtgttttttgttgttgttgagtgatgggctgttgtaattctcttaaatgtacttttaaaatggttagaacaattcagaaactcagttgtaaattcaagtggttgagaatgttagagttggaattggctatgactcaatcttatggccttgggcaagtttagtctctttgtcattttgtctcttcaactataaagtgacaagattagaatataagtcattcgggagctgtattttacagagatctagggagcaggttttttttttcatatctacatattgagaaaagatcctaaaaccccctatactaatggaagttacattaccatttccttcttctctccctacctacacttaaaattacatagtaataatatatctttatagtggaattgattgctgaagtattcaatcattaaaagagtttgagtgatttcatctattcacaataaatttaggggcctctttgatctcaaatttaccacagtttaggagtttattgattttatcaatagctttggggtttatttgaactggttcattactgttgtgagatattgacagcattatatactcataaatgccttcttgactatctgtctctttaagaacatctattttaagtacatgttgaaatcatacatagtctccagatgacagcatagcaatagaaacttctgtgttttgttctctggtggggagacttcttctattagatacttaccttatatacctcttactgtgttttactatcccagagtatttgataattaatctgtagaattctatacatgacacataacagttgcttctgcaagccacatatgttctataacatgaagactctcagaccatatgccttcaaacatataactgtagtagagtcctttgtaaccactttagttgaaaccacataactaatcataaaggtcaaagtggataatcctaaaaacaaaaacctatgtaccttaaatattttattttaacctaaaggatataaatatatattcattgacaatcagtcttttttaaagctaaatcttttatttgtgtatggatttctgagctccacattttctatcctggataaattacactacagtgcatcctatataatttccagcttagtttttttaaaaaaaaacaatttattaaatcatgtaaattacattaacaagtaaaactggcataaatagattggggacaaacatagtgacttggtaaaaatacagctcatctggtgggagcaaaaacgcatgagtgcaatagagacagtgttaaaaacacagaagagaaatggccatgtatatgctgatgttaaagaaaaatggcgtaacagccaaggccgggcatggtggctcacacctgtaatcccagcactttgggaggttgaggcgggcggatcacctgcggtcaggagtttgagaccagcctggccaacatggtgaaaccccgtctctattaaaaatacaaaaattagccaggcatattggcacacgcctgtaattccagctacttgggggctgaggcatgagaattgcttgaaactgggaggtggaggttgcagtgagcctagatcgcaccattgctctctaacctgggtgacagagtgagactgtctaaaaaaaaaaaaatgatctaaccaaaaaactaaaattataagtttttctgatatttatacttttaaaaaataattcattagaagcccaaacctcagcatcacacaatatacccatgtaacaaacctgcacatataccccaaatctaaaatttaatttaatttaaaaatgataacattggcagaaaacatcaaaggaagaatctatacaaatgaccttaacagcttttaggtatcttccatgctagtggttagtggttcctgacatatataaagagtatataaattcatatgtgaaataggtagaccaaaaaaaacccaaaatatatatgtacgtgtaatgcatacatatacatcttatctatatatgtactactgactttcagatatgtgagactgcttagtgtacctaacaaaataaaattagttcaaaaagcagttttttaattcattgtgctttttttttgttgtaatctacattttcttaatgaatggacactaaaattatagctgctaacttacggaaatctcaaaaatgtcttgtgcttgatttaaagttaaaactattactccacatttgtgatactttttttctttctatgcgttaatgtgtaggggttggtgtgtgctggattggctgatatggccagacctgcagaaaaacttagcacagctcaatctgctgttttgatggctacaggtaaattaaataaatatcttctgtgtttcttgtagaacataaatgatttttgttttcttttatatcagtttatttagtggcttagtgtttgaaatacacccacacacaaaggaattaacagtattatgtctaggaagttattaagttatggatggaggagtcacagaaagaataagtatctgaatgggcttttgcttttcaggtttttgccatgaacatatttttataagtgggaagaaaattacagttaatagtcactttaaagattcctctttcatgtaagaattgagtattttctgtgacactaagttacagaaacattgaaaattcagagtatagcatttctttgtccctcatcctacattattgttgtaattactttactcaatattaagtattcactgaagttattgaagcagtatgtattctttttaaagtaacattttgtttcaacagggtttatttggtcaagatactcacttgtaattattccaaaaaattggagtctgtttgctgttaatttctttgtgggggcagcaggagcctctcagctttttcgtatttggaggtaagcctaccagagatatttttaaaactgttgcaaaagctacttagatggcactaattttttttttttttgagacggggtctcgctctgttgcccaggctggagatggcactaatttttttaaaagattcatatataatgctaagacaagaagtatctaaagtagaaatttaacatttctagaaaagtctaggggtttacaaataagttaaccagttaactagttaactgactaaaatcagttaagcagtatgttacctagtttttagatttaactgtgcatcatttagatggttaaccatctcacataatctcttttattaagacaacatatacagtttatgatttattaatttcttatgtaaaccttttatcactttcaattgtatataataaattggaacttaagtgtattgttatgtagtattggaaatgatacgtagagtgaggtctttgctttcattggaaagtgttccatgagcactggaaatttttaaactatttactcagtagttaatattgtcagtgatttatgataatgacattatgatcaaatatttgaaatcaggatcttttgagaaacctaggaggtatggttggcttcatggaataagttccttcttatgcttttatactactctccattccattataagctaggaggaatagtaaatgaagcccaaggtatggtagaagggaaggaaagactatggctctgtggttacttctttggattgagaattgaggaaatggtccttagcgtttgtgaacttaagtgtttacaggctgttaacccaatagcctgcctgcatcacagaagtatattttaccttagtggttagaagtatattttactttagtgattactttagtatattttactttacctgttgatcttattcttaggaaaggtgctttgcgagtataaattttaaaattctaggtgaccacattttactaaattttatacatatgttcacaagtttgtcacgttcttgtagaattccagaatgagaatatttttattaaaataatacttttgcacaggaaactatatgtcagctaagctgttaaaagtttttggcaggccgggcatggtggctcactcctgtaatcccagcactttgggaggccgaggcaggcagaccacaaggtcaggagatcgagaccatcctggctaacacggtgaaacaccatctctactaaaaatacaaaaaattagccagaagtggtggcgggcgcctgtagtcccagctactcggggggctgaggcaggagaatggcgtgaacccgggaggcagagcttgcagcgagccgagatcacaccactacactccagcctgggcgacagagtgagactccatctcaaaaaaaaaaaaaaaaagtttttggcagttgtgctcttattatctgaaacaaaatccagatgcaaatgaactctttgaatcctttcctttctgcctgtttctacctgtaagccctccgggaagattctgtttacaactgtatagctacttgaccaccaagaaagaagaaatggagtatgcttcccattctctccttaccataaatttgtctattattattgatgattatttttctttctgttttctttatagatataaccaagaactaaaagctaaagcacacaaataaaagagttcctgatcacctgaacaatctagatgtggacaaaaccattgggacctagtttattatttggttattgataaagcaaagctaactgtgtgtttagaaggcactgtaactggtagctagttcttgattcaatagaaaaatgcagcaaacttttaataacagtctctctacatgacttaaggaacttatctatggatattagtaacatttttctaccatttgtccgtaataaaccatacttgctcgt

SEQ ID NO: 36161 - DNA, 5536 bp, Homo sapiens
gcctcctccgctgtctccctggagttcttgcaagtcggccaggatgtctcaggtacagcgcgtgcacagccaggctgcgaaggtgcagcgggcgggaggcccgttgggggctcagccggctgccagaagctctcgggctctttccttccgtgcccctcacttgctcatgggcccatgcctagccctgattcgttggacagagccttgtgagcgggattttccgtttggggatttctaaatctgctgcccaccccgcaactgccggaaagttgcccatggggtggacttcgctgtgtagcgggagaggggtgggagtcgagggtgcttgatggagagatgggggaaggggttgcacggattggaggagcgaggagactcagtccccatcccgaagcacagggcaggacgtcgcggcggagtggggaagcgaggagtccgtggccgagagcttggaggtcaggggaagtacggggccggctgctcagagtgcgggacgaggagaatcgcggcccggggagaggtgacccaggggcccctcccttctctccagtgtagacccttgtctgagaccgagctatgtggggcgacctctggctcctcccgcctgcctctgccaatccgggcactgggacagaggtcggtgttgaacgcgcgggccccagggggagggaggggaccaacgggctccggcgctgacaccgcggcactcatgccctgtcccctttcagctgtttccagcatactgtgccccgtctgtcctcaggccagggcttcgctgcagccccggccactccctagtgcctggcccggtggtggccaggcagttggccgcgctgcttctcccgcagaggggacccccactgggggcgaaggcttggcctgccctcttcactgctgtatttccagacctgatgcctgcgtttgtgagagctctggatatatggttttcgattgaatgagtgaactggaggggcttccccttcttgtgttgctgaatctttctagctgccctgttggggcagggaggggcagacacacttcaggggctgcattgcccgaagggtgccacctttcccacctctccatccccgtaactgggctgtcatcaggccacagtaggattcttaccctctcccacccagaggaggccctcaatcctctcctctcccttccatttaggctgagtttgagaaagctgcagaggaggttaggcaccttaagaccaagccatcggatgaggagatgctgttcatctatggccactacaaacaagcaactgtgggcgacataaatacaggtatgcagagcgggggttggaagggcatctgctcatcaaagcaggctcagcagctcagactggaagtccctgggaacttcactctcaaactgcctgaggccctactcttcaggtggggtatggtgatggttcctgaggtggaaaagaccatgttccggattctcagtgtctccagtagtaacagaattcaaatcctggttttagaaggtctttactggttatcaccagcagctactctctactagggaagaagcaaaggctgcagcttggaaaagacttgctgaaggctctcagctcagtagtatcattgttgagccgttcagcttctgccctagatgggcaggatcaaagttggagcactttttggagcacttgacagcctggccaagcctgatgtcaggagcagagaagcacctggtttcttgggctaggtcagagcatttcgctaacaagtctgtgccttcctgatgataactttttccctgcccagaaatcttggtgcagattttgaggctgtgctttggactgtcatgttctgtaataacatctttcctgccttgggcaggtttcattctgtccctaagtccctgaaacatgggtggatactgaggcaacagcgcagtgcattctgtgcaaggactcagggttatcatggcagcacagaagggaggtctcccctgcccctgctgaggaagaaggcgagcatggtccctatttccgcagtagctggggtggaagatggagcaggtgggctggctgccaaccagctggaagcaggaaatagtacccagaatgacagatcacaggcagtaccatatcaaaccctggggttcacatggagcacttagttgaagaaggtcttatggcgaaggtgagttttacagtgagttcgtaaactctgtccttccagggaggggaaggaaaggtgaagtgggggaggccagaggtgccaagatgcttttctgacaaacagtattttcacagagactggcctgtgcccgtactagagttaccgattttcacatgagtctagatagactggcataggaatctatcacttactgatcaaagaggtgtcatcggctctctctagggctgtactatacagccctattacacgattataaaacatgatagtccaaacacgatagtttagtataatagccagtagccacatatgactatataaattttaactgaggctgggcgctatggctcatgcctgtaatcccagcactttgggaggccgaagcaagcgaatcatgaggtcaggagtttgagaccaacctggctaacgtagtgaaaccccatctctactaaaaatacaaaaattagctgggcatggtggcatatgcctgtagtcccagctacttgggaggctgaggcaggagaatcgcttgaacctgggaggtagaggttgtggtgagccgaggtcgcaccactgcactccagcctgggcaacagaacgagactctgtctctaaaaaaaaaaattttaactgaaaatagttaaataaaatcaagtttagtcttcattcacaggaaccacatttcagatgcccagtagtcatttcaggtacttggtgtggcaagtggctcctgaattggacattgcaaatatacatgtacatttccatttccaccgcttggagagagctgtcgaggagtgctattctaggatcctgatgatgaccacaagggcagtttgtttcagctgtccctgggaacacttccctgaaagcgctcagggacattttctcaggcacagtgctccaggctacggactctgattgttccctgtggctttggggctgggcatcgtagtgaaataggacaacagggagatggtgagtgtgtttcccaactgcagatgacaacaggtctataagcataaagtcatcatataacttaaagaaaccttaccctcggtgaaatctcccacagatcagcaagaaatagactaacaattcggtagaaaaatggggctaggatataaacagttcataggaaaggacacctgatatcattaatgattagggagagaaattgggtagctaacagcaggggtgagagagaaactttatagtattttcctctgtagcttttgaattttaagacatatgaatggattttttttttaattgtaattaaagtataatttttttaaaagagaaattttggagtcatttaacttgtaagacaaaggctatcttgtaataagaatactgttcttcctatttgctctagattttaagtttggattggcatacattggttttcttagggcagaacccactctactagacctatttaaccccatgacagagcctagaaggaacaggtgtaatagaagatggcatttatggcaagaaggttgatcaagttctccattagaatttgaaccagatctaatgccttttcttcccttgtttaagaacggcccgggatgttggacttcacgggcaaggccaagtgggatgcctggaatgagctgaaaggtaattgttctaatcaatttctctcatttgtgaaacccagtagtgaaagagtcttcattatgaagtgtaagggaagaggagagaaaacaaagtcaatggggcacgtgtgggaaaccagcctgacctgtgccagaatgggaaaaaaccgggccacctactttttctcctaacaccatttatgccttttctaaaagcaccatctctgagcaggagcatcatctagagaggaggggctgggaaccaggccactgaaaaatagtttgggaaatgatgtagttggcgtaggctttggatgtgttcagaataaggggtggtttcctgtctgcaactccctctcccctacaaggccaggcggtgaccccctaaccccagtggccctccccagttccttcctagccagaaggatacataaaagaagggaatgagctaatgcatggcctgccgctggcatcgtaggctcagtgaatggagccattatatgctaagcaccagcagccaagaagtatccaagctcgtacttaatcacgtgccacctgcagcagcaagacccaagagttggcaccaaagctcctggcagcattagtgttcctgctggctagtttctgaataagccctctgtccttctgcgaatgagaaacccttgaattcagaaagggccacaatacaataaacacactcctaggatctgcaagtaactgggaagggaatgcccatctgcctgcccattttcatgggacatttccataccatcctcaggccccatgtactctccagtgcttcagaacaagctctgagttccaaagggtctctatccttcaccatagaatccaggaaactgggtgtcactgtctctgagggatacattcagtgtcctttctactgcagcaagaagacaaagatttgtctcattcccctccaagaagcagccacttttggtcagagttcctgaaacttttctcatagcctctctctggggagaagagggtgcctggctttgctttttcactgccagcttaacagctctggaagataggagcccaaaacagagacactgaaaaggccaaagccaatatcagccacgagagttagcaggaccagtaaagtcaccacgatgacagtttcctacctgtctggagggtggcacctctctcccaaggctcacaatggccattcccccaggacaggtgggggacgcaggtgtccagcagatgggcgacagatcttggccagccccaccaggctttctgagcacagttgcttatggagcattcacttcgggccaggttctgtggatactgtctcctgtaattagtagaatctcaactttattaagtgagaaactgagcctaggagagttacagcagagctgcctggggctctggaggctgcttgtttcctaccatgctacctccctgacacataatcctgtcgattccttacagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttgttactttaaat

SEQ ID NO: 36162 - DNA, 323767 bp, Homo sapiens
gcgcgcgtggggctccattccgcggtgctgggtctccgtgccggggtgggtgctcgtgtgtgcgcttctcctccccatcccccttcccccaagaataaaagaagaaccgggaggcgtgctcagaaaataaataaataaccaccacacacgcgcagcccggagcgagtcggcggggctggcggcagcggcggaggaggagtgaaggcggcggcggcggaggagggacgcgcggaaaaggcagcaactttaaagccagctcagagcctagacctccagccgagcggtttgcagcgcggcggcggcggcggcggcggcggcgttgagtgtctggcccgccggtccggtcggggtgtgcagtcggacggacgagcagcgcgtcgctgtcctccggcagctggagatgtccgagcccaaggcaattgatcccaagttgtcgacgaccgacagggtggtgaaaggtaagcggagcgccgcggtggcctgggtgcaccgtgtgccgcaggcgccagggcagcttgcctcgcctcgcctttcctcccctcccccgccccaggttctcctctgtccgctccagccgcggaccttctaggatattgtgcaacccgcgaaccccgcgaaccccccgcccccgcggcgcccttcccccacgcgtcccacccagcctcacttggggcatttttattgacgggggcgtcagttggcaaatggctgagccgcggggaggtggcggcgggggtggcggtggtgggagggggcgcccggggggtggttgctggtagggtgtagctgctgtgacagaaataggaagtgggtggctctgctcacaggcttgcatgggatcgggtttatggttttcttctgcagagggaggggtgattgatggctttttaaaaattaatacggcatttttatgtggccgtggctttccaccgactgcctcacttgggcagggttgtcttggagctccattgcagcaattccctccgcgcccccctccccctccccctccccctggaagggcctgcacaggactcgcgagagagcgggagagcgtggggggagcccggcgcttccttccgcgcggggcgggggcgggggcggtcgctggctggagggtggccgcggggggcgcgggaggcggggaacgacctgagagcaccagccgttgccgccccgggatttcccccgcacgccccggggagagacacgaaaaccacttctccagcctctcttgccatccccggctgtcccccgccgacctgtcattgctcttaaagggttctccactcgtgcacacctcccaagtgataacctcattccgcctgcttcctccgtgccctggcatcctttttgtaacgggctgttggattcctattattgcctcctcttcgccgcctacgggatgataaactcctggcaaggatgcactgaggttgctggcaaagagaaactgggatgtgcggagtgaggaaggggacaggctgtggttgatcactctgtcgcacgggaatctatcggcctccttgtattcctaggtgtagtgggggaggaaccatcctatgaatcctggaaggctgaggcaacagagcagaaccacttggattaagtagtatctcacattcctgggggtcaggacaccaagcaaagcagagatgggcatgagctgtgcggggagcgggcctctgaaattggaaacagcactggctggtgtaatgtgtgtgtgttgtgtgtagaacagagatggtatctaatgtggccagagcatgcaactagagtgcaaggcaatcaagtcgtttgcaccatgagcacttaaaagtgaagtaacccagcagcccaaagaccatgatacacaagtccctctggggtttcagaaatgattctttctccttagaggtttactcagtttttaaagtaatttttctgtgtgagtggtggtggtgatgggggaaattacgttcccttttttcagaaagaacaaaatatcttcttttgttttggttttactggaatcattcctgcttcagcttcggtgcaggattcatatacccatgaaaataatgaggaaatagctctgcaaaaatgattcgaaatagggctgcagagagatgcacagctattttatttttcctgcaggcatggattttcatggaaacagtccattcacatttatttgagagagctgtgttttgcatgaaaggcttctgttgacattttcaaaaattgagaccctttgcagaaatatcagagaatgacaattatctccttaatgtgtgaagtttagatgtagctccaatctaggttaagatcaaaacaatgtaaagcttataattcaaatgatactagtgaacgtgttggcaattaaaaaaacacttgtgcacacataaggtcacattccctgttttaaatcataggatgtggattcttaatgtaggtgtaaagtcatcaggtgaacatgtaaaaataaatgtttatactttctggcttagtttctctactgcttaaaatggaagagcccactcaaccattccaaggctactttgccttgctttttttcaatactgtaccattataaatgacttttcattttaggtacacacactcacccataatttaaaaaattttattcacatactatgtggatagtagactcaaaataggaaaagttaattttgcatttgttttgatagagatcctgatgtgagatgtgaaatgtgaaattttgtttatagaagttttgttgatgaatcctgattttaaggtggatacactgttattgtttatcctgttttcttgtagaatattattggcatgaaaggcattatacaaggttggattcaaccttttgtcatacataagatttttattattagttatttgagataatctattttgattattagctttctgtgaaataatatttccccttgagtatgtatacacgtactgaatgaatggaaagtacgcgtatgctggatgtgaaacatattaacaagtgatttaatttgcaaaaattagataatatggagtttagaaaccattatttacttgaaattttgttagaacttcatctcaatggctatttaactcattctttaatacagaaaagaaattatctttgaggaagtatttgtgctccataagttttctcttttttacgaagtatgtgtagtattatttactatatatacatacaaaaataaatattcagattgttattaccatggcatgccatggcatttgcttacagttatatttattagtgtcatctggcttttgttgtataagaaattgctatttacaaataaagatgtgcttgtggtttgtagtaatatgatgtgactgttttcttaattgtacttttagaatgcagctttagagacgtaggttgagtctgtctcaactatgttatttttgaggtttatagaatctgctagcatgtattcagagaccctgatcggttttctaaaccttaaaaatgaaagagaatgatggcagtggagatgaaaagtatttgtttagattatcccaggagagaaagttacttcagttagcaaaactagtgctgtatcattttgactcttcttggattaaaacaatggaaagtagaaaaattcagagaaaacatcttggtaatgacctttgctggaaatcaaaataatatggtccgtttattgctttacattatatttttaaagatacatacagcaaaccgagggcaataaatagaagaataactgtcttcctccccttgacccccgtcctgatttttctcttagtgatactctacaggccttgtctcaaactttggcttttcttcatttctctctgttcctgcctagaatgctttgtctggccctagcattccctattggtcatggaactttgctatgtgatagttaaaaatacttagaggaaattaaaccctatgtgataatgagtatttggctttgttaaatctcttaacctaccttccctctgttcccatctccaagtattttgtgatgggacttctaccttaactcaaaccgatggtaatggtagaaattttagaaactatgggaggctgttgagggataaatttctgagaagagttttgtggaatctctcagaaactatagataatgcgttgttgtgctttgtgtaaggttgcttttggccatagagaatgagctgtttttcaggtgtattgccagcttacgtacttcatgtagacagagtacacataggagaattctgaaagatgctaagatcatagaagcaagaagatgctagttaagtattattaagtaaataaggattccagccactagtatttctagctgggtgagactgataatactacttaaaaagaaaacaaatatgtcacattcgtagtaactgtcgtgtttagaccttgatgcaacagagtagtaaataatgtcatttatttgtggtgttccaggaagagcttgtgaatttattttactgacattttgttaccatcagttgagtttcatgtatctggttttcaatttgagtatagtgaaactttattaattcaatatcatgaatttaaatttattgtgaaaaaacaccagtgtttgttggctgaagtttacatcagcattggatgtgaagaaaggggtccgataaccaaaaagtataaacaacatagttccagcattgttaatataccaagagaacaaattcttttcaatacttagtgaacagtatgcaaattcatcctgttcgttacgagttaggttggtctatttattaacatttccttttgggactattataaagtgaatataacacaagtgcattgttgtaaaaacattcagtaaatttaatgattaatgcaacaattgagactgggattcaggggaattccagtgattctaaaatgccatcaattagaataatcaacattttgaagataatagtttttctgagaagtgtgggatagaacccttattttaaatggacagtttatcttaagacatccagttaaaataggaaaaaattaacatctagaatctaattaatgaggtttactctaagatttgtttaaaaatatgccttttaaaatctatttgtctctttgttttatttgtaattttagcgagatgaaatataattttgatagaccattcatttataacttttgtaattggcctctcatgcttttccttatctttttttgtgtcagctatgtgtaaatttgaaactaattatgacaccaaataaagaatccatttagggtgacctcattggaaaacagcatttttgcagatactcactctccttttagcaaatatggttaaattaccattttgaatacttctagaactatgaagaatggtggtgattcatgatatagaattttgataattactaaaaatcattttgtcaatttttttccagcaactttctgatgtagcagtctcttgatatacaagagggatatggtgagaccttgaacttcagctttctgtaattccactggtatatgttataacttcacaggctaactttctctatacataaaaggggagtaattgtatccactgtcaacttgtgaggaccgaaggataatcaaatgggaaatggggagtgtgtggttaacactttgtccactgcctggtaatggcgattcagtcactgctaacacagaattagaaatgacacgtgttatgtattttctggtcacctgagaatagtcagaaccattagcattgaaagccatgagtgccttgggtcaagagtagcttatgatgacatttatttttatagttaaagaagtggagacagaatagatagaatggttacaggtaagtgtaaacacattattttctttattaaagaggcttttcttgcttgaaaacatttttgaaaattgccactggccaggtgtggtggctcacacctataatcctagcactttgggatgctgaggtggaagcttgggcaacatagcaagaccatatctcttaaaaaaaaaaaaaagaaaaagaaaaaaagaaaatggccacttcttttggtatatttaagatatcttcacatttcatttcgcattttgttttactaaataattaactatgtaaaatagtttgattaggagaggaagctttttatatttctgtttttagcagacatcaaattctggtgataaatattataatttagtctgaccttggcctgaggtttataaagaaatactgttaaacattgctttctgttcaggtaaatatatacacagaaatagaatagtatactctcctgcaaaagaatgttatttactttcattttgaaggatgttgtcttaagcctgtttttctgaactccacttaatgacccacactgatgctctggtttgacaaacaaaatcttcagatttgatgattttgttaatttctagagcaggctcaggtgaaaatatcagccagtgattctgaggtgttgcattcctatttttaaagcagtcattaggtaggactgatgtaggcaatgaaataggatttcagtttgtaaattaagtctttagtactcttgacattttcagcattttaaaatcattttattttacaataattccatcttttatatgaatccatcaattatatttcatatgagaagtgaaataacaattgtgtattcctccatggttaggggttctgaataatggcttaaatcagatgggttatcaactttatgacctagcccagttgctggtatctcaaatccgttttaacaaatatgcactcgggtagtggaagctttagatattaaaaaaataaaagccctcactgacaaagtggcaataaattattaaaatgctatgtttttggaattcaggtagattctttttgagaccatcatagagaggaatagaactttgctgtcctttttgttttccttatccatgcttttgtctcacagcaaaatatactatgactctattttaaaaaatggtctacctgtctgtgaacttctgtctcttgcaactggaaattttgcttgtgtctgtctgcaaaagagggaaacaaatagatatcagggatttataaaagctatctcaatattatgacatactagtttacaatgtttgtcaatttcaggtacttttgacaactgtgaaaccggaagaatgatggttgatgttcaaagagagagttttatttatatggagctaaattaaaaaaattttcatcagctctaagattcttagacttagagtctttctgtggtgattttattgtcccagttttcctttctttggggaagaattagtagtagtttttatttaaaatgtccagttctttctatgtaatatcagaatgttttggaaattctagtatgtcagtgtctaaactatgtgtcttggttgctgcatatacttggaagttgcataaaattgttaatatttgtattcagagttttagtttggaaaaaatggtcattgtcttattggtccctagctcaatgccttgcttattaaatgcactgaataaattcttttgaatgagatggatattgtaaaattctcatgtgcctcctgaagccttctaaattgtttttattttgagtgtattatattaagttccatttgtaactggttctgtatggtgactggcgaattggagtgcttctttctccagcccaatcagggcatggagtatgagaaggaggcattaataaggttacacaattagaatgagagctgttctgttcggtcacttgaactcactttgtccctgctgaatgtaaaaggctaagttctattcaatttaatttatttgcttgaacctgacagctgtctttcagtttttattgtattcccctttaggctggtcaatttctgacaaatgagaaaaaatatgttaatcactgagtgtttgattattggatgatttgtgtattttagttattgtctagatttggacttgaagataaaatgacctggtaaatttcatgaaaaagaacaaattggaaaaaacctctttccctgtttacatctcaatatatcatttcctataatgcttctgtaatccagaaatgctgccttctccaacatgacctccttcccttctctggcccccaaaatgtcattggatgccatccagtggaaagatacatgggctatgaaaagttaagaaaaaggtggcactaacgctgctgtctccttagattctcacaagtgggctttgagccatccgttgacatttgtttttaaaacatcttgtaagttatgctgttttatcaagttaaattaaaagcaagatatattcttaaaaagatggaacctgagtcaggaattcaagtttgttttattttttgtttgctttttacaaaggaatttgattttaaaaaatgataaatctggcattgttggttcatgtatatttaatgctattaaagttacacacattcctgttctgctgggcctgattattgggataacaaatgttctcctgatcattcagttctcttctttcgagcttcagttcagaagttacctcctttgagacctgcatctcctgacaccttcacttagaataaaggaattgagcctcttccttctcacagaggacaccttgataagagcatgttgctgtgatgacttgtttccttgtctgcctctcctccccaggaggtggaaagtcctagagacagaagttctatctacttttgtgtctttagctctagcacagggcctgctgtagaataggcatttgatacatagttgttacaggaatgaaataacaaaggataagatggatttaaatttctaaattatggggttcctttatgttttgaaattttgtcaatcttaaatcgtgatcagtacacaaatgtctgatgagtcttgacttgtaagctccagtctttgtagaagtgtgttttcctgtgagtttttgaagtgctgtattttattaactggcattatatggattttgctcggtagccagcatgcagaagcataactggcagaagtggccttcccatagggagtgcttgacttttaatggattattgtcacaaggtgtataggttgatttcctcaaaggtgagtgatggtttctttctcaggaagacaggtgatgatactaaattgaggggagagccatttgacaagcatatgggaggcccatattagtcttcacaatgtgcaaattcaaatgaataaaaatgtataagattaggaattagaacagagattaaaacatactgtacaccccgataggtgataacttactgtgtatataccaataaaaaatcttcaggcccatcacgagtacaggctgctcatgagtcacctctcctgatggcatgtctgcatggtgagtgtttttagaaaagctcagtactggactccacaccaacagagtggcagtatagtgaggcacttgctcttagtcccatccttacagaagaccgctaaagctgcgctaccccagatgtggttgtatgacttctggttaaagaaagccagctgggcctttccaagctccattttatttttgttctgaatgaatatttccagtctctcacatgggccgggatatactttgtctcactaacacagaaatactttcatttcaaagagttgaagactaaggaaactatagtttcctacataaaatctcactgttagcttctgttgatttgcattcagcaaccaggagggaatctctgttgtcctcgcctctggtcagaattctccctgagtactctatctcgttccacgtgcccttccagaaacggatgtgttaaattttggagtatgttttacaaaacagtccccaagatgattaaaggactttaaataaattgtgacaggaagtgagagattattcagtctgaacaaaaaagggtgagtggtgatttaactagaggcttcaaatattagaaagtctctttctgtagtggatcatactcagaagttgttcatcaccccagtcaactaaagaagagaaaatatttagaagcatcagagaattaggtgatttttaaaaaaatttaaccagttaggggcatttaacattgggatggtttatgggaatcttctgaatggagagaatagatgattcttatttatttttgttgtaaatgtgaactttatgtgtgctgaagaatagtctaagcctaaaattatggcattttgaagctggaaggaaccatggaaatctaattttctgtctggctcagaaccctctatttgctggggagaaggattgggggatgtaggggagacctttgatctcttacacttgctcatgcctgaatttaggcctacaaatgagactcccagaattggaaggtacaccagaattctagcttaggctatctctaatgtggaactccctctccagcctctctgatggatagaatcccgcccctgcatgtacacatctagtgagaggcagctccctattccatatacctctcactccatcctggacaagtctgctttgaagaaatattttcttattcttgattacaatctgatgctttgaatatatattacttgttcttagcattgtcctacagaattccatagaataagtcttacctgtttgcctccagagagctcatttgctattaaaaacagctttctttttttttttttttcattttttttttaagacagtttcactctgttgcccaggctggagtgcagtggcacgatcttggctcactgcaacctccggctcctgaagttcaaacgattcttgtgcctcagtctccccagtaactgggactacaggcatgcgccaccatgcctggctaatttttttgtatttttagtagagatgggtttcactatgttggtcaagctggtcttgaactcctgacctcaagtgatccacctgccttggcctcccaaagtgctgggattacaggcgtgagccactgcggccggccagctttcttgttcttaagtcttctagctattcctcacccagcatgtttttgtttgctttttttttggaggtgggggacaaagttttgctcttgttgcccaggctggagcccagtggtgtgatcttggctcattgcaagctccgcctcctggattcaagccattcttccacctcagcctcccaagtagctgggactacaggcatttgccaccatgcctggctaatttttgtgtgtgtgtgtatttttagtagagatggggtttcaccatattgaccaggctggtcttgaactcctgacctcaggtgatccacccacctcggcctcccaaagtgctgggattacaagtgtgagccaccatgcccggccagtttctaggtcctcctccatcctaggagtctacctttaaatccaggtcagtctattggagtcccttgaaaatggagaagtgaacaaaggttgatcttgactgacttcttccatggaacctccagcatcttgtgctctcttccttggtactcttgcttgcccttctgtgtcctcatgccaacttggaactcagaagtctttcataggtgggcccagtttagcatcccgagataccctttgggagggtgaggattgccagtcatgatgctcttagttctcatgcctttcccattgaaattcccttgttattttttcccagaacttaggcagtttcaagttgtcaaacgcctaatctggtctataagtagaagtctgtaaaacctagatagcagacgcgttttaacagtgactttctaaaggcattgctctcacctttcatttataatacaggcaagtaataaagacaggatgaaagcatagcaccatgtggtgatagtggggctattgagagacaggccatgccccctttatttgcttttcaaatcatgccacaaagacagctagctcagcacctcacttgaccagagccaaacctgcctcttctgcttgctttcacttgtgcctaatctttgaagattgtctgctcctaacgccattgaatttggcaaatgtagtaaaattggttgtaatttgataactagtttcagtttcactgagatatgaaggagaccagtggcttccaactatggtgtcaacacagtgttgtgttaaactcagctgtgaggtattaacagctactgataacctaaagaagtttgcagatgacttattttaagatatctacgtataaacgagagtggatttacgttcaaccctaaaatgctactttcacttgcattctgacatgaagggatggagctgcaactgtcatggtgggcattttgtataaattgcagttgcttgatcttactgataagtctttaatcacagtggaaattacatatgtgtgtatttccctgaacatttttttttatagtggttcattagaatctggatttgtttatcctagtgtttcgtagaagtgaatgttatatcatgtatatctctggggggaagaaaggccgagacctgtcatgggagactgtgcctttgctagccagtctgtaaattgaataatcttgaaacatttaggtaggcacatttggggtgacttcaaagtgctttatgaagtcttctctcctcacacatctccagagactaccatacctgaaatttcatgattgtttaagataagaattgcttttttgatagatatttcagaagtaactgatatttaaaacataattaactgactaatttaaatttttttccttttgggtaatgttgaatctaggaaaaaaatcctgttattcaggagcctttttgagagttaactttcatgcttctttttaaatccatatcccatgcctctttgaaattgtcactcgggggttgggcgcggtggctcacacttgtaattccagcactttgggaggccgggtgggtggatctcctgcggtcaggagttttagaccagcctggccaacatggcaaaaaatcatttccactaaaaatataaaaattagctgtgcgtggtgtcatgcgcctgtaatcccagctacttgggaggctgaggcaagagaatcgcttgaacctgggaggtggaggttgcagtgagcagagatcacgacattgcactcaagcctgggcgacaagagtgaaactctgcctcaaaaaaaaaaaaagtgtcacttggttttctatatgtccttatttcccatatgatataatctcctgctcggtaagtagattatttggttgagtgtaaaatggctgttaaaaagatactgcttctacttattaagccatccatctacccatcctgctcacgtatgtgtcagacttttagtgcccactgcgtgtgtggctctgcactgtgttcttggggtctaacataatgtaggcaatctgaaggttactgtccagtgtgggaagcaaaaggaaatcacggtataagttttgctttctttaatagcagaaggggctacatcctactgtgggaatgcagaaaagggagtgataagctgccttcatagactgtgctttcattttttgcaaaagtaaatgtaatcaatatgaatttgtggaaagtgtagcatatattgccatgtgttatgactttgagcttattttaaaataaagatggatgcctgtttctgcctaacatgttagtcagtgttatcaaagacaagaggcagaccattcattcactcatttccaaaacactgaatgccattctgtgcctagcgctatacaagacatcggaaattcagtgtcaataagtctttgctttccaatcaacagggacgattttaattatagattgtcttcctattaagtatgaattttagcaggtattaaaattagtttgataatatgagaaaaaaatgaagattgaggccgggtgcagtggctcatgcctgtaatcccaatactttgggaggctgaggtgggaggacttgagcctaggaatttgagaccagcctggacatcatagtgagacctcatctctacaaaaaaaaaaaaaaaaaaaaaaaaaaaaaaaaaaaaaaactgggcatggtagtgcatgcctgtagtcccagctgctgctcaggaggctgaggtgggaggatcgcttgagcccaggaggttgaggctgcagtgagtcatgatcatgccgttacattccatcctgggtaacagtatgagactctgcctcaaaaaaaaaaaaaaaaaaagaaagaagatggcattatatttgaaattctgcagctattgtaactcatttgtgagcagggtatatgagatagaatcatagacttttgaaggtggaagagggctcagacgtaagctagttaagctgtctttcaaaaagaaaagatatttctgttagatggttaacaagccactcttcactctgcctccctccacatacttccagtgatggggagacagcatcacagtgtggaaagagcattggtttacagctagacaaaatctgtatttaaatcctctgtcctccatatgccaactgtgtgtccatgggcaagtcatgtaaccatcttgaacccatttttcttacagaaatttggaaacgatactaattttttaaggttgttgtaacgacgagaggaatattatgtaaaatgtctagccttagtgcctgcacagaaagtgttcccaatatatgttaggtattgtaattttgctgctggacagctcctttgaaagacatgctttttacttgtagaagtagtagtaattttcattaaagtaatacacttcctcacctcctatccactgtcaaatccgttgtacagtcatttggggggccctaccattccatggaggcaggttggcagtggctgtccaatggctggtttctgtgatatttgacaggtgtcaccttgtttttctcgaaaggttgtcctcattggctttcatgaatttcttcttttttgactttttgctatctcatcttgactgaatcctaaatgttgatgttccctcattcctttatacctttctctaggcagtctcatgtccttacacttacaggattgattaatgcctgtaggctgatcactggcacatctgtatttgaaacctagacttttctcttgagctgtctctcaaaccctatatacaacagttgctgtggatgggtatggtgaaaatacagttggatgtctgttctcctgtgtttcctatgcttggtgatgtcaccaccacccatcccagtcaattaaacatacctctcagttcaagtcttttaaatacttctaacctagtgctgcaggagcctcccaacatcagtgtctctgctttcaacctttttctcttgcatacacatatgttttgtcacattggcactaggattatttttctaaaacgaacacttgattatgccgatacctacttggtggttgatccctttttttactggtttgcaggaactctgtatattacggaatttgaccctatcacatgaattctgaaaatatttataatatagcatatgttacattgtactgaacttattttaagtctccaatttatttgaatataaatttttgggagctgagaacattttttatttatatgtgtattctgattgtttatctgtgtttggcatataataaaagttgattgagctgaaggacttaaaaacctgaagcacaccttccatgcttttcatttgctttacctctgcatggaacacttttaatctgtctctcctgtgtgaaacttctctgaaacccttaccagctgtctgtgctgctacttgtctgttgtacgcacgatggatcacaaatgttggcaacattttttcttcattaactgagaaatctctgaggggcagggtcttatccagttgatctctccagtgcttagtgcaatgcctggcacattattcttcatttgtttttttacaacaaaaaaattgactggggaagatatttctgtttattatacaagaataatgaagcaaagtacttcctgtcctcccttctattctaaaaattttaatgacattaatatccatgccttgcatgtatattacctcattttaagtaccttatgcaaagtttcctagtgagtaagtggtagatcaggtatttggactccaagtcgtgactcagatcctgggcttttaccaccataacactaacttcagggcaagatgaggccaaatatattagatggtgtcagtgaattgatagaaaatacttgttattagggatttctttttatataaaatatcattgctcctggaaatcattttggctgaacatctgtggcattttctgtgggagaaaaatctaatacttttcgtggggcagatatttttgtcttctttgtagaaatatgtagttgaggcccacaacaatgggactggaccataaattatgcttttcttggcattattgaccttattatggtgttataacacaaacgatccaaaacataaaaagaagtaccaactatgagatccataaaaaagtcattttaattggaccttaagtttttcccctaggttaaggctatgaaaaaaaagtgtagtgctagttattgtacactgttagcctttttttgtagacgttgcctttttatacaggcatattttagagatattgtggctttatacaggcatattttggagatattgtcggtttggagatattccagactgccacaatagagcgaatatcacaggaaagctagtcacacaaattttttggtttcacaatgcatgttaaagttatgtttacactatactgtagtctgttaagtgtgcaatagcattatgtttaaaaaagcaatgtacatacttcacttaaaaaatacataaccgttgtgctaatgatcatctgaactgtcagtgtcttggggtggctgttgctttatcagctaaatgtatgtagtattggaaatcctttgagttgcttctcaaggatgagcaaagaaagtagattttttagattctaaagaaactatcttctttgctcatccttgagaagcaactccttatccattaaaattttatcatgggattgcaccaagtcagtcctatcttcaggattcacttttaattctagttctcttgatatttctaccacatatgcagttactccctcctctgaaggcttaaattccttaaagtcagtttatttcaaactcttgttaatgtggatattttgacctctttcattaatcatgaatgtgcttaatggcatctagaatggtgaatcctttccagaaggttttcaatgtactttgtccacatctgttagaggaatcactatgtatggcagtgacagtcttatgagatatatttcttaaatagtacaatttgaaagtttaaattactccttgatccatggactgcagaatgggtgctgtgtacaagatcagagctcttggatgactaggtgcattgcaaagagcagtaatattttgaaaggattttttttttttccctgagcagtaaatctcaatctcagccaagagcttaaaatattcagcaaacaataacaatgctgtaaacagatgtgctgttatccaggctttgttgttccacttacggagcacaggcagagtagatttagcataattcttaagggctttaggattttcagaatggtaaatgagcatgggcctcaacttaagttaccagctgcattaacccctaaaaagagagtcagcctgtcctttgaaatttgaagccaagagttcacttcccctctctagctgtgaaagtcctaggcagcatcttcttccaatagaaggctgtttcatccctattgaaaatttgttattgagtgtagccgccttcattaatgatcttaagcaaggtctcctggataacttgctgtagcttctacattaaaatttgctgcttcactttgcatttttatgttgtggagatggctttttgccttaaatgtcatgaaccaacttctgctaatttccaactttttctctgcagcttcctcacctctctcagccttcatggaattgaagagagttagggtcttggctgctgattaggtgttggcttaagagaattttgtgattggtttgatctatccagaccacaaaaacttttcttatattggcattaggctctttagctttcttatcatttgtgtgttcactaggtagcacctttaatttctttgaagaacttttcctttgcattcacaacttggatgtttggcgcaagaggcctagctttgggcctgtctccacttttgatatgccttgcatgataaacttaatcatttctaccttttgatttaaagtgaaacatgtgcaacttttcacttgaacagttagagaccattttagggttattaataagcctcattttcaatattattttgtctcagggagtagggaggcccaaggagagacagagagagatgggtaaatgactggtcagcacagcagtcagagtacacacatttatttgttaaatttgttgtcttatatcggtgtgacatgaggtgctttaaaacaattacaatagtaacatacaaaaccatggatcacagattaccataacatacaataataatgaaaaagtttgaaatattgtgagaattaccaaaatgtcacaagagacacaaagtgagcacatgctgatggaaaaatggcaccgctagacttgcttgtgacagaattgctataaatcttcaatttgtaaaaaatgtaatacctgcaaagtgcagtgaggcaaaacacaataagtgaggtatgcctgtattcattttcatatttttgttgctgaagcaaataaaggaagccacacatagctaaagtgaaagccacttcaaggagacgtcacatgaaacattttgaggagggagttatgtggtttcattgtaacattttagatgcaaatgtgaattgttttgagatcagaatttttcatttactacttttaactattcttgtactatgatgaatgtttagggttagcctagttatacaattcttaaattgtttgaaagaaaagatggtgattgagaattttagtgcttctcctgaggcaggtgattggagacagttgtttgttcttgtgattcataaacgcattttgaatccaactgaaccttgtttgattcactttgagaaattctgtggttgaggtagttgcaggtcataggtttaggtgtaagagaagatttaacaccctgccctgatttcctgggtctgtaaattcggggagctccaatttcacacggaggcctcttaccatctcttgcttcatggtgaatacctctgcatgtgggaaaatttcttcctgctggaatcagcttaggttcatattttctttttcttctttttttccctggtgatatttttgtggaccctgaacttcaaatatattttttttggttgttgtttatgaaaggtgtccagtaccatgtagatgaaaaatttgagtaacgttcatacaactagagtgttttgttgacagttctcattttgttaatatatatttattgaaatgtaagggttttcatggcctgaaaaaacaaaatatgcattacaactttcctgctgtgtgtgtttatttcagttctgaagctagcctgaaataacctctactttataaggaaattgatgctgagttgtcattatgcccaacatttataatacatatacagctaatttgaatgttataagtatagaaaaaatatcaggtaagtctgtattcaaataggaatatcaaagtaaaataaccagtgattaaacattccagtggtagtacatgggaaccaagtgagaaaatatgtaagaaacatgcttggattttttgtttgtcttttttttttttctcccacaaatgtggatttaatttgtgtcttatgagtgaaattttaaagtagaagattatgagagctcttcttttgggaattcccctagtaaatacagcttctaagttcactgtttttgttcttccttgagctaatgagagaggttaacatatttgtagtagattccaggttttagaattttttcttatggaagagaggcaaactggaatcccattcagtcacaatatttggttcagtcacaatatttgattagacttcaattgtcttggacagaagtaagactgttctccatattcttaaaaaatggaaatgtgcgtaaattattttctgtacattcactattttaaataattatttccctttcactcttatgctgagctgtatattgtgaccacatggatgaaagtctacctcttttcttcttcacaaggtttccgacagtgagattttgtgagtgatttggtttatttcaagaatggtggaattatcacaataatgtatattttaaaatgcttttgtagttatgcctcagaataggcagatagatactgcctattcatatttgaacttctgtcctgtgaagagctagccccagaagggatcttttgcttttgattatttagcctatatttaagaggtttcttttctcttgaattgttatccccagctacttgttcagagatgtttgtaaatgaagggagtgagtgggaggaaaagcttatgttacttgtagaccagagaatagtatagcagctagaagtggtgtttgtctgtaggctacccttagttgatttgtgttgtcatgcaagaaacattttgatgcatttatttcaggacacggcattttggagacttcattaaatgctacctgttgctgtttgtgatggaatctagtctagaatgttaagaggcagtagaaaaagctgaaatggcaagaagatggcactcttcagtctttaagattcacctgtttgcattttagaaacacattaccattctttttgcttctcttaaaattggagctatttggattaaaattaaatttatcattatgatgtgacctacttggtgtcagttatttttactgtttcttttaatccctaaggtaatcctgtgaggaggttaatatggaaatctgttctgaagtctgtgaatcaaagatgctaaataattttctcatgatcagagagctagtaagtgatcaagctggaattgaaaaacagaacatttaaaaattattttgaaaaaatgtcagatatatgtaggagttaggaggacagttaacccacatatacctatcccatagattacttatggagattttattacatttcctttattccctccttccttttttggagacagagtctcactctgtcgcccatgctggcgtgcattggtgcagtctcggctcactgcaacctctgcctcctcggttcaagtaattctgcttcagccttctgagtagctgggactacaggcacatgcgaccccacctggctaatgtttttatttttattagagatagggttttgccatgttggtcaggctggtctcgaactcctgacctcaagtgatccgcctaacctcagccccccaaagtgctaggattactcttcttttttctttgccaaagtattttaaagccgatcccagacatcatgttaatgaatgcgcacattttaactgtgaggctagtgtttagaattctgtacctgatggcctaaggtataaaagagcatgacacaatatgaagactgtgagcagtagaagccatattttttctacaacataagttatatatctgcattgagttttcttgatatggttagccgtcatttgccactcatttgttaaaaaaagatcaatgcaataactaatatttattgagtactgactctgggttaggaacagtccctcatattttatgcatattaactcatttagttaacagtagccctgtgttctgtaatcatttattgtgggttccagttgcttgttgaaaacagttacctcttttacataaaaatgaaatattccacattgctttgacttgtggtatcttttccattccttacctttagtaattatgatttgttaaggaatgtatagaacagtgctactcaaaagtgtggtccacataacagtagcatcagcattgcctggaagcatggtagaaatacagaatttcaggccctaccttttgaatcagaatctgcattttaaattaggtctttaggtgatttatatgtatattaaagtttgagaaggtttgggttgcatttaaacagccttgcaagcatggtcacacattacaatcacttggaaaacttttaaagctaccaatgcccagcactgtccctgaacaattaaattagactatctaggtaagcctccagcatctttttcctttcctccccctttaaaaaaaattagattctctaaatgagaccttagtattgttattgttgtttttcaagcatcccaagtgattcttaagtttggccatgctttaacatgcactagttttataggagtagagtatctttgtgttctgttccagcttcttaacactgaagagaacatttcaacttgtaaatcatatattgaaaatgatgccaaatgagagtcaaagatggaagaaattccgggcttatacttagtcttgtgtcggtaattggctcctgatggcataaaaaataatttccttttttgcaagactgaacttcttcattgttcttacctcacttggcagtagggaatgaaagtgcccccaaagtttattgtcttttttttttttgttgttccattctttccttcaagtgaagagttacactgagggaggcagggagatatggaataccaaatggacaaaaactggaccaagaattgttaaataaattcgcatcattacactggataggattctaagtattttaattttttttaaatgttcttctgtttgtgcatggctgcttgattttctttaagttagtgaatttagttccaggcacatactttgttcgtttagctgcatttagtgagtactcagtaaaagcagtcaaaagaatgaaatagcaaaagggaactggaacagtggggagaaatggagtttctatgtgctccttacctttagttgcatatggtggagtggtctggagccagactacctgcattgaatcctggctctgctgcttatttgccctgttgccatggtcaagttaattatgtgcctctgtttcgtttccttccctccctcccttccctcctttccttccttccttccttccttccttccttccttccttccttccttccttccttccttccttccttcctccctcccttccttcccttccttcccttcctttcttttcttttctttctttcttttgtctcactctgtcacccaggctggagtgcagtggtgcgatctcactgcaacctctgcctcccaggttcaagtgattcttgtgcctcagccttctgagtagctgggattacaagtgtgtgccaccactcctggctaatttttgtgttgttagtagagaccaggtttcaccatgttggccagcctggctgatcttgaactcctgacctcaagtgatctgcctgccttggcctcccaaagtgctgggaggcatgagccaccatgcccggccttgtgcctccattttcttgtcattaaaacacggtaatagcagctacctatagagttgttatggggattaaatgaattaatatatgcatacagtagttagaaggttagacacatactaagtgctatataagtatttgctgatataattactgttattaaatatttccctacctcaaagagaaagggtggcttatatatgaaagcatagactcttaacctaatggtttcaacatctgagagattatttaggttaaaataggatttttgatcagggaaattggattcctgatttgagcagggatagaaggcattcagaaatatattctgacgccatttactcctcattacattgggaagtgggttaatcagtccatccttgactgaagagggagcaagtaacactcatcacacgtacacagttaaccttagcttgttgaagtatttcagattccttccataagagtcgctgaataaatccaaattttagtctttaaaataattgccttccccaaagccctatagtagcacagttgagtattttaaaaacaattcattagattagtagcattttatagtttcgctctatttgaggaacacctacaggtgttcagttcaggcatggaggaaatggggcaggcaagttagagggcaagcaagggaggaatggagcaataggaatactagaactgtcaaatgtgggcccttcaagggaccctaaagactacatgttagcccagtgcatttatttcccagaagatgaaatggctgaagtgtgaagattttagtgctctaatgagaaatacatgctctatttttacttattttaatgctgttctcattaattaaatacattgatacatatatacacacatatatatgctgagtgtagcaaaaaacagcaacagtaaatattattctacagtaagatatttttgtgtctatttttatgtctcttcaaaattgtgatattaactaaatattacctttttttcacagttgtcttagttcattcaggctactataacaaaaataccgtaagctggatggcttgtaaacaaaaatttatttctcatagttcctgaggatgcaaaggctgcatctttagatcaagatgtaagtagaggccaagtgcagttggctcacgtctttaatcccagctctttgggaggctgggtcggacggatcacctgaggtcaggagttcgagaccagcctggccagcatggtgaaacccggtctcttctaaaaatacaaaaattagccgggtgtttagtgcacatctgtaatcccagctacttgggaggctgaggcacgagaatcgcttgaacccgggaggcagaggttgtagtgagctgagattgcaccattgcactccagcctgggtgacagagtgggactctggtctcaaaaaaaaaaaaaaaaaaagatgtcagtagatttagtggtgtttggtgagagcctactttctagctgtgttttaagggcacttcctaatctcgttcatgagtgtctggcctcatgacctaatcataccccaaaggctgtatctcttaatgccatcattttccaagatgatggttaggatttcaccatatgaattttgtggagacataacatttagaccagagcggtagtgattttcatgcattttcgaatagactgtgctatctattttttatgggtaagattaggcatgtttttgttggcatagaaaaaattgctatgtgaagagagtgactgttatttctctaacatttaaccagaaagcctaaatatgttcaaaagagctcatttgacaagggttctggggcagaagtgttaaaggacaaatgaaacaaggatttcttattcttaattggagttgagggaaagggccaaccttctgtagggaaaatgactataaatggtctttgcagtgaagacatcctctgttgcaacagccacctttttggtcggcttgtttttcctctttcttcacagagtactgctattaaaaacacctttctcttggcacttgcactctaccatttgactcttcagatttttcttgtttctgcataaaattttattgctcttagttttgaacctttgtgcagccgtagtaccaagctctttgcctttttcttcatttgttattcccatcttggaggcttattcactggtactcggtatgcctggaagggttcccttgttttatgccagatgacaacaacaagtgaatcctgctccctagtccttttatagatagcttttgggggaagaaaatttaaaggaaaaaataaaaacaaaaattttattgtcattaccgaagatggaatgacattcattctcatctgatagactttttggtctctgctaatattttttaagccttgagggcaaggattgcttttcattgttttagtgatgtaatattgcatgctgcagtaacacccaacactgaaatgctcttttctttgtttcttcaaatatatgtggtttctgaactatatctgtttttttaaataatgtagttctgtaagtcggctataccagaggacttctgtttctactttttattttgggttaatttatataaaatatatgtgtatggacatgtttacctctgtagatctatccttgagtttgtttataagcattatatctataaaatgtaggtgagaaaatggaatcacagttttcgatctcacagatcactggtggacatagaagcacaaatcatgtcttttgatagaaaatagcttaaatcctgccaaaaatactttgtcttgtaagtgaaagtgcaagggttagatttgactttaagcacatacacaaacatcaatgtttttcttgtctttacctctctgtgatgctttcctcttaggtggcttcactgccctgtagtcatttttttatgctggagcaacaatacccatcttgtagatccggatttaacctggatctcagaataatacctgagatcttttcacaaagatctcagaataagcctgacatggtatccatcagaatcatataatctctcccgaagattctgaacggatcatatgcctactcctggatcaggcaatgtgtccaggtttgttaggccagcctgtttgccagctaatgacagcttaattatacattgaaacattgcttgtttaactcaagtttggaatgaaggaatagctgtatgtcatgttttaggcaaggtttttagccagaagcattgtttctttctatatgaaggttatttctttctaagaaacatgaccaatcacctggaatccaagcccctccgccctccactggaggaaacattgacatattgtctgtgtatgtgtgtgtgtgtgtgtgtatacacacacacacacacatacatacatacatacatacatatgagtggttttgtgtatgtgtgtgtaccattcaagctatgccatagctatgctgatccattttgaaaaatcttcctttagtacataatactgttttagtaacaatgcaagtaaacaattaattttaattgattacattttatgttagttgtttttgggcagcttatagggaatgcctccctaatgctaatgcctaatctcaaatataaacttaaaatcacagttttgaataggctacttcttgaaataaaaaaaaaattcactacagattctgtgtgtgtgtgtgtgagtacatgtacacgcgtgtgcatgtgtgaattcttagttgtttctataagatagaataatattacctgatactgttttgtttttagagttgatgatccttgttaatattttggcttgttgtccctctattcactgactcgtatggaaattggggattgggtagaagaaattcaggtatacacaatatcttatatagtcttcaaaattatcctagaaagctggtgctatctttgagatgaaattcaggtataaggctacatgtacatgacgtagtctgcttaataatatatgataccacaaagccaattgtacttaagagtttttgctgggtcttctttatcactcttagtatgctatttattttgtatttaaaataggtttcttgatataagtttatcccttggatatttaaacagttttcatcaattgataccattatacttctgttctaaaacatcttctaaatatccctgaataaattcttacctcaattttttaactgatttgtgagatttctttttctccattaacctgattcttattgaaaggaatgaactgctattatggaagtactgccaatttcatatcatctaatctgcccatttgaaattgatgatttagtcgtaaaggagtatttttagtttgctttaattaagtagcatggcttgtaatgtgaaagttttgggtactcttgaataacattagattacagaatttatagttctaaaaatttatttaaattattgaatcctaaacatatgcttaagaatgtgagtgaacctttaattggacacttccactaatttgtagcctttccatggaaacatgccacaaatcaataggttaaaataaaacttagtcactttgtaaatagtatagtaagagtttttaaaagtaataatgccgtttaactttcattcttttttgggtatacattactgaatgaataaactctctgttcttcctttttaaagccaggctttttttttttttttcaatatggtataactcagaattcttcacgtttaagagcccagtaaattttaataaattttctaagtggctgcctgcttttaaaataatatttgtcttcattatgttctcattcattgctaatttaatttttaaaaataactttagttgagagattgcttgtccagcagaaatggagctatcctacattgagaagagcaaacctgtgtagaagaatttaagaatatagagagtttgaaagaagtgggaatctccaagctatcattgcacgtttcttagattctagatccttttgtgcaaagttaaatatgagtggtaatgtgtaatgggcagaactttgagctattagaattctcttgatagcgagtttaatgttcatattgaaaacagaatgctgactatcaagttagactcaagcataaggttttggaccccaactttaagaacctatgaaacctgaatctcttccttaggtacaaatgaaaactttaatgactcttattggaagccattgattatatttttgttcttagtatctactgcatacttttatgcttgtactatatactggatatacaaacagagcagttaccacaataccacacagatacacaattctaacaatataatttaatacttcatgattcataagttaatgtattatttgttaggtggtaagtatgatgcctatcaatttggctgaaatctaagcacatcattaatgaagcctagtttgcttaccacttctgtgatttctttataaaatatttcattattcaaggaaaaatacacgtttctttgtgtttcctttcatgggaaagtcatttttactttctaaaaggaatttaatagctgaagttccttttaagtatgctatgaactcagtttaaaaggaataatttaattggcactggggttttctgagtctaggccttttatgaacagatgttagtagattatttcagtagtgaactttttttatatcattctgtggtttaaattttttctgaatatttcttaaaaatacaactccagtgttcaaaagcatgcatgtgaacatgctatcattttgagtgggcaatttatattaccaaattgttttgatacgttgtttactacactacaactattttttaagagaagtgagaaataataatagacaatatttgttgagtgattacatttatctggtactatctcaacctacttttcacataataattttttaaataccgagggcaactccaagaggtagatattgttgtttttccagtttacagaagaagggacttgagtcacagtgcgcagcttgcccatgattgcacagttggtaagtggtgatactaggatgtcaaccagtgaccatcggtttcagagcccactgtttaaccattaaacaatgtgcttctcaaaagactgaaagattgttgagactttcatcaagtggatcaagtagaccaagtccacaaaagtccagtttattaaatagtgttctctgattttgaaaaaagtggaaaaatagtattgtcagtagccgagtagtttttggtatgacaagtaatattgttacagcaaatatgttttgatatgacattatttctgtgtttaatttcgagcctcttaatcatgatctttggaaatctgtgtaaatttaaagaatgataaaatatactaaaacacatagaatacaaccagataaagaatttttagatactgggaatgtttagtcttgcattaaagattatggggagataaggaacttcgtttatttttacaagtatgtaaaatggaaggaaacattttgctgtcttgattatatgaatagattgaattattagaaattgtatcactttactattggagaaatttagggcagtgtgtgtgagtgtgtgtgtgtgtgtgtgtgtgtgtgtgtgtgttgggagtaccgagttaaggggcctccaagaccatgttgaagggatgacacaaatggtctggttttcttttgctgtggactgcttgtctggctttgtctagctgaatgcagccagatagattgtggaaaatgatgtgggaagccgggaaggtttttgagagaggagatagataggagagtgaagtggggaggtaaatgccatagggaatggaatattggggaaaaatacttatagaaaattttaagtatgtttactctgtgtatgtgaaatgactccttcctctatcttcccaagaagattttgtaagaaatgtactttcttcattagtgcttttgaagtcatgttcatgtttttctcaaatgctttactataagactgacttccagaagaaaagactgacttataagtgaaagcacagccaagaaggccctcttactacattcaacttacagatgtaccaattatctgatagtgttttaaaatactaacttagcaataacacattggaggatagttgtagatctctataaatagttggacctagctattcaggcaactctcagatttgattgcttatcaatatttgcattttcttctggattctctatttggctatttgttcataacttttggatataagaataattttagatgataaatatccctttaaacttagtggcacttctactggcagaacttagctttacctaaaccaactccctgtattctaaccttgggaaaacattagtatttataaaacaaatcccacccgagtttgtctgacagaaacagtaattctttataatgtaaatgttgaaaatagtttcctaaaatgtaaaaccacatttacttatttgattgcttataatgagatgattccaatggggtattatagcctccctaagaaataactctggatatgtcaacttcaattatctttgatttgcttgaaaaatttgattatattatgaataaattggagaatatatgcaaattcctgtggcaagttcatctagttgcctccaaatactcatttttaccttatgttttagtaataacacaactctgatttttagctcaacacattgccacccagccagaaaaacctacattttgtagattcctttgtagtcacgtgagtctgtgtgataagttcttttcctgggcagatgttgaagtgctgaatgttacttttgagatgtatccttaaatgtttcttaccctgcttcctagaacatagaattgatggctggagctctggcagccattttagaccttgaggataagattcatactaggcaagcaaccagccttattttgttgttttgctttgttttaggttttcagcagtccgaaaccatggtttttagtttatgtttctagtgatgagcagaaaagggggtgaggaaggggctgtactggcccaaccagaaaccaaaactacgaacccatgactgtattctgttcctgggacatgcctgcatggagtagtccaaatccttgatgactttgtggaattgccaaactataggctagattacccactttgacttaatttctgtgagcgggaactgagcttctatcttatttaagtcattgttattttgggtttgtcatatacagctgaattaaattctagcagataccattctcagtgaataggacctttcttgtatactttattggctttattcttttgggcatatttctgcgtcttgaatgagagattctgattcccacatgtcaatgtcagtgaataatgagaaacagcaaaatatgcatgggggaaagagcatgaatctgactttgaattttactgattatgtgatcttgggcaagttattttaccttattgagcctcagtttacttttttataaaactggggttgtactgtgtcttagttcatttgggttgctctaacaaaatgccttagattagatggtttataaacaacaacagtttatctctcacagttctggaggctgggaagtcagggtgccagcatgggcagattctgatgagagcctatttccttcatagatgtgtgtcttttcattgtaacttcacatggtggaaggagtaaacaagatgccttgggcctcttttttaaagacgtgaatcccatgtaggaggactcagccctcatgactcaatcatgtcccaaaggccccatctcttaatacgatcagattgagtattaagtttcaacatgtgaattttggggggagcacaaatatccagatgttaagatttctgtaagtaggactgttgtatttaatgaaaaaattataaaaccaagagctgttgttttgaatcatgttttgaaaaaatacaaatgaaatatgttgttcttctgcgaagtgatttttataaaagaagaaattaagaagcagttacccttataatgaaggaaggtagccattcagataatttgaagaaacagaagaatttttatactttgtttccatttttctttctctagttcaattgaaaaaaatgtcaaaaatatctcatagggattacttttattttcttagaaatatattggtagatatttttcattaaattatttaagatcagatggagtgagaggtattgccattatttatagtttttacagcagagcaacaagtaagagttaccattttgaaaattaaatctttttttttttttttttttttttggttttgagatggagtcttgctctgtcacccaggctggagtgcagtggcgcgatctctgctcactgcaagctccgcctcccaggttcatgccattctcctgcctcagcctccggagtagctgggactacaggtgcccgccaccatgcccagctaatttttttgtattttagtagagacggggtttcaccatgttagccaggatggtcttgatctcctgacctcatgatccgcctgcctcggcctgaaaattaaattttttggtaacttgattagtaacatcttaattgaaatttgataatttagaagcccatctgccgaacttactccttaaaattaacatatgttgaaatatctacactaatgttgtcagtacaagtgttggatagtgtatcgcaaacatatttttgcaaatttctgattccttttagtttctggattgcctcccagttttaaacatagggtaggtgatgaaattgttgggcatcaaatgcatttgaaagttgcaaatgcgttctattttcttttaaaattatttgacagactctcattagtgtttgttttacaataacaattgtatcttctagtgtttgcccctcaagtgaagttctccttagaagagaagatcttttgggatcagttccccccattttcttatatgttcactaatcagctggggttaacatttaattattcctcatattcacaaccacttaaacatttaatagagtttttaaaaatccaaacaatgtgtatcttgtataattttattttcatttaaaattctattaccaaaaaagccaggttagccatttgcttataataaatcatgccttcttttaggaatttttagagtcagtttaatgggactcctgagttgacagctgtgcagtctgaattgccttagactctgaaaatgcttcagatttaaaatactaccaaccaacatggagtactgatcttcccacttgttgccaaagaggctagttaggaaaactagggacaggctgttctcttgcaattcaaaactgaacataaactgaaattgagagaaagtcatattaaatcctcatgtctgccatgtttgcagaggtcagctatacaaatatgaatgttaatttgaacttcaagaaaaggacactgctaaaatataatacatcttgaaaatgaagatgactctctacttgttttaatcagaacctcactgatatgtctcagggattaatttcatatatcatatccttaggctgagtgtgttggctcacacctctaatcctagcactttgggatgctgaggtaggagaattgtttcaggacaggagtttcagaccagcctggtcaacatggtgagctctcatctcaaaaagaaaaagaaaaaaagacccttcaagaactcagttttgtggtattaaaaactgagagagagatgtttataataaaaaaaaatacagtcctacccataggatctttagtaataagtaaggacagagcttcaagaaaattgaagtgtttgagaggtataaagtaaagggtttggttaacttggaagaagggaaggaaagaagaaataagattttgtacatttattagaatgctcttctcagtaacttgtattttattgtgcattttaaagtgctttttatgtattttttgccttctgtagccagaatgttgatatgtcaaagatgctggttttgcctgcaaccactttttaatgtctctgatgatgtatctggtgcagtgcttaggagaaagcacttatgcttacttttgtgttttgactgtcttttatacattttatttgcttgctgtttgtcacttattgtattaatctatacattttcttttaaaaaattaataattaaagattatttgaagtttcttcagtaaatggttatacagcttaattttttcagaccacattttactaaaggaggaacttttttttaatttttaaatttttcacataagtctgaacatttgaaaaatgaacggccattcagccagtctgacaataaagataatttgtgaatgttctgtaagaatgtaaaaagatgattctaggtattttatttatttttatttatttgctttttattcttaggtaaaaactcttctcccagtgaattcttttattatttaataaaaaataatgtttaataagttccagctttctatatatgtcttatgttacataatttaagttataatttatatacagacagttttcaacttaagagtcttttgactttatgatgattttattgcgatgtaatgtcattgtaagtagaggaacatctgtacttacaatgaaaatgaaattgaatatattttaatgatccattttatataattgcaatgtatgcattatataatacatatatgcatgtatatttactttattattcagtttaatcaaaagtatatgtaatctctttatatttattgactcctgattgtctttttcaactgcttataattaaatgaaatgtctgtgtaagccacatagaaaagtgcttggcaaagagtaggcattcattaaatgtcaactattatcattagtttagtttttaaatgatacatagtgatacaaagtagtagatattagagagttcagcctggataacttacaaattgattgtatgtgtgtcttcataactaccttgagtggaaagagataaaaaaaaggtaataaattggatggcttggacaaggttgtatgttcagaacctgagctttaccagcagaaaaattgcagcatcatactgagcgatggtatcatttttttggtatcatttttgtatccttctatcccccaggctgaagtgcagtggcacgatctcagatcactgcaacttccacctcctgggttcaagctattctcctgcctgagcctcccgagtagctgagattacagacacacgccaccatgcctggctaattattttacttttgctagagacaggttttcgccgtgttggccaggctggtcttgaactcctgacctcaagtgatctgcccactttggcctcccaaagtgttggaatcacaagcataagccactgtgcctggccaagaggtggtatcttaatgtttagtattgccttacaatatagagaggcagcatggcttaggggccagaacacctaacaaatagctacagacttcaggtaacttattcagttttcatgatttttaaatatctccttagataaatagggataatactatcaagctgatagggctggttgtaaagattaaatgagataatgtaaagaataaagcacagtgccttgtcacatactaggcaccaaacaaattttaattctcttcctcctaaaacagagaagagaaaaatgataggagtgtaagagaagaggaaaattaaataagtggcattgtgtttacataacttttaaaaaacataaattgatctcttggagtttaagttatacttggatttgcaagctaataagaaaccctgaagtgaaggattcttcactatttcttttctgtgaattattaacgtaagttagaattgtctaatttttgatttttaagttagtctccttccataaagcttatttattttttgcttcaaaaatgtgttaatatttttcaccattccattcaatattaattacattttgtactctttaggatgatgactttgaagttgtttgctgctttcattttaagtacattcatttaggtgaattgccaagtacatttatagtttttatttaatttgaataagatcctttgctcaaaaatgtttgtgctttcattgtattgaattttgttgtgtattttattctcaagaaattttttggatttcagtagtttcacttttcaaaattaaacaaatttttaattttacttaattctgttgttatttcttcagagtgtttctctctgtcacttaggctggagtgcagtggcgtgatcatggctcattgtattcactaactcctgggctgaagtgatcctcccacctcagcctcttgagtagctagaactatgggtgacaccactcctgggagattttttatttttgtagagatgggtctcactatgtttcccagactggtcttgaacttctgtcctcaagtgatccttccacttgggcctcccaaagtgatgagattataggccttttttcttttaaaatgtagtttatataatttactatttctgttctttgcaagatacaagtatcactctttttgaaaacccttgaggtcttgtgtgattacattaataatatctgtgagtcaagttgatcaatattaagatagaacataaccatcattattattggttactgagaattcgtggtatttcgatttaagccttagttttatagcattgtgttaattatgagaaattcattttaaaaaccttggcagtgaaaggtagaaaaacaggaagttaattatgggaagcttttctttttactaacaaacacaacaatcagtagtactacagctgaagagagtacaactggtatattttagttaaacgaaagtagattttagataccatgataattgattgggttttctctttatttacacactgatcttttcatttgaaatactgtctcaagctttctaggacacggaatacagaattaaaatgttgaatcaatcataacgtgtcgttgataaatacgtactttctttttaaaataggggaatgtgtagcacactatttttctacaatattttttgttattaagttgtataagaatatcctatagaaacattccattgtatcacacgttagagaacagtgtctctcttggttaattctgactgcttgaccattcttagggagactgcaacaagaatcaaccaacacaacatgtggatatcttttttaaaaaaacgtataattggaattttcacagggccctacatggcagatatatatttttctgtttagctgctttattttcaggcagaacagcacatctttctttatagtgttccaattgtccatgtttaagaatgttttccctgagtcctagaacaagatgagtttatggaactgtgcagtgccacctccccaccctctaccaccccccacccgctttgctttttagtttcaagtgtttatatgaaacctacatcacaacataactgctttagaagcctggctgccacctcttctgaaagattatgtttcttatagtctcttatttatggattattatcaagtagaaagctttgtcattttataatatccccaggaataaagccccttgtaactggaagcaacaggaagtaccaagataatacctgatgtgtagtatcgttttgtttcctttctgttccatagatgacaaaggccttgctatcaaagtacagaaaagggatgacagaggaaggtggggctggggttgggaaggtttattattattatgattattattattgtttttgagacagggtctgctccttcaccctggttggagtgcagtggtgcaatcatggctcactgtagcctcaatagcctaggcttaagtgattcttctgcctcagcctcgcaagtagctaagaccacagacgcacaccaccatgccaggctaagttttgtatttttttgtagagacggagtttccctgtgttgcccatgcgccacaatgcccgaccaggaggtctttgtagaaaactctggattcctttttctgggaagtatcttcctcttgctaatggaaaaatgtttaatcttatgtatataaaatttcacattgcagaaagtatgttttacttgaattatgaaattttttgtgactacaaaataaatgaattttggctaacactttattaaaaataattatgggccaggtgtggtggttcacacctgcactcccagtgctttgagagtgagaggacctcttgaggccaggagttagaaacatagcaagaccctgtctctgcaaaaagttaaaaagttagctgggtatggtggtgggtgcctgtaatcccagctacttgggaggctgaagctgcaagatcacttgagcccaggagttggaggctgcagagagctatgatcatgccactgcactgtagcctgggtgacagagaccttgtctgtgaaaaaaaaatctgaaatattacatgtaaggggattttgtgaacattctatatgctaggtattgtgataaaactgtaaccaagtatattgtatatagtatggaatgatagtaataccaatatctttcatagagaagtttctcctttccagttttaaaatttaggattactttgggtcaggtctattcatctttgaagaaaataattttttaaaattccattgtataacatgaagatttttgtatgtgaaaaatacattaaaatcttgataaataagttttaattttacatttcaggccagacatttgttgtatgaatctatgagagcacatacaggattccttgtcatatgtggacatgagtcattataaagtgtactgttaaattgtttggaggcacacccaatagatgaaaaggctaaaaaatgtaatatgtaattatgaaattctcccttgactgcttagtaaccattatgctttctttatcactaattatttcgggtaacagattcaataggtttacaataaggattcaaatcgtgaagtggaagattgtgtcttttactgaaacctaacttaacatggaattggagtataaatagaatttttataaaagagaagtttgtccttaaaaaagcagtgtatacttcagtataacctccttggttactttggtttgtgttaaagcattcagtatggtattcgcgctggaggaaggcttcacatactaggcaccaagtgttccaagtgttggccacaagtacatctggtagatttagaaacatccaagaaaatttccaccaaaaactgttttatacttgaccatgttttagtgtttttaacactggacttatgaccagttgtaactacattttatagtaagaatggcaaccatttgttacataatcaagataagtaatttgttaagcaaaaacttttttagggagttaccttctttatctgtatatattagagtttgactaatgaagatttattttcagctgataaggtcagccaactatggtgacgtatctgatttgctaggtttttgctctgccaaaccaccttctcagaattgtttcgaaggtaaaagctcccaaatacttgacatatggcagctattctcatttcaacacattctgtgtttcagttcctgcagaccaggaaaacttaatctgtaatcacaagtggagctagggcaaacatatcttaccctcagacattcaggttttccacgtaaggtagggtcatttgtataaatacactgtaccaacagaatctgttttttttttttttttttggttcaaagtgaaattagtgcagtgattaatcccattttagagtctttgttcagcatgattgaagtttaatgtttttgctaggaaaaattacttggtgttttgatagagctgtaacacctacaataccaccagtagcattggttcttgagaggagacatagcatgcattccctcagatataatccttcaataaatactactgaagcagctctctaccaggaaggaaaacagcactcatcctcatcctcccgtggactcactgtttttgtcttgcctattctgtgctgtaattctcacatcttaactaaaggagctaccacaactaaacaaacagacaaaaaaaaatcagagtataccttcacaaaataagcagtctatatgaaataagggagttgcatttggtttttttgtcagtaagtctgtaatgctcgatatatcaactttcagaattacagtaagtcagagcaaagagaatgaaatctgtagctcagcttgtttatttttttggtttgcttctgctgaattttgtttcccccaagtcagaatacgagtctttttgtgttctctctcttctcttattcttccgagaagtgaaggtggtgggtgtacagcccatatttgtttactttttctgtagctcatatatctattattactggtggtttcttagtggaaatttttctttcactctcactttggctttacctccaagtgctttcttctcttggctgcaattgagcactataatttgtggctttccggagggggagccttggtggtcaggtggaggaggcaggccacattccaaaagtggagtggtaggtgttccagacagagtgctgattcaagagtgagtaggggtgtagggtgaaagttggctactaattcaagcctcacctgaggcagtgttgctcaaacagaaaagtgccctctctaattagctgcccccatatgcgcttagattaatgacagccaactaacttagaaaccccttccagagtaagctagccaaacaatagatgttccatggacatgacaaagagctaattttcttgtgctaaggaatttttagctcttgtatttgtggtggactgcctcatcacctaatgaaggtgaagtacattctccattttaggaggcagagttaaaacattttcctcctgtggatgtctgattagaaaaaaaaaaaatctcctacttcactgtacctttccagcaagtcttatcctctcaaagcactgtgtaaagctttgaaattaactggttcagtgagtagattatattttggtactttcctatttgtccttaaaaacattttctgactgttggatgtaaaagaagatattaatgaaaggttgaaacttcattatcattgattctttttaaacacccccctccataacctgctgttttctgcatttgaaataggaagattgtgacaaatgatttcattctgaaattgctgttgaatagaaagttttgatattataactctcattcaattcaaaggatatagatttcatttacctttatataaaaaatggtgatagtcatttttcctccatatttgtactctgaaagaaatatattctaggctttctcatcagttagcctggccttaaatgaaatcatggaaacaaataattcacatcttaagtattttttcagttttctagaaaactttatgattaaaagttgctaagttcatttcacatttttcccaaggtgtgaaatacaattctgtaaagacatttccataaacaataatttatggggtcacactgtgtggtactttcaaagttatgtggaaagtgtttcttttgatctcctctgaaacatgtgactgaaagaataataccttttgtggtctcaaatatttcagttttcagtcgtgaactttaaaattcacatgagcaaaaagaaacaccgcctgaaaaccaggcagtttttcttccctagatgcccagaaacattttgagccattccaaaccactgggatcatttgctctgatttcagataagcagaataaaataaacaaactcttgcccatgtgggaagtggttctgctgtctcttgttctaaccctgcaaagcctgaatgtctccccagcatctttgaatgggtctcattgtttatttattgtgcttttcacaagtgcttgtaactgtacccttgttttactaatagctttcttctaaagtgggttgacatttcagttaattttcagtgtcctcaatgtttttccttaaattgggccagactgactggcctgtttagttagtctcgtatagattgtagcacataaaaataaggaacatttattagatatttttgaatttgttttcttctttaagaaatgtcaggtcaagagaaatttttctttcacattcttcaattatttgtgttgataaataattgaatagaagttttaaacctgtgactatcctagaagttttaagtttttacattaaaacctattagatatgtaaatgtatacatttttattcatttttgaatgtaattctgtttaaaatcttaacatgacgaaatttaggaaattgttcgaagtcttgtctagatgagcaattttgaacactttacataacattcagatttttattgcatttattttaaaaacatacataaaacctttttcatctgtagaaataaactagaaatgaaactacagggaatattgtccttgtaccaggaagtaaaatctaccaactgtaggtctctattggcacggaaatgggcatcattaggcaaaacccagaaacaggttccagtacatagtgaaccttactgaaatgaagaaatgacatttccattaaataggaaaagcatggattattcagtaaatattatggcgtggctctcaccaaagatagtactataaggaaattccaagtatagtaatagcacaaatagaatcaaaaaacaatttaaataaaaagtattaggaaaaaacataagagactattactgaaatatcctgatgaaagaggtctttgtacacatgttaagaaactttgattgataatgcataataacagatttggttgcataagtaaaacattctcatttataaaagacaccataaacaaaggcaaaatactagcagaaaatatttgcaacaaatatggtgaaaagaaggttaactaatatgtacagggcgtcagcacattaatggaacaaaaaacagttttgaaaggacatgaacatcagacaaattgcaagtttgaccagtgaagatatagaaatatgttcaacattatgagtggtcatgataatacaaacaaaaacagtaagatgtcatttttatcccatcaaattggtgcacttaagaggacttccaattgccagtgcttctaagaatatcagatagttgacatttttatgtactcacgataacaaggtgaatgaaaaatgtactttttgtctcagtgatcctatcccacttctgggaatccatcctatagagaataccaatacatagagtacgagaatgtctattgttaacaacctgtacattgtgaatataagttaattgttaaagatgtatttttatttgttaaaaatatcagtgaaacatttttggattacatatggtacattcaaactatgggatgtcatgcagctatattaaaataattggatcaccgtacacttgggaaaatgtacatgatatttttgaagtgagcaaagaaagttgtagatatgtaggtacatataaatatatggtcatgtatttcatataattttgctgaaaaaaatacaaaaatgcatatgtttgtatatttttgtgtacttgtagaaaaaataaggatatttccctagggtgagctagtgtatcttgctggagaggtggatgtgaaatgaatatgaatattacatttgtcattttaaaagtatcagtagaattttacatataaattttggccattttactttagggaaacatgctattttgaaatgagtcagaattacacattttttgaacaatgtattactgaacctagaggtaaatatacagaattacagaatctgtccttgtatttccctcgcattttgacgtagtcacagtggagattgaatctctttttgatgatgaaaaatttgtctagagttttttaagggaggtatgaattttgaagtagaatatagctttgaatgatactcaaaactaaatttaatggccattcccaatttttaagcaagacatacattcaaccttaaagttttcaacttgattcctgtgctttgttaataactctgccttagagtaattagggagtctgaattgcatttactcttaaaaggcagaggttggagccagaaacttctgtcttgtcatgttgtattctgtctggctgacatggggccaaatcactcttgtggttctgggactcagtttctccctttctcaattggaatgataatattgaaaattaactggttttttagattagtttgagttctgcataaaaatgtgctgtagtcccagctactagggaggctaaggcaggagaatcgcttgaaccaggaggcggaggttgcggtaagctgagattgcgcctttgcactccagcctgggcaacaagagtgaaattccatctcaaaaaaacagaaaagtgccgtaatggcagccttagagatgtcatgtcatgttctgttaattgtcttattattgaatgctataacaaacttgttacagattaacagtcatcactctgtaatagtgtgctaacttagaaaagtttatccttgctttttgaattataagattcttgtaataatatatcatcgcagtttggtcttttcataatgttaaatccagaaggaaccttgaagatgaggatgcatcagcattttaaagatgttcaaactgaggtgaattacttgtccctggttacacagctggctaatgagggagctgatgcttgatgcttcatttgagcaacattctggggagtatttctggcataaaaccaatttacaaatgagattactctaaatctagtgctctatctacagcatttatacattttgtttttcattattatcaaatggaataaatatttaaaagtatacataatctctatcagtaaaactagtatctaaaaaagtataccctttagaagctgtgtagctttgcattcatttttaatttttttcttcgaaacaaatttctttaggatattctataaactacattaaatgggtcaatttttgcagaaagcaaatataaataatatttacttatttgcatattttattttaattagatcattatctagtaatttcctttaactgtgatttttaaaattatatatatatatatataaaatatggtgctatataatactgctttaaaagctggacgcggtggttcacacctgtaatcccagcactttgggaggctgaggcgggtggatcacgaggtcaggagctaagaccagcctggccaacatggtgaaaccccgtctctactgaaaatacaaaaattaaccaggtgtggtggcaagtgcctgtaaatcctagctactcggtaggctgaggcaggagaatgtcttgaacctgggaggcagaggttgaggtgagctgagattgtgtcactgcacttcagcctgggtgacagagcaagattctgtctccaaaaaaaaaaaaaattacatatatattatatataaatataatatatataatatataaatttaatatataattaatatatattatatataaatttaatatacataatggttgttaacattacttgtgtcaaggattatcaattgaattgggtgattcataacacagatttcattggaaatgtttgagtagggagggcctaatatttagcaggtagtatcatgttatttgacattaaatcaattgaattttgtagtttcagtaaacacaatgtgaatgttggacatttgaagatatgaatgctagtttgtatgtcagtgtctgtgtatatgtatttatataaatgagtcattttatatacaaatatatgcatttatgtaaatttgtaaatgtaagtataaacatgtttactgtcttggtgtttgagatgattccatttgtggtgaatgatggtgacttctgttttaaggatgtttggaatgatttaaagtaaaatcctgttcctaaatctaaagattgtgataattttagatgaatacttttcccttttcattattattttttggtgtctaccagaatatttatacatagtgatagaaacagtgattttttttgtatggagagaactcagaattattcagagatattattattttgagggaggcagatatacagtacaatccagaatgacatttaggactactatatgaaatattacgtggcagagtctcgttctgtcacccaggctggagtgtagtggtgcgatcttggctcagtgcaacctctgcctcccggcagagcgattcttgtgccccagcttctcgagcagctgaaactgcaggcgtgtgtcaccatgcctagctatttttttctattttttagtagagagagggtttcaccgtgttggccaggttggtcttgaactcctggcatcaagtgatccacctgcctcggcctcccaaagtgctgggattacaggcatgaaccaccacacctggctggcaaaaagggattttaaaattaatttaaaacattaaaacaaaaatggttttatcactatggtaatattaatggtgttgcaccggtaggttgctcacggtttatgtttttgatgtgatatttgtcctttatgtgttaggaatacccaagccaagatgtgtgactgccaatttttgatcctaatagcttttctgactaaacctgttttatagctactatgatcaacatcttctggataccaagtgtttatatgggtagcttgacttgagagattgaaatgtttaatgagtggacattaaccttactaatttgtatctgttaagtgaagctaatttgtagcttatttgtctgatttgtggtatgaccctatttgtggtctgacccaaattatttgtctctctgaaatagcagtgtgttagtctgttatctgcttatttacttcctccaccccgccttcttagtagactatgtttctgggaagcagaggctattatattgttttaattttaaaagatttttatgcttttaagagattattatcttgatcacctttgcaaattcagtgccaagcatgaagctgggtacacattcaaaaaaagtgtgttcaaagaatgccttttaaagtagctgtaagactatgtggcatgctggtccttgatgatatagggcagacagtgtaaacatggccttacctcctaatgcttatgacctgatgaaaataagttagacattttataatggaaattataaatttatttactcatattcatttcctgaggctctgtacatatttggtacaatgggggtatttaaaaagacaagtgtctgtcctttagcattccaaagagttagaggacaaaactgtaaaattctggtatgtaatatttatttcttataaataaatacatatatacacatagcagtcatgtgctgcataacgatgattcagttagtgacagaccccatataggacagggtcccatatgattataatggagtatatttgagccaggcatgatggctcattcctataatcccagttacttggcaggcagaggtgggaggattgttcaagaccagcctgggcaacattgtgagaccctgtctctaaacaaaaaaaaaacccaaaaaacaaacaaaaaaaccttctgtcattgtccagcttctaagtcttcagtgttttttcactgatctcagaacaaggactgcaggactaatggggtcctcaagccttgcatctgtagcctggaacactctaatgggctgtatgtagtggcttatgcctgtaattccaggactttgggaggctgagacgggaggatcacttgaggccaggagttcaagaccagcctgggcaacatagcaagaccccttctgtaccaaaaaaaaaaaaaaaaaaaaaaaaaacgatatatggcacttgatattgacattgcagatcaattaagagaaattattgatattcagcagtggtgctgaatatcatagttttctatggggaaataatatatacatatataccatctaggtttgtgcaagtacactctaatgttcgcacaatgacaaaattgcccaattatacatttctcagagcatatccccatcataaagcaatgcatgagtgtatacacacacacacacacacacacacacacacacacacacacacacagtagacccttgaacaatttggggacttggggcactgacccctcatgtagtcgaaaattcatgcataagttttaactccccccagacttaactactaatagcctactgttggctggaagcctgatggataacataaagttaattaacatatactgtgtatgttatatgtattatatataccatattcttacagtaaagtaagccatagaaaagaaaatgttacgaagaaaatcattaaggaagagaaaattactatgcattaagtggaagtggaccatcataatcatccttgttgcctttacattgagtaggctgaggaggaagaggagagattcgtcttgctgtctcaagggtggcagagaaggagtaggtagaggaggtggcaggggaggcatgcatactctgtataacttaatgaaaaaaattcatgtataagtggacttgggaagttcaaacttacgttgttaaagggtcaactgtaatatatatatatatatatatatctccctgcttggtataggtattgttagttaggtgtctttacatcaagatttctttgtcttagaccaatttaaaaggaaatatgaggctttggggtcctgaatgacattgggctacatcttagggactcttgagtctatctgagggtacatctttctgtaatgctggcataaggagctatgagacccattagcttattctgaccctaggatatatataggagaaatactacagtcctaggtctttggaactgagaggaatctctggagtcacttattggaattgcctattcccactgagaaagccgcgtgagaattttccaggggacacaaatatgaggagtcagtttaagatctgattccctgattcctggtcctatttctttgcatcaataatgtgccctcactcctgatacagtggagagcaaagtaaaaacagctaaactattcaaaagaaacaataagaaaacattataaggcatgaaaacccaatcaaacagttgtatttcaacatgagagaaacagtttgcagcagattttcagtttaaatacatgtttaatttcatgtttaaatgcaagccaaatctcagatttaggacaggggatcttcattatccagatgaatattcctgcataaggaagtagggaaaaaggcctgtagaaacctctgtcatggtaggttatatgcagaatccaatgccagcagctggctatatgtgtctgggctggcatggttgactctttcccaaggatggtcatctagtgggttcctcttcctgacatcgcaggtacaattggccatgatgccctctgcatggtcaaactatatgtttcctaagagaccttgggcccacttctgtcaccttacatggatctgttaacattacactggataggttaagcaatgacctgtattatgatagccagttcatgatgtctatatagtaatctcttaggacatggtaaatgattatgatcatcattagttttgccccatgtgtcaggttcttcatttaaattggaagcttattcttatacttactacgtgctaggcacagtgcgaagagagataatatttattttcatctggaattaatgtcattctaactccaaaagaaatgactagagaagattagggaagcccagacaacttgtcacgtagcagtctcaatcaaaattcattaaaaagaaaagacgattataaatgaggaagaaagcaatatataaatatttcctgttttatcattatgtattattttatttgctactgtctctgaaccatggtattttgataggagttttataagttcctagaatgatattgtactcaattgtgcatatattaaaactttttaaaagaaacctcttggtgttttaaatacatgttatttcaatgtattgctatttaacttcagagtatttctgcagtggtttgatggcagattggtgttatagaaggggccactaaataagttagcagtgttttactgtgagtcattgactaacttcagctataatcttgagtctcctaacttttagatgtatgactttttagtttatcaattataatcatgtatgcataaatgtaaacttttgcacgtctgtaataaatgaacttttattttaaaaaatgggaaacagaaacaatctagttgaaaccctcaggaaagtaagcctgtgataaaacccttaaatgacataacatactcaccagaattaataggaataataggaacatatgggattccacctttaaaaagagaatggacatattataattacttatctgattatttttgaaaagttcagcttaaagcaaaaaagatgaactggtttatcaaaatatggagtgtagtagaataaaagtagttcatctttatttttctttagctttctcatgcatctgttaaggagcagtaaaatgaacaaaagatactgtgagaaatctggactgtggtagactctagatgaataatctgaaaatttttcacatacaaaatacttatatttagttttaaaaacaaacataatagcctctgagaaatggttaactttctatgttccactgtgaattacataccaatagaaatttaaaatgctttaaaatttgctgtaatttaaatctattgaattttatttgggaaaattacccccttttataaggttggtaattcttaacaaggttaggaaattccttttgtgctaccatttaggaacatgtttaaaatgcatatatataattctaaggttaaacagtcaatgtgactctcttcttgacacattttgcttgaaagacctgtaatattccttcagaaacaacaacaacaactccagcttattttcaaatctgttacaaaagaaagcacagaaggaaacattcttgaggtcttacagttccaaagaagtttatctaaagttcataacttgttgggtctgatccattggaataaaatatctcactctctagtgttaaacttgcagaatgagtgattttctttttaaactttttacactttcctctgggattccaaacctgttctgaagagaaatcataggagggaatggaaacatctttaactcatgacagtaggtaatgcctatatggcaaaaagttatttgtaagtttgctaatcatctggttaaatttattagtgttgacagctaaaagctgtaatttaaatcccaaagagaaaagtttgaagcaaagtaataataccaaagaattgccaagtccccattttgtttcattctgtctagacatggtcttaaatcatggagtctacagtaagattttgaatgacagtgtccagttttccaaaaagaaggttaagaaaatgttatttggaatttcttcatagtcttagaacatgcgtgtactaattttggaggtttttccacctgtgtaagctttatgtacaaaatagaaaatagatgaccgttttgataaaactcatttgcctgactattcataaaggtgttgaagccactaaaatatgagtgaatatactttcttttttttttttttttttttttttgagacggagtctcgctctgtcacccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccgagtgaatatactttcacaccaagtataccagtagccctttttcttaagtaattgcctattgatcccatagctttaccttgtgtataaacattaatggacattttgtattttgggacccatgactatttaaattattttaattttttttttttagtggtttctggtgcaggaagcgggtgggtttcgcaatgtctgtagttatttttcatcgctacaactagcaagagagtgctggtatctagtgagtaaaagccagagatgctgccaaacatcctacaatgcatagaactccccccacaacacagaattatcaagcccaaagtgtaaataatgctgaggttgaaaccctgccccagatggaaggaaccttatttttctcctctttgccatatataatgtattttttatgattaaaattcataaagcatactcttagaatatactaatattagagacaaatataggccttaatataaatgattaaattaggtacatgtaaggcatgaaattatagcatctacttgatatgtggttataaaattataatactgaaataccccaaggcaaacaaataaatagagatttggtaaaacttaatgtgtgtcatagagttacatattgctggactggaaggagcctaatttgatggttcctaattgggttgatgtgttgatgagcatcagtgcttcagaattatttgatgagatacctagttcaaagatgaatgcttggagtcccacgttagtactggattatgaaggcacaaggtccaagaagtactttttataagctcactcattttctgtaactgcaaatataagtgattcttattatataagtgattcttatgacctcagccaccatctccattccacttcttctgagatttactgttctatctgtattacatgaaggcttgatgatgttgacattcctcagttactattgttagtgaactaaaaaagcggatcattgtttcttccttattgctttgttaagattgccttttaaatgtgaaaatattggttttcctatctcggtacattcattctccttacataatgcctcctggctgtcttctgccaggcccgttcctagtgtctgatgatacggatattgtctctgccctcatggagcaaaagagagatagagaaaaaaaataagcaaacaataaagcaaagctgtaggagtcttaaaaaatggagcagaacattcagctacaagtggcctagcaatcacatggttcagctgagacctaaggagttgaagtgacttgcccaagttcacctaattacatggctgtggtggaggtgaagggagggcgtgggcctctggatgtctcttctctcattccacactagaagacatgcaggtggggaacaggagcatcttctacatgtggaaaaatgtgagggactggcccatgtgtgttataggacaagttgataccaccgtcaagcctagtggaggtaagggaagttgtgggccattccaaagacatgtgttcactccacccttcacactcttattggaataggtaaacatcaaagagaaagtgaccaatatttcttcctttcttacaaggacacagccatggctgggctggttggtattcctttaaagtctgaagaatcaagagttcctgagcgtgtcttattccctgtcctggccactaggcagtcagtggctgcccaaattgtgttatggaaaagtgaagcatgggaagacagaaaaggggggataatattattacctgtgattgagcaagcaggtaaaggaggagaaaacgaagggtaggaggattcaaatggggaaaagggcatgttttccatgctgctttccctttcctgctgtgaacttcagaatgcacttgcccattgaccacattgtgagtgtgggttatgattctaggccagcttcccagaccttacttcaccagtcatgcattctctgaccgtaacactaagagtacaatggtaccaaaattttaatgtaacattttgaaatagtaggtgagatttggataggatggttagcaagttggtttatcaaacttagcctgtaaatgaccacacaggtttggaaatagaaaataatttacattatgtgatatagtacataagattgtcatgtggaaaaacaatacaaactagattgaatattcaccatatgagaaaaacactttcttcccttttgaatcacattagcttttaagaatcttcaaaacttttcaggaacatgctatatccacccaaccccttgttttttggttaattgttgtttgccctatcctaaggaccaaaagctatacttacttccatttagtttgtcagtcttttaaatttatttttctaaattgagaagagcctgattaaggagttctgtggcaatagaaaatctctcttcaattcattgccaaagcatagaggcttctgtatatagtatttaaaagtagagctctaaagtaattatttccttggatcctaagaggactcgtgttagtgaaagcaaagtgggacttatttcgacccacaaagaagagctgatttagaggccatgtggtgatgccatgggagaggcgcatgtactgctggtttaggacgagctcttctgataagctctcagctgttacaacagataagagaaaattgatagtttcagaaagcaatgaaagtcaactaggactacagataaacagcatctatgattcttttcaaatgtttgagtacaaaacacccatattttaatttaataaacaattactggagacttactatgtataatatgctagaaatgttagaagctctaaaagaatgataggacagagttctgcccttaaagactttagaactttttagggaagagtcaggtcccactataggggccgtgtgtgtgtgtgtgtgtgtgtgtgtgtgtgtgtgtgtgtgtgtgtgtgttcatgggctcagtgcagcctcgaactccccgggctcaggtgatcctcccacttcagtctctcgaatagctgagactacaggagtacaccaccatgcctggttaattttttatttttgtaaagatagggtttcgtcacattgcccaggctagtctcaaacccgtgggctcaagggatctgcccacctcggcctcctaaagtgttaggattacaggtgtgagccactgtgactggcccatgtgtgttataggacaagttgataccactgtcaagcctagtggaggtaagggaagttgtgggccattccaaagacatttgtttactccaccattcacacactcattgtctcctgcatatcactctgtccaagtaatcagcctgtgtttgctattacagatattcattcaagtattttccttcctttttgaaatgtcctggagaacaaggatgttgcgttattaatcttattctcagtgtttgtcagtgtctgctaaacatttgttagagttaatgattgagtgaataatgcagggattaattcgtgaatgctttgtgaaagcaatggagatatggatgtggactggtagagtggaggaccttcctctaattgaggcttggagtggagggcagaggaagtactccagagctggaacaaggacatagtgatgagcataccatgtgttgggaaggcaatcctcagattacataataaattagaatgcatgccaatacagactccttaggttgcaagtcataggaaacctagctcagagtggattaaacaacatcacacagcaactcttgacttttttcaaatgaagaattggccccaaagattactcctattagtgaaagcaaagcaggaaattattttgacccacatagaagaactaatttagttgatttagaggttctaattacgctaagtaactgaataactgaatagcctagttaaggggcaaaacatcaggtacagtttgcagcagacaatcaaataatgtaaacaatcctggttattttgctctcttaggttctgcttttcctacattgtgctttcctacttacgatggcttcgttcttatggtagcaaaatggttatagtagctccaagccttgcctgttcacaccaaaatacagtggagcttgctagctccaatgtctcttgcgtctgaatgactctgattttatttgcatgcctcaaaaccaatcactgtatccagggagttgggttatgtcagtctggccccatgccatgaggtggtattcattgattgcctccaagccctgttgttggtgctggagatgatgtttaagttgcaaccacatacctgtacccttattctggcactccctgtgttccttctttgttttatttttctcaatagcattaactgccttctaacatactatttgactcttgtactgggttgtctgtctctccttgttggaatgtaagcttcacgagggtgtatgcatttttgcctgttttgatcgctgctccatccgctgtccagcatatgtagggactctaaatatttgtttacatgaatgaaaaagaaacaagattctgactttcttaggcttacattctcatgtatttatattatttaagcaaggaaatatttatattaattaagcaagaaaataccagttactgataagtgttgttaaaaataaaacatggtgatgggaaagcaaatgtgaagggtggtttaatgtggatggcaattccacctcagttgttgggccattaacaggagcggaatgggtgaccaaaggaaattcctgggactgcaccagataaagtcaaactggagatagaggtaacagaaatgatctttcttatagaatgcatcttatgacttaatcaaactagaaacagttatatcctttagagaaattactattttcaagatttttgctagctgcttcttggcaagttttgtaaacttttgttgacttttaactttatgtcactcatctcttaaaactgtagatcacttttgtcttgctaggtacaatgttggtgtcacacagtcttcattacatgcatgtgggtggcacatttctgatgtcaggctagcttccttcctaacacttccttgcaccattctagcagcatgatcttagggcatgtaagcccattttaatgttagtcttaaacatctgacacacacacacacacacacacacacacacacacacacacacatacacggacattttgggattatagtgatattgttaaattgaatatataactggaatcaagtgacatttgaatgagacagattcacagaagtcataggctcatatttgagggtagggagaaatttaatgtaaaatgaaaggtaagtttaaaaacaacctcacatatatgcatatattatgtataaaaaaatctatgaaaatgtatacactaaattatatatgtttatacataagagactggatttacaatctttgactcattaactcacctgataattaatcatgaaatgattaaattcagaaagggagttttattacatgaagttgctcattgcaggtttcactgcaaaatgaggaaggcaactggaaacatctgaagtgtccaaaaagagaatagcggaaatcataatagtctacctcaaatgagggtgattgtatgctaagcccattctataagaaggcaggtagaaataaataagcaagtggataaataggttacgcatttgtggaatattatggaattcttaatgattttacaaatatgtggagcatgtggaaatgttatgagatgccaagtgaaagtgcagaatacaaaactataagcaaaccatgattacacctatatgtatatatgtattctgatatacagatatgaaggaaatgtgcaaaataaaatgcaaattttatctgtagagttatttttgttgtaacttttcttttgagtatattttaatgtagatatacatagttttaatgaaattggaattacatttataatgggtttataaaagatagcagaccagtgtcatttttcttttttttaaaattgaaaccggtaagtaagagcttgtttttttcctcctacgcagttggagagtgacagatattgctgatgaccctcactttcaggatttctgtcttgcagccaagttgggaggaaatgtttcgaatcaaaaaggggaaggatgaagagactcaaggcacttcattttgtgtgtgcctgtgtatatgtgtgtgtgtgttttctagggggttaacacattgccccagcttggattatttctatcctcagaacagcatataaacattttttggggggaaaaagttaaaatatttacacagctgcttcctttatttttttttaaatacacagataatatttttactacctcatgaacatcatcatgtctttgtaactagcatgctaaactttatttctccttttggtagcactattttgttattaatcccttctgcccttcctccttcccctccttcccgttgttccctcttatcccctcctccgaccactcccctccccctcccgctcccttctcccttctcctcccctctcctttccttcttttaaaaattataatctgttaatttgtttgaacctagggtgcctgaaaattcagataacttgagagtaattaattaattccacattagtattccaatgcatttgtaatgacagccttgcaatttttggggggtaggtaaccattaattttgcctcagtaaaataaatggcctttatgtataagctaagacttgtacaaaagtagattaatgtccttcacctgtgactctacaacaccaattcattcactttggtttttcagccagacatctggccattttagtgatttattgacttaactgattaatttggtaggggaggttaatactattgtgccttcagatatagccttaagtttctgtcaccaagaggtgatggcaatctaacctgttggcctcaggatgtgctttgccttccctggattcctcagactcctatttttatatcagattctactttggttgctggcatgactttaagctggcagggcaaagggctttcttgaaggtgactgtctcctcaacctgtctgacttaaacggttgggtcaaggaaggaaaaaaatggtatgatgcagcaggaattgggttgttgaaaactgtattttatttgcatttcttgagtttgcacagaacttaagttaccagcctttgattagcaatataaatttaaagtttgtcttgggcaaacttactgaaaactcctttaggcactttcctcacatcaattaaaaaaaaaaaaaagagaggttaatagaacactagctactattttgtttcctttttaatgccacgtgatctgtataccttggaaggcagaaaaataattttatacttgtgttaattgaaatagcgtctttcttgtcctggctgtagaatgatggtgggtcctttaagcagaggactttgtgcacttgaatgggagcagaagacaggctgctcagggtgtctgaacttcacactcacatgcctagagttgggctgcatatctaaggaaattaacatgttgccactgttttgatcagaggcttgtgtttctatgctgaatattttcaaaacaagaatgttgtcaagaagtaaaggtcaacatcagttctctctaaaggcttttaatttctatatcttttggtgatgcactctaaatgtacacattaaaagtgttatataaaaatgaatgtgactttttaagttgtgtttctaatgcttaagtatgtataattaaagtaatcaaaaatgtaagatggtggctaattcaaaaattttaagctttgttaaaacaaggtaaattagctaaggtatttctgctagtaactatttttttttgtctgtcagttactgggtttcagaaatgaaatacagatttgagaatgaccttgttatttaatttttaaacattaaaagtttagtaaacatagcctcacattactatttattttaagagaaaaggtatattaatattacacacatactttttttttttttctgttgtgcaatccaaaacctgctggaaagaatatatatgcttttcatcaaaaaaagttaacaacttttaaaatcctacaggttcaagtcccagctgtcgaaaactgatcctgggctgctgcagctaatgtactttcttgtgagaggctgaactctgtcacaggtgacagctgacccacttactcagaccttgataaaggatcaggcttcttttataggccttcagattctcctgagatggtctgtcatgtccagctatggatgctgaagctgaatttcttatacttaattttttatagcatttgtgtaaactaccagttttggaggaatggttaaaattctgacacagtggcctgtgagagtattttgagttccattttgaaattatggctagcagatgctatgagtttggttatagagacccttaaagtgtgtaagacagtttttgttttttaattagttgtttgaattttattaacgtaattaacttcataacttccatttgtgagattccaggatttttctaccttcttggtaacttttcagtgaagtagatatttccaggtgcaaaactttatgacctaaataatttgtaatcatttccatagtatatgcaagtattttaaaggagtcgggtgtctcaacaaaagccacctaagattgtggttggcatttgtgtttatttgccttaacatacatatttatttgctttagcatattttctctaaagcaggggtcccctgggcctccgacctgtagcagtctgtggcctgttaggaacctgggcacacaggaggttagtggctggccagcaagcattactacctgagctcctctgccttctgtcagatcagcagtggcatttgattctccttggagaacaaaccctattgtgaactgtacatatgaggatctaagttggatgcttcttaggagaatctaacaaatgcctgatgatctgaggtgaaacagtttcatcctgaaaccatccatccacccccgccttgtacatgaaaaaattgtcttacacgaaaacggtccctggcaccaaaacagttagggaccactgctttaaagtatatgtgcttttgcattgcaatttaggtgtaggagtttatgctgtttttgcctttctgttttcattgtgtaaattatcagccaaaacttttgtcgaatgactgcaaagtcttggtctgtgttccctggaccggctttgtggtgattcacactagtattgattaatggcatgattcatagcagcttgcattgataagttcaagaactccccttgttgactttgtgggtcgtgcttgaccatcttgggagaggtgtttccctgagataggagtagccaacatcgatatgtattagaaaacacacacacacacacacacacacacacacacacacacacacacacacacacacatacacacagtggcatttgaaagggaagggaaaggaattagtatcaattaattctttgaaatgtatctctttgtttcagatgatgtgggacaccggcttgtgcaatgtgatataagaagggggaactctttaagccgtacaaaaacatgtatcaagtgatttgatatgtacaggggttataaatcttgtattccatttatttacagattagtgatattagatgtaaatctatttagcagggaaagtataagcaatttatctttaatggaagggatggttgggaggccataatctcctcttctactacttgataagatatgattaaaggaaagcaagttaaggataataattatttaaacataatcctttatgtcaaaattaatattgcatgaattttgaattctatatttacctgaaagaaacctgtaaaatctcggtgctgtgtggacgttacagattttagtgcattgaggtgtgagacagtgagtacagatagagggagacaagatagagaatccttgtctcccatcagtatttgggtttgtgtttgtgtggttttcttgctgttgttagaaacaatacgtttcttaagaagatgccaaaagaacttgctttagcaagttgacatctattgatgaataagtatgacattttaatccccatattttaaatgatgtttggttactatttgtttaaaagcaactgaataaaaacatcttcagctatccagattccaatctgtacagatgactaatcatgtggaatatttgaacataaaggttctagtgaaaaataaaaattaaaacaaaaaatgtagttgctcccagatttgaaagtacagaatgttttctgtgccttttagatatgggtaactatgacattgaaaacaatggtaaccacgggaaatgcaccttacaaaataaataaggggaaaaaaaaaagacatgggggtggggagtaggaaggagttggtgtagtaacagcttagtgagtaaataaatatttaaacttcatgctttgttacttgtgtaatcatgagatttgcagaattatgttttatattacatttttagttggtatcttttttatcttgtgttaaataatctgttaagccaaatttaagtactgttcagaaacaaaagcaagttacaagctttgtgggtgttaatgtcttcatgtgtaaaaaaccagaaaattgaattagatatatcctaaggttttttccaagcttttaaattccatgattctgtgacccaggaggtgtccaggagtcatgtgagtaaacttttaagttttgaagtaacgttaactccaagacttgaaacccttgaaattggctagaaatcctatacaagatttccagaaagttaccgttatacttcctgattacgcttatggatacaaatataaagcaaacaataaccaaagacacataaaacaaaccctgattctagcagtttacgaaaagaggaaatttattagaaggttctgggggatcattgtccagtagaactttctgtgatgaggaaaatgtttagagaatctgagctatccagcatggtagtcaatagtcatatgtgactatttagcacttgaaatatgtctagttcaactacaagactcgattttacattttatttagttttaattaatttaaatgtaaacttttaagatttaaaggaatcctgggagtaaccgaaacgtcggtcttgagaagaataggaagaaaccagggtggccttaggaactaagaactgctttggaagcagtagtggtgtgttcttcagagtcataccatgacttagttattagtggtacccaacctggatttatcagataacaatggcatcttccagggagagaaaatctgattgtctttacatgagtttggtgtctaccctccaaatcaatcaactgtaggttgggttgcagaatgattgcgtacctgccagagtgctgacagttcccagggaaggaggaagtggagccaggcagcagtcttaagagcggtttgccacattacttaagagaaatatgtttttccctgcaagcactgatttttctaactttaaaatactcttattttgttaatttacttgtattgcacctgacttatttaccttttttattgctaattaaaaataccactctatgttgagtaaacttttactaacctgagagactaatgatttataacattgtgtagaaggaaatcaaagaacattatagccaaaagcaacaatatgagccatgctagacaatgctctcttgttacagagagtattgataccaaggcttagatgttttgctatttcaagtcacgaaattatttgccacattagggatagatacttgctttaatctgaacctatgttgttgaccagctacatgttaaaaccaagtgtttgaaaaccatctttttgaaatttgacgctttcccgtaaatttttattttcctgtaaagtggtaatactaataatttgtgagaaaactgagtagtgcaggttttgattttgaagggttttttgttttgttttacatttttaaaacatgaagaaagagctttgattgagaatgtgttaattgtattatgtgaacctataaaattaactcttattatttaatacatatgaaccaaataatacttgacccagataagtgaaggatagatagaaaagaaaggcatttacttaaaatggctgcttattttatcaaagttagatttcaaattagagttggatgagctgttttaaaagtccatgctaaatatgttggggactgccccggaaacaggttttcctcctctgtgtaaatcagccatgtttctgtggtgcgaggtgggtgggagccttgctttacttcctgcatctcagcaggctcaggaagggaagcttgctagggtgtttaagcagccacatgcattatgttaaattaattctaccccagtctttggacatctattgacaatagtattatttgggttgcaaaatcaacaagtgaatagaccaaagaagaaatggggaagaacccagaatgagtgtgagtcaaacactaccttgacacaggaagccaggactagaagccctgagatcagtccaatccagggaatatgctgactgcgctgtcatttagaacaggccagtggaattcaggacctatcaggtaagtccatgtcttaccaacttaaagcaatcttctgggaagaggtctggacctgtatctaacatgaattgtagtgaggtctgtccatcacatttcactcatctaatcacctttgtcattcttctggttttcacagataggatagaaaaactgtagtttttttctgttgccacttagctcttggttgcaggggcctctaggtaggtgtgaagtggttatcaaggctttgactgtcaaaaacacttctactcaaaattggccttagcagttaagccagatttaaaatgattttggtagtggattatctaagctcatatagaataactgcaagtcactttcaaacttgccatagatgcgaagataatatattctcattttctggactagcttttcccaggaaaaggtatggggtggagggatatcaaatatcaatttttgtagatatggaaagctccatgaatgtgtatttataggccccctgaggtctaactgaatgtatgttgaatgcagattcttctgttttcctccccaggtttgtcatttggcaactagtacaggaaaaagaccctcaataactagcaagtctgtctttgttatatgtagacaagcattttgattaatttagggaggatgcttttttcactatataaaattaaaatgaaattatggaagaacctagtttgttttcttacttgagttgaatgctgtttaaccactttcttattacattcgattgacttagttgagttggatgctgaatgtttaaccactttcttattacatttgattgacttaaaaaccatctgtagcatagcctaaataacttaagactttcagaaagttgtggcaaatttttttgatacattctcattcatagccaactcaattatattaactttttatacaaatcaaattatattataatccatacacattaaatttcacttagaccaaagaagagccaaggcttctttactggatctcaccccctcttacgtatttaagagcattgccccaggaagtcctcttttctgcatcagcattttctattctttgttggatcatactcattagcagaagatgccatagtttttactgtcttgaaataataaagcttctcctgagcccatgttcttatccagctactgctgcatttctcttcagagcaaaactctccaaaagaattatgtacgttcactgtctcaaattgctcttctcccattcttccttgaaccctctccaaagcttttcctcattcactgcttcagagccttcttttgtcaaagtctccaataacctcagtgttgtcaggttgaatagcaggctcatctaatttgacttagcatagcatttaacacagctgatcacactgtctctcccggaacacattcttctctggagtacttgcaaatcacatgctcttggttctcctcctgcatcataggctgttctctctcagtcatttttttttcctatttcttctttgtttctccagtctctaaccatttaaccattggaatgcccccttctcttttctatataatgcatttgtggagtgagctcaagcattcttcttttatgtatgacactgatggtttccagtttttttttttttttttgagactgagtctggctctgtcacccaggctggagtgcaatgaggtgatctcagctcactgcagcctctgcctcctgggttcaagtgattctccagcctcagcctcccaagtagctggaactgcaggtgcatgccaccatgcccggctaatttttgtatttttagtagagatggggtttcactatgttggctaggccggtctcgaactcctgacctcaggtgatccacccgcctcggcctcctacagtgctgggattacaggcatgagccaccacacctggtccgtttccagtttttatctacagtttgaatctttcctcagtgcctctagtctcatatatacaaaatacctgcttaacactttcacttgcctgtctaaattaacttgtccacactcagactcttgctttcccttgttctttctgagcagtaatggtggccttcttgatatttatttaaaaaagaaaacagattcacagctcaaggcctttatatttgctattacctctgtttgccatgcttttctcccagatacccacatggcttagtctccccacctccttacgtctgctcaaatatcactattctcaatctggctactttttcttcttaattttctctctaatgcttatttgacatgccgtatatttgtctgtttattgctttacattccaagaatatatgctctaagagggcagtgacttttgtccattttattcgctaatgtgttcccatttcttactacagtgcctggtccatagtaagtgctcaattaatatacattgagggaaaagactacatgaacattactaccacgatgatgttatagttgatttcagttccaggaactgaaaatgtgaaagtgcttccgtcaatttctcctttgaaacttcactttagataacttacttctttagtgagaaacagcagccccttattcttaaaggaagatttccattgtgtgcctttttcttctgcagctgtctctgagcaaattgctcattctagcttcttcttggaatgagtctcttctctgaacttctcttggctcttccctctttcagcttggcttctgttcacggagcttagttctacttcctgacctcacagagcttgccctttttatagtaaaaagcctgtggtgatgtcattggctcagctggtttcaatcaggctgctcagttgaagctgatgaatgactctgcaagttatcttttggagggctgtacttattctgatacaaaatacgcagttatatacagcattaaccatttagcaattatcccatgtgagtcatgggaatgctttttcccactctttactaacggaaattctaattgatcattggctgccccacaagcacagcagagtcaggtatctgatgttggtcaactgcttactggctcttactctgcttctaactctctaggacctcctgcagcctttctcctgcctgttactttattctgctttctaaatgtcattccttagatccttaattaagctaccccaaacttgtttctcaccttgaacctctgccttactgttactcatccatttgctgctcttggatcacacatttttttttgaccttgccatttgtaaaatgtaattgaattgtgtgtgtgtgtggctacccttttcttttttaattctaggcactcatctttactattaattctgtaacaattgctatttttgactttagaacattgtcctaacttttttcagtgagaaggtgattggtttgtgatttatttctggtaattttatgcttctaagtctgatgcaagacattttaattacattttttagtttggaagagaaaggctttattgggaaattgatcggttttcataaaacaaatctgtcatatttaaaaatgggcctgcatagaatatagtgtgtatgaaaagtggtggctacagaatccttgtagttaaagctcagaaagttttgatagccagtggcacaaagggggccagatgtccacgggggtgattgtttaaagggatggtagggaaaatataaagtgaatgtgtagaatgaaggggtgcttatgaccagggtgaacttctaatttattgtgtaaatcaggatgctttgaagataaaagttgtaacagacataaactgggactgcccacgcaaaccctacctatatataacattgccgacacacctcagaattatgggtaggcctggttggccttcatgatcagttgtttttcaggacacaatgaagttaatattccacctctgtggtatccgcagtctgctttatagcagagcaagagtctcaggaaacatagtttgagagctccaagttcaatatggagaggtctgtttctgagcagcagctatttctaagccactgcagctgggaaggtggtagagggagtgatgaggaggggatcaggtgtctttggggcagttaatggacctaattctgagggttagtgagaggcaaaatttggggtaatggggtaatagcagagggctgacaaatgacaggtagactaagcaatctttaaataaaattgaatatattttaaagacatgcttacctcattgtaagcttataattaagaaactgaatatggcaaaataattgcagtgttaaatttatttcataacattgaatttaaaagtcgtagttaaaataactttttaatttttttatttttttttttttttttactaatagcttttaaagtttcattttttatgtttggtgccagaattaagaagtggccctttctccgtataaagcaaatggagttttatatgctagattcaatgttgtgaactgggaaaaacatatctggttttatataggctttaagaaaaatcaggactgatcctaggaagattaggaaggggatttataggactaatatagtcactatctcagtgttatgacttactgctttggttttcatggaattttcttctaaagaacattgtgagtcactggtgtagacagaatcctgaacactcttagaccactgacaagtagaaaaccctgtttgcagccagcagggtctgtgatttgcccatagtaggtacttaataaatattgttgacttgatttggcttaggtttgtcactggaaaatgtaaaagccaatgcacatttatagattgatttaaattttggggagcatttttgctatgctatgtacatttagagaaataatggctatttttgtctaacaggaattgtaggcatgcgtaagttgaatgtgcaagatggacctctgaggagacaagaaccattagaaacttttgcatactatattatctgaatattcataagtaaatgcaaatagaagagcaatttctgtcaaattgggacatttaaacaaatcaagtgttaactttgttactaaatttttaaaatgcgttttttgatatttacctaaatgaattggaaatgtaggtccacgcaaaaacccgtacacaaatgtccacagcagctttatttttaatttccaaatagccgagatgtctttcaataagtgaatggatagataaactgtggtacatccatatgatgaggtattattcagagatataaagaaatgaggtaccaagccacatagaaatggagaaaacttagatgtcaattggtaagtgaaagaagtgaatttgaaaaggctgtgtatgattccatctatgtgatattatggaaaaggcaaaaatatggtgacagtgaaaaggttagtgaatcccagggcaagtgggtagatctggggagtaagagggatgaataggtggagcacaggggacttttaggacctgaaaatatcaggtcctaatattttgaaaatatcaggtcctagccataatgctggatagatgtcattatacatttgttgaaatccgtagaatgtgtaacacaaagaatgaacctcaatgtaaactgtgggctttagttaataataacgtatcaacgctggctcagcaattaatttcaacaaatatacagtactaatgcaagatgttaacataggggaaactgtgtgggaggtaaaggggtaaatgggaactctgtacttaccattcagtttttttttctctaaatctaaaactgttccaaacaacatattttattttaatatagtaaacatgcaaaggcaaaccctatttcctgtacatagtggatgtctgataaatacatggtacatgaatgcatgatgggatgagtgaagaaatgaactgcgtgataatgtatgtgaaagtaccatgtaaacaaactgcctgacaaatgtggggggaaaagctagtgaggaaaaatggaaaacaagtcatgaaaaacattcagtgtaaaagtttgagaaggcataagaggaatttgaactaaagactgaaactattttaaactgtttaattttcagaaaaaaataatatagtttttattaaataaaaagttgatacctatgctttcagagtctgtgaattagagacaccatcttgacaccaattacttctcatattaatttggttttgttctagaggcttcagcttacaagtttcagaggaggtccttctctaaaggtgttttttgtttccttcattgtttaatatgggcaggtttccgtaatctcgatacaaaaccttgataaggccaggagcggtgattcaagcctgtaatcctagtgctctgggaagctgaggcaggaggattgcttgatgccaggagttcgggaccagcctgggaaacatagtcacatcttatctgtacaaaaaaattagaaaaattagctgggcatgatggtgcacctttaatcccagctacgcaggaggctgaggcaggagaatttcttgggatctcgagttctaggctgcagtgaactatgatttccacagcactccagtctgggcaacagagctggaccctgtctcaaaaaaaaacaaaaaacaaaaaacaaacaaacaaacaaaaaacaaaaaaaaaaccacacatacacacagaaaacaaaaagcgaaaaaaaccacaccaccccaaaacaaacaaaaaagatgtaaaagtgaccttgcacataacaagcttccagccaagaagattgaaaagcagttaaatagaggaataggtagactatcatttgcttagtattttataattttgagtctttgttctgaagaaaatgtgacctttgttaaattttagataaatatgagaatgaccttgattctttggttttatcttcagtaatgttaaaaatgcaagtatgttgaagtcatttgttgtttttctcagataagcctcgtgtatttgaaaataattggaatgatttctgctcggtagtagtatgattttcctagccttatatcttttatgcagtgctctcaaggaatatgggtggtacaaggttataatatactggcaaccgtgtttcttaaggatttgacgtgaaagaaggtataactttctataggcgattacagataagaacatggtactgtgagagtacataggaaaggtgcttacctgcagccctgaggatcaggaaggtgctttatgagaagtgacaactaaaccaggacctgagatatgggtggcagttaaccaaataagttagtgagagaagggatgtgaaagtaaaggaataattactgcagaagcttggagtcagggctgcagagagtttagagatcagaaagatgttcttcgtggcaagaatatataccgttaagtatgagggttatgaggaaataatgaggctaatgaggaagtagggtcagtgaaagactttctgccatgttaaataattaactttttggagcccaatcactgaaaatgattcagtttcatttttgaacttttgaacattttgtgattaataaaaaagatgtcaattattgcttattaaaggctttcaatgctattactcacacaatttatctcatatgaattgttttattgcttaaagtgtcttggattataagaaagcacctgttaggtttgtaatgatctaaatgcaatttcactttagcttgattattggtatttatgaaattaaacattaaatgaattacatatactagatttgtgggaaggaaagctttctttaaaggcagaataaactcccagagattttactaattggacaacatgtattttttccctatagaaatgaaaaaaatatgtaatccatgactttcatgctgtaatacgtacatagaaaaaaagatttttgtaaaaaagaaagggagtatttgtgaactctggaagaatctcatgttgaataagaaattttgaaatcagaatgtagtgtgggtttagtattttctgtacagaataagtttgccataaattactaaataattcacagatcttttatctgattaattgaaataaaataattgaagatttgttaattttggatgttgtgcccaattaacagctgaaatatccttcaatactaattgagtaaagactcaaaataatttgagacatgaacatattttctcatctatgttagttctcctttatttatttatttttgagacggagtcttgctctgtcgcctaggctggagtgcagtggcgcaatcttgcaatctcagctcactataacctccgcctcctgggttcaagtaattctcccacctcagcctcccaaatagctgggattacaggcacccgccatcatgtccggctaatgttggtatttttgtagatacggggttttaccatgttggccaggctggtcttgaactcctgacctcaggtgatcacccgccttggcctcccaaagtgctgggattacagtcatgagacaccatgcctggccaacctttaatctactgtatgctacttaaagagttattctgcaatttctttgtataaagattttttttcagctgttagttttttttttacttaaatcaattataaaatttaagttaaatataaccaattgctattgcttcttggcccaagatgttttcttatttcatcattttatttttatttgcaatgttgaccgttttattttacttctgtagaggaggtgtcactcttggccatttttgcttgaatagttcttttattctattctttcattcattctgaccttagaggatttatgtatattgaagcttatttttgaaaagtggagagataaaactactcatgcttgggattcagtttcttaaatgtgaactgtcatcataaaatatgtaattttaaaggccaggtgtggtggctcacgcctctaatcccagcactttgggaggccgaggtgggcagatcacaaggtcaggagttcgagaccagcctggccaatatggtgaaaccctgtctctactaatagtacaaaaattagctgagcatggtggcatgcacttgtagtcccagctacttgggaggctgaggcaggagaatagcttgaacccgggaggcagaggttgcagtgagtagagcctgcgccactgcgcgatcactctgtcactcaggctgcataggttctctgtccagcctgggcgacagagcaagactccatctcaaaaaaaaaaaaagtaattttaattattttcttttattaaaaatagaatctctgaatgaaaaatgtgttaattctttaagagtaatagaaaccatttggtacaggtattgggaagttacaaaaagattcttgacttagaaacacataccagtttgtattctcaaaacaatatctatcctacttacatctatcaagtcatgaattggaggatcaataatgaaaatttataaaattcttgtcctttgaactcaggatgatctgaaggtcttatagtacttcaaatgaccaaaagtcaatctggagaatgttcttttggaattctgaagccaatttagtttctcttctgctcccttcctgctttagttgttagcttttcgttcttacctgggaatagtttgctccttgtttgtcccctttcagctaactctcttaccttaagggaacattaaaaagtatttgggttacaagttatttctccataaataaagtgcatgtgtatcaacagagttttccattaagaagatatgatacagtctacccacagagagtttttgtttaataaacacttccttactctgtgccaggcaccgtttcaagtactttgtagatattaatgcatttaatctcatgaggtagataacattattgtccacattttgcatgtgaggaaactgtggcacggagaagtaagtggaggaactgaggttgtctgactatataattttgtgtgctacttctctgagcataagagaaggatcagtactaaagagaagcatgcaaatgatcagtaatgttgaaaacatacttttcttggatgaatttctgttgaatagataagtgaatcttgatatgattgccttattgtcctacgtatcttgtatattatagaatgaggcattatgtctctggaatttatccaggctttgggggttaacagaattgggtttaaattctgactgccacgtacttataattcttataattatttataattctaagcaatgtctttaagtataaaatggaactagtagtacttcctaaggtagttatgggataaatgagataatgaatgtaacaggccaagtatattgaaggcattcaataagtggtatgtagtattaagtgctataactaggatggtagaaatagaagttgtatagtggaggagataaacctagaaacagtttcatgtaatcatattatcagctaaggatggtgattgaggagtggcggggtgtaagggaagccctttgaagcaaattaggcctaagtaataataaagaaaatttcattattcctaactattaagtgaattaatcattatcttgttatagtataatgattacgaatgactaagttagtagttaaaatgttacattttaaattttgttttaaaaagttgtagcagtgagcaacatagacatttattcaccaacagcacttttgttgtttgtgttttgtgtgtcgttaattctgtccaccacatttttgggcccatcttttacccttgtttgtggtttatctacactatattagtttatggggagacctttcctcttaataaatagcaggaagctgtccacttccagtggtgctgactcatgtagcaacaggaagaggaatgattcctaaagatgggaggggaaggggcatgatcctcttccctcccttaaagagacaaattcgggacagaattacaaagcagtttatgtgatggatgagtaagccatgggttaaaagattttctccttaattatgcttttttatttgtgttttattcttactgtactggcttacccatgtgaaagcaattcctaatgcccactgccttttaagtttatgtttactttctctgattagaagattaaagagaaatatcatgtttacacttacagtcagtattaacttctgcttgtaactggtggtatgctggtgggaaaatggttaactagcacttaacagtgatggttggcaccagtcagttcttattggttgaatcgaaataattactgaaaggattttaactatataagatataacttactagctaaatgcataaattgttagtatgtgtcatgagtttattgtcgactgaaagctgcttttttaattatcaagttttggaaaacatgtagaatcctgtaaagagaaatccagaagatttgagaagacaggtgggagtgctgttatttggagaacagtttctgtgtgtgatgtgaactctctgaaagaccttgaggaggaggaggtgaacatagatgaagtggctggctgaggtgggaggattgcttgagcccaggagtttgaatctgtactccagccttgggtgatatagcaagatcctgtctcaaatatatataacagaggtctaactaaaaattattagaattgatttttacatgtagtttatggaacaattcttaaaaattcataaagtcacactgtatttaatctactttggggttcaaacttacaaaaaggacttttaggcaatgattttttggaatgtaaaatataccataattaaaaatgaatattatcgaattgttaagtcttatgtagggcatcaaggacttcactagcccacctgtaaattaagaaataaccattcagattaaacaaagcaagtataaaggaagttggatggaccctttttgccaatatgcagatgtatcatttctagaagatgtactttaattatgaccatttaacagaccaatactgtctaccttaaaacctcctttggtatctaatttcttgcaacatagtgcatctcaaataactggtaggaaattgtttgtgtctttaaacatatttttagtgtctttaaacatatttttgtttgtgtctttaaacatatttttaggaacgtatggcatcatgcatatgtccttttctttgaatctgggaggtggaagaaagcttagtttgaacaagcttatctagtacctgacattgaacatcgctgtatgccttgtgatagagtaatagattgagacacatatttacaacaattgataaaggttttattggttgtgaaggtggtatgcacacatatgaatgacctgtcacggatctcacagatacttcctttttatgcagtagctatagccactttaaaagatacagatgttatatagtaaaaatactacaaactcagaacctcttaaaacaattttttgcttcttgcaaattgctgtctttatgcaatattcctcaaagatcttgtttgcagtgaagcatccttcaaagcatgtgaaatgtatttttcattaccatctcacatgttatatgcccttaattccatttgtaggaactccttctaacatttaatgaaatcctcagcagccagctgtatgccacagaggttaccatgggttaaccaacattttatgaaatgttcacatgttcctggaaaaaccaatgagcagcttatagagactggtaaagcaaaggcgtgacttctactgatgttgcatttctgtagtactgccatatttggacacttatcttacaaatacttatatgttgtcttcttcatgatgttcacattgaggtgggtaattatgccagcagtatactttgtgtttcacagctatgaaacaaagtggatattactacaggatgcctgtgtttccaacaaatatttaatgaatgcctattaataccaagatgttttccaggttctggggatacatagcagttaaaacacacacacacacacacacacacacacacacacacacacacacacacgttccttgtttgtatggagcttatgttcttttctgtgcatgataagaagacaaaaccaaatcgaattctatccccattttcatggatgggtataacaatttaatattatttatctgtattctagaatataagtcagagagaattagatttaaaaaggtagtttgggggccatagtgttcaaagccttgtgtgatgaactaagaaagttgcatttaattcacttgtgaatgtggagctaatgaagatttagtgaatattttgaggaggatagtggcatgattgttgctaggcttctggaaagatgattcttccataagggtatatggtgaattatagtctgaatcgtaaataaagagtagttaaagttaagtctggcaagatttattatagcctgtcatagacgatgaggagggcatctgtgtaatcttacagcagtggatctcaatcttcttgacaaatttttgaagacagggaacaacattgctaaaagataacaataaaaatgaaaaatgctgactaagttggtacaattagacatgataaatgaattttatatctgctcttctgtaattttcatagcagttttctcctgggctgaacaaatagtttataaactttgggcagctgatatttagcaggacgtcccatgagacaacttagtaaaaagaataaaataatcaaataccaagaccagttttaggaacacagcatagacatcaaattgtgatattgtcctttgacttttttttcccatattatcttaaggaagatatcttgagtgcgcagaagtcttggacatttggttcagatatgttacttgtatatatgactaatacattaagcctaatgtgttccagcaagtataaataatatgctatagggattgttataggctgcgaatcttccttaggtttatttaggtatagaggtgagataaagttgcaattttattatctttagttcattagcagttaaatacagtgttactctatgtattgttgactgtccgagttgcaggtttttatagtggtatagacatatttagggtactattgtagaggaagatggttttacgtatttaagttgatttcagcattgtggtcctatggcaccataaaaactgtgaggttggaattctctgaaattgttgaaggcctacgaattactgtgtaccagcttaagaatgtaatcactgagatgtgacagaattttgccttcttttctcagacttctctcaccgatgattaggtgcaggtatttttgcagaaaagaagtaatacctcttttccatttgctttagttgaaaattaatgagaatttatcaatttttcttcttcatattgatttttattattgttattgttacttatttatgttttttagagagtggatctctctatgttccccaggctggagttcagtggcacaatcatagctcactgcaaccttaaacttctggactcaagtaatcctcctgcttcatcctcccaagtagctggaactataggcacataccaccatgcttggctaacttgttaatatttttgtagagacgaggtctcatcatgttggttaggcatattgattttaactcaggctatcaaatatagtccctgaaaaggaggaaattatttatttcaactaaaaaggttttaaaagtttaaaaaccatcttcttatgcaagttaacaatagtatcgatagtataaatattaatagtggagtaaatattggtgtataaactatggttataaattcttgcacaatacaaatctcatcttggactcaatttattgaacatttttagtaattttgtcagtctggagttcacttttgttactagtataaattgcattttccagagatagcgtatgttaatattaatctgcctggacacatttccctacacttctttgtcagattaggtgtcatctcctttagaggccattcctcagatccgcttatcccctcctgcctcccatctcagtatagtacgggcttcatgcacttccattattaaactttatgcttatagccctcaaaagcaggagtcgtagcacagtttctgtactgtaattatttgattacttggttgtctttcacactaaataatgagtacctgaactacaaggacattgtaatcccaagtatataacacaattcctagcgtatcataggccctgagaaatattggttggaaagaaatctttattcacatttatggataattcatacctattatgtgttacattggcttgtgaaaacctttgattctgtggaaattgaattttattcaacttttagatgagccattaattctatatttaatgcatattctgcacagtacatggattatccactaatatacttttttctaacactgaagtaattaagttccattatctagagtcctcctactcagtttgaggttgtggaaatctgtgtatacatattatttcattcctagttaactgaggacgccccagggcagaggcagattggtaataaggtctgacttcacaccatggccctatcagtggtctgaaaaagacagctaggcatggtattctgaaaaggacagctaggggtgttcgtctgtctcatgctcctacagaatttggcttaaatgaagaaaatagttggtcacattctctatatgagagaggacagtatcagtaatcaataatgattgagcaattgctacttactttctccttttatacccagagatactactggaaagatactgttctcttaattttctttagtgaatgtgtttgtgtttgctacacatagcccctaattttaaatttcactttcactagttgaactcaggttcaattgctagacctgtatggactggtctagtatggactgtactcttgtttctcatccagtcatctctgagtctgtcaatgtaaagaaatttcttcatgtttatcccaaccttgatatttccttgagatttcattaggccatctttaattataggtttttaattttgtttttaatggacagttgatatagactgaataacactgtgattttaaatgagaaagattaatcacgctatataatactgtaactgatttttataatgtagtagtaaccattcttataatttagtagtaaacatagctagggccatatctaaatttaataacttgattgaaaaatgcattcacttaataatcctatttattttttgtacctatgatgtaaatacttatgatgtaagatataaatagtaaatgtatagagctgtatgcaacttttattctctttattttcttctgttagtaatttactggctttacatattttgacagagttaaaagaataagaatatgggaactgatgtaagaaaatacagagttttcatgaaaagtagaggaaataggtgaggtaagaaatagtgaaaacagtctggaattattaattattattatatctaagtcacttggtaagaaagtaaataaacctgttgaggtataaattattttacttcctctttgtgtatgtaaaggtagttctatatataaaggtgattcatccacaggcagtaacatgtaaattccataatccctctgtatgctatcacaaatacattaaagaaacactttttttttctaggtagagcatgtgagctgcattatcttaaagacgtttatgttgctttctatgtttattcccctctattacatgaccaggtctttctctactttgtaagtgaatgaccagtggagtttcttagatggtttaattttgttattttgggatcagggtaaatgagttatgtttgttttgaagcagtgtttgtatatctgttgtttatcttgtgtggtttttatttgggttatcatttgactttggaatttagccactccttacctttcattcatcttctccttcaaaatgctgacacaagcagagaagtgaatgaacaaaaactcactgtttgtatttattcatgtttccaagtgattcatgtttagttatcctttccttgaatcaccattcattaaaagtggtttggtcttctttatgcctatcttctctgtttgtgataatctttctattctttgggattcaggtcaatttactaagaaaaactcatgattaaatatcttgaagaaagcagacatgggctgggtgctatggcacacacctgtaatcccagcagtttgggaggctgaggtggaaagattacttgagcccaggagtttcagactggcctgggcaacagagcaagaccctgtctctacaaataaataaaaaaaataaataaaagagtagctggctcccagctactcaggaggctgaggcaggaggatcgcttaagcccaggaggtcaaggctgcagtgagccctgtttgcaccactactgcagcctgggtgacagagggagactctggaaaacaggctctattgcattatttcatatggctaacaaattataacctacaatacaacaaaattcagccaaattcttatggatatagtggtaatataaatttttggtttctctcctgaattgtttttcttttaatcgtctagaccagagctgaaggctacttccccctcagagagaattgtttggcctaaaagagatttaaacagtttgtattagtttccatcataggggattcagaagataaaatctgacttttccctgctacctcctttaataagggcatatatcaccagaactctaccttgcctcctctatcctgtcttccctcatacatgctatgtttactttgcctcccctggctcctataggcatttgagtttgttgtcttttcttgaatgattaaatgagatatttgcttagtgattatttgaacttaataaaccattgtgagaaattgaaggtcactgtgcaactgggcttttagaatctggatttacactgagactgagggacaaagatctgcacaacaaactgaattttatgtgcatttgtacattttgcatttttctgtatgttaaatagtaattgcttgctggtctcaaaaaactgattcatgaagaatgttttcaaaggaaatgtttttccttccttcttttattttaattttttctttttgttaactttctttttcttgccctgtcttaaggtgctgatttttcctgccttcgtatgccttagaagtcatttcagttttcatattaaactaaagattaaaaaaagactcaattcctattaaaattaaaaagtcaaaaaattcaaatgcaactgtgagctacagtgacttctcatttactaataaagtgctgggtcataaaaaataaataaaaaggaaggacagacaacagaaacagttcctgccttgggggaaaaagacatgggggaaaaagatatgaaaatgattcatgccttatttcatttatttgatgtaaatgaagaactttatgtgaagacatattactttttatgtctattttgaaatctagacatagacttcgatattggggtcaaattgctaatttaagtactgtgagaatcagtgtactaagctaatcttgtgaaaagatggttttggatggagactcttcccagtaattattacggagttaaggcaccctttttaccatcttctctgtcaacctaactgacatgaatttctaacctggtaaagtgagaagagtgatcaggagaagataatttgcatagtatatatagatttctattccatttatataaaacccttgaatggtaccttagtagaaacaatataaaataaagctaatatgggttagatgataatgtggttaagtggatttttttttcctgtctgaacaaaagaactgacaatttaatcaatagacccctgtcagtctggagagatgcttctagtggtcagcacggcactctggtctttgtgtgtgcatatgggtgggggcagggcagggtgttgcattttcccattaatcatggtaaacattaaaaaaaaaacactagatatcaaaatggaaatgtaaagttgacagtggaaaacaatttagaattttagaaagttaccttaattgacagtaaggaacacaccttgtctgtcttttcttgtgagccttattgccctctgtgaaggaagtattaacaaaaacatttgtttgttgattataagattgaatgagatacaccacatcttttacagtaacagggacaagaatggcactgatgcctagaccccactcttagaaattctgatttaatttatctggaatggggtctaagcagtagttttttgtgtaaactcttcagacaattggactgtccaaccagagttaaagggtcactggactagtcagtctaagattttctgaggcggagcaaagatgacatattcccacatactctgcaatagctactgctgcctagtgacatgtatttgtcctgaattttttcttgataagattgaaagctaaagaaaatgaaaaatatctctcaaggataggggattcaagtgttcagcttaattttatcttcccaaccatgtacacacagtatgcactgcattgtgcatcataagctcattctctttatagctgctgtggattctattggtatattttcagtgttgtttctctccagttgagtgctcttctgcaccttcctccttcctttgtttttctgtcccttcccctgacagagagcctacaagggccacagggttaaccatgtgtgtaaagcttaatacaaactttcttcttagcaaagtagccagcccactaactatgggagtaaggtggtcaggtggatagttagagctcacataagcttgacacacatttttctgattattcctagaaggcacacatacagttgaaagttatggagtatgccatattccaggagaacaaaaccatgagagtcaggagacctgcatcatagtctgagaggtttagagtccacctaacttcatgtgtttgagcaccttacttacctgcctctatctcattttcttctctgcaaaatgagaagctcaaactagccacttcctaaggttccctctagcctttacaatatgaagtgccattttatttttattactagtttaagagaacataagcatccacttgttgctaagtattcttttcccaacataaaaaggaaacccagacaaaaaataaatacaaattaaagatttcaataatgtaaataattatatatacttatatttgggttgttttaattggaatgtgccttaacgatatgaattaagacattaccagaccagaaatatttcaatcttggatgagggagaagactggaggggtttgtatatactcttgttattaatttcacttaaagtgcttctgtaaagtatagataacactgcctttgactgcctatttgcagagtgattattagtaaaatgaggggggacttggtggatacttctttttttgctaaagaaaaaaataaatgtaatataaaaactgctgaggtaaaaatcggtctttgtatttaccttagttcctggtcagtttttaattcattgaataattcttagaaaaatcattgaatgtattttttttgttattgtataggaaggttaataagctctctgaatatttcatactttaatcctacagaaaaatatgagtagttagaatagattaccttaaataattctgggaagaataatcattaatgcttgattatttcttttgatagctttttttttgggtggggggagaggggaagttaaaacacacattgactgtaagtttttttagaaatgagttcttcagaagaatgtgtgagaaaactcatgatgattttatagttgatttgggaatttgcagagctcacagttaattagatatttctaaacttatatgtaaatttctggtaatgctttgcaatgagatcactgatacttttgaagaaagtgaagttctattttttaaagtgaaaataattatactacattagtcacttataaaggacaatgcttattttttttcagactgatttgctgaaaagagttaactgtggtgtttgcaaatgctttggaagaaatgcagatgtttggaaaatgtcttttaaaaatctggaagttgtaaatattatgcagcaataatgttacattatggtagacagaatatcttgttacaaatactaaagagtaaagaaatttatatttttgctccagatttaaggatttgagtctggagtgctcagtgctagatatgttgccttcttttatggtattttctacaataccatactttcaatactgtgattgaaaactgactatacttctattacaattcttgaaggagtttacctctgatatgctgtaagagtctcatctccaccatttgttttaatcttggtcaaatgatttagttagccagacctcagctccttatttctaggagatatgaatggtacctacctgatgcagttttatggaaattaagtaaagcaatacacataaagtgtttagctagagactgctatatagtaaatgctcaacagaagttagtgatgatgttaccttgcttgtggaagatcttgtcaaaaaatcatttgttcttttgccattggcttgtgctttctctgtgaaaatgatacctctaaccccttttcttttgtatcctttcttttaagaactcatttattccctgggacagtggaagtaattaagtgatttactttagtggaacttccttctagcttactccagatagaagtaaccagaaagtaggtgacaatgttaattagaaagataaattaataccttttatgtggataatttacctgatgataatgactgagaaatcattgtgagattgtcagagggcagtttatagaatgaattacttttgatgaacgaaggttgctttttcaggggcagaagatagtttggacttacattttagagagagagggaaagttacaatatgctgctggcattcatcgtttagttaataatttggctcatcagggctgaaacagagtttgcattttttgatgaaggatcatttaatataaaggcttatttagatgacctattgtcattccatagagatcttgggtatttccatatggactagaatggtgctaggaagtaaaagattttctgggaaatcagatgtgctattttaaggaatgattttatcaggtcatttaaattttgtgctagacttccaatatttttgttttgttttgattacgaagtgttctgtaagaccagaaaggaagccagcatgttaagaaagttttaaagttattatatttctgatactgcacgtatacagacacacacatacaaacacaccatttcttttccatctctgaaaatctaaggtaagatttaaattacagacagtatgaaatcctgtgatgccaagatctttattagaatagcagtttgcacctttgtcgttgatacgatttgccccgtattcagaagcctgtgcagctgaagatgagtcattaagagaaactggaatcagtaaaactgcattttacaataatgctttctaaactggtcaccttgctaaaattggatgaggctgaagacagcagtttctgccttgaaaggaaggagtaattactattaacattggtcaggaactttcttatgttcgtgccttgacagctcttagcactttatttaaacatatactttggaaacaggttgtgtggcttgcacagattttaggggcatgaagctgataaagtgggagcatattcacaatataccagtgtaagagaagagagcgtgtggcagaagattgacaacttattttaatttgccagtccagatcttctgttctgatggaaagtcaacatcctttaggatggtgtgtgtgtgtattttagtccaaggaatctaaaacaactttcagaatttgtaaattttcctgaacataatgatttcaatgtgacactataaataaatctggcttataatgatgtactttataatcctgaccaggttacttttacgtcatgccagaaacacattttttaagctagcacttagaaatattacttttagctccagaaaataaattatctggtacaaaaaagaacaaagttttgacctgtaaggaaatggtgcccactgtggggactggtctgtggagtggagggcaactgaacttactgggatttatcgatctccttggtgatcgtggtccatgtggcatccaggctcattgtggatgcttgcttgcttgctgaatgaatgaatgattgccttcctgtcaactgggaaaggaggaagaaaaccatgaaattgaaaacaaacgtgtttagcagtaagattcctatccgctgggttcatgacccatgttctgactagttatcacaattgaatttatctcaaggacacatgagaggaaaccgttggtatgtggggggtggctggagaggaatgatgatagaggaggaaagtacttgtagtgtgactttcctcagagtcaagagaaggaagtgcttgcagcaataaaagtatttaaatataaactgaagaacacctctggttcttgtttttggtagatggagaaacccagagcagagctgaagaggtgtcatctgctctccagatggagtcagctgacaactcagaagcagaaaccaggtcttctgactctgggcaaatgttagatgctccctttagtagcaggaagacctgggtggaaatcctgatttggagtgtggtttgttgggcttcaacagttcacttgtctggtttctcctaaaagacatttgatttcacagatgtttaatttcttttgggaaaggaaactggacttcattgtcaagcttgagagaagagccaggcttaccatttctcctttctttctgagttttagcaaaggaagtctcaagctcttcaggtaaagagatgaggaccaggaaatgggtggtggtaaaggagtagtttagctcagtagtaggtaaacaagaaagagaaaaaaattcaaaggaatgaaaaattcctcaggaggattatggttttgtgttaaagtcacacatttcttatcaaagcagagatcattgattagctaactctaatttagatagtatttactgtttccagttggaaagttagtgtctaaaacattgagagatttgagggaacatataggttatcttcttgtccaagaagaagactcaggtgtggacagtgcagctgcctcttgtccagcccttctctttccttttgcttgctagtggttcattggctcatcagaaaatttgggcaagttgaccttgagggatctagaccatagtttcttacctcagtggtaatccatttggatagttccttaagaatcctctacaatgtccactttcttcgtgatgttttccttaacttctgtattctatagttttgaccatcaataagtttatgataattttgtatttatacttcagatttagtgttcttgattaaagtcaagacttttttgataactggttgtgtattgttttggatgctttactactactggaattgtgctttattttgagaatcatttatgtatatatttgtttttgcagcagatagtttttggacacctacttatttcagggaatttttttacgtttccctgcctctggacaagtaggacataatgttaataaatttgttttgaacacagtttcatttgctaacatggttttaagagaaattatttttggtcacgttttggaaacaaagataatacctttagaattgtccacattgatgatagagagacaaatgtaaaatgttcctgagtatatcctaaatacaaataatgcgtattcagtaactaatgttgttgggctaaaaataaacaaatagtacatttatggtaagcttgacacctttcacacagctgttaacattttctctcatctctgtgtaatgttctgtatgtttcatgaatgaagaggtacctcatccaacataataaaattaagtagcactttatagagcatgctacatgccaggcattattctaaatattttacacattgattattttaataatcagaacaacactatatgataaatactttaaatatattaatatattaaaccattagtctctgatttaaatacttataggtgaggttaacacagcctataaacaaatatttgtggacttcagaacaaactgaaagcaggttctaaatgtcaaataaaatggcttataatatgtccattggatctgtcactgaatgtggaattctgaaaaaaaaaaaaaaagtctcatacatgtagatggagacctctatctccctaatccagggtggaggtaactaaccaacccatttctttaatatttttccttttggaactttaatatatcttatccttattaaacaccccttcactagaagaagacatcaaaactaaaagaatcaggagtaaacaataacatggaagtatttaacatggaaaattaacttggagcttagtgtatgatttggaaactcagtctcagaaacgttaagtgacccatccaaggtcacatagcagaactagaatgagttccataataagaaatactaagattctaatcccaccccttccctacttgggcaaccctggcgaagttaatctttcacagcctcagtttcttcaagcgtaaaacacatagcaatgataaaacttactttacagcattaatgagagtgttaaacaaaataatatacttgaaactatctagttcagtgctttacttcatagatgggaaacgttaaatgcttattttcttttgtcctcaccatctctattagtctattggtgactgaatctgctacctaggaatacaaccctaacattacagtgcttctcagggaaccagaaaatcctacttgtaaacattcccaaaacataaagctgtttcatattaggtctattgactccttccatcattaaaactctgcaatcatcatatctcagtttaacttcatcagacttcttaatagtcatttaaatggaaatttctattgtagatatggtttatttggtatcagtgagtactaacagtagtgagcaggcagccttgctagccaaatatttgcctttggagttggccagtgattttgattgctttaaagtacatgtagttacatttctggcaggtgggtatttaccatttctagcaatgtttatgtaccatcatgtaattagcaacctgttgtaaatcatccagccagtgatgatttgccagaatgaacaatagctgagattatgcattgctgactttgctattgtaacccaaaagacaacatcctttttcctggttggtaggagtctcttcagacattagatgatttttaaaaagttaactctatagactctgactctattcagagagcaaactaatatagcatttttattgtgctaatagcaaatctctattaagaattcatatatgtacctttgttacgttttgtaatatgttttcaataaaaatcttgatgtaagaagagtggtgaatagaacatcagcacccctgttcaggggcagaaaagaatataaattgttagggatactggtaatccaccaattactttaactatctaatgaccatagtttaggcaaaagagagaggaaaatgatttaaaattattcattatcgtatttaaaaaatggaggaggaagagaaaggtgagaacagtaaagtagatttgatgcttatttaatgcctcccttgtgaaaaaataacattaacacagaaccaacagtgattatggtaacaaaacaaagtaacaagctaaacatgcttatattttagtacacttttgaacaaagtatttaaatgtggcactacagagaagtgtaagatataaaaataagaggcaataaatacatcttcaattacttaattttttaaaatttcacttttagaggattaacattaaaataatagactacttttatagttgcagaatttacttacttttggttgacaataagatgttagaattgtttttattaattttaaaataaaatttttaagaatgtgataaatataataaaatattagagaggagggtctgtatcttagtttgatttctatctctgttgttgcccttctagtgcacatctttgtatatcataagtgctagtgaacaatttatgttaaactgaaaaatgtaaaaactgaaaacgggaaactgtaattttcacttgcaagtagcgcatgtaaataacatggagacattacgttgtttcctttttaaaaagctaacgacaacagtagcgtatctctttcttactggtgaaataagaaattaggaagattttgtaagagatgttttagtggataggcttctgaatatggatttgcagtgaattagggcagagtaattcccagagaggagaaacaaaattggaagtcacaagggataggctttctcatttcagtgatttttaaatctgtaacatttgaagttttctgtttcctcaaagaaaaaaataagaggaactttgtcctgtataactttacatcttgtcctgggactcatgcttcttttttttttttttttttttgagacgggactcatgcttcttatgtttattgtattgtcatgataaggcatccttcgttcacatactactcatttcctgttaattacatacatacgaggtcctgtcttatgcatggtggaaaataaaaagattaattggacacagcgtttactttcaagaatgtagtagtttagggagagaatcaagctaaggtcattaaatgttggttgagtggctgaataaagcaatttatagacaatcatagtgactataggagcaaaatttttcaaagggcaagacacaagatttaacatttagagtaatgagggaagagtcaattaatactgccttatggtattaaatttactgactgaagttgatcagagtccatttagataatgttctctcttggatcatgtctgtatgaatgatatcagtgaacaccttcccagtattgaaatgatgtgtgggtatagtttttgttttatttacaaattatttaatttttattcttagagatattgtcaggaactattagcattaggtaatatgattaccattttagagcctgaaaaaagtgatagagcaatcacaaatcaatgactcttgcttttaaaaaaatttaaaatgcaatataaaccatttatacagtacataaactgggtccacacctgtgaccagcaaataaactatacacattctataactagcagaatatttccattaaaatgaacttacgaattatatctgataattctttcattattcatcaagtgcttaatatgtattagcttctcttgctgaatgcagagatcattagtggacccagctatatcctcccagtattagtacttcaggcagatacgtaaaccaatacatttagtacagttttctaaattgtaactggaagaacaaactctactgggactttgtgaggattaagtcatactgacttggcctctttggatatatgtcttgaaggataggatgattttgcttttgattttacctgacatgagtataacaatagctgtaaaatgccttattactatagaatttaagtctaatgattatgaatggaggtgggaggggcaaagagagtgtacagagttcaagtgacttcctgtattgtataattttattggttatactttttgccatatccccacagagaaaactggaatcaatttctacttttctaaggagcatcgtaaaagagaggtgctgcctcttcccctctttcgttcatatatccacacatttctgagactaactcatcattcattaagcctagaataatgtgagtgtggggtagaggatggagtaagctcttatataagtcatgacgttatcataatctatcaaaatatgttaatttaatcagataatctgtaaacacaaaatttaaagtctacagagaaaatcagataatgtttagtaaatatttattgaacaaatgaggatgttgggattctttaataattggcccaagtgatggagatgagtgtttttatttagcttttatttaatacgatgaaattaaaatagattttatgtatcacaaatagaatgtaacccttgaaggtgcttggtatatgtattccaaatgttggaagagttcaagaaagaaggtgactcttagtttcagtattatcattgtctttctttaatctttgattaattttctgaacttaactagctatgcaaagagcagatggtggaacggtgccaagttaacattcaccatctgcttctcacatataatttgtaagaatgtatgctaaaaaataatatatagtagcagggacattctattttgtggttgttgatcagggaagctgtgccatttaagataattgtatttaaacatgaataacttcattaaataaacatagcaagaacacttttaatgagcaatctcagtatgttgttttgtcttttatttggtctatgaaatgttgttgtttttggtgaaaacttagaatttgctcttggacccttttcagcttaatcagagttggtttcacagtttcttagagaggtgtccctgtgtattaggcttctcaatgagtcgttttctctgcatgggaagcacatgccttagcaagcagcaacctcttagagtcagcagctggctaacagccttgcttctccactgtttcactttaccccaaatattaagtgtgggcctcttggtagactgaaactgatatgagagcaaccgtctatcaaataagagagacagttaagaagtacttcaaaggaggcaagaggacaagagggcaaggcccaaaagtagttgggcctctgagccaggctgcaaatgtgtaaagaagttaatactaccaataattttcttatactttcaagtatccataaagcagggttatacctggacctatatgtgatgaatatatggtcttcagaggatctggaaactaaaattccatgtaatatttttgtgtatagatgcacatagttaaaaaccattaccatggagttataaatgtgtgcagaagggctttctcctagactcctttcacctgtttcacagtggtatgccttagttttagttttgtttttttttaccaactgagggagaaaaatcacatataaatcagaaaaaaagataagacacaatgacaatgttattttaattgagtgaatgcttatattcctttagtaattctctactgtatttacaaccctaccaaagtcttcatttagtcatatgtcagacaaaccaacaaataatttatgtttacattagttctttcacgactaacatgggaaaatgtcattgtgctggtaatatggggacagtatgacattttggctaaggacatggactttagaatcaaactagagtttgaattctgctacacattactgattgtcattgtacatgtaggcaggctcttcaaacctcgctttctttatctggaaattggagataatagtatttacttcttagaactgattttgtcttaaaatcatagttttagtaatggcacgtgggaattgtgggtatgcccgttttcagcaaggtgtgacctttctgaaacaaatcctctcttgcagggggatctggtcctcagtttaaaactttgatgaaggaggaggcaaggtattggcttatttctgtcctgtggttctcattacttcaacagtcagtacctttggtatctacatatgttcttgcttataggtggacatgagatcttgttttactttttgccttcagaaatgatgaaagtttcttccagctagctaaacgcagtgtacacttcatctctgaacctcttgggaaaggaaagacagtgttagaatgtacttttattatatatttattattattatagttgtaattggttagtatacacctttagttcacctgtcacttgcatgttgcttttaatctctacaagttttttgttttctgttattcaggaaaagcactagagcatccctgttgttaacaattataggacatttaacgaacagtctttgattctaaagagagaaacatcattgtactctattctgaagaactagtcattgttggatccaacttaatttttgtcctgtgtaatttacacaggtgtttccatttattgttagcaactaagaatactgcgtgtcagtcatattttcacatagtagaaaaatcttgtgttgagttttgtgattagcaaaacataagtaaagatttctaaggccctttatttataagtacaatataatgaaagatatttacttctttgggaaaacatagaaatacgtatacataaatatatttcatttttttctaataaatgaaactttaagggactttgttcagctctccccagttgttttctttcattgttctacatttgtcttcatatgatataattttatgagcccatgagagctaagaatatcattgctatttcttcttaatgttaatattaataaatagtaaagaaattaaagatttgtaacatgaaaattttctttgtgtcaagtggaagtattgtttttctgataaaattgaaaacattattctcttacaggacttaaagatacattatttgaaataaagaacaacctttctttttttctttcctttgttagtcatcataccaaactgattgttcgggaaaagagccccttggtaatcacagttgagatcgtttatttgtctttaaaattttttatttccttttaatatacaggttagcaatctattatatttatcaagaagaatacacttgcttattaaacctattaaaaatttaatagttggaaaaaatttaacctcagggaagaaaaaaattgaggctaatgaatagaatggaaaaattattttaaagtcacttctaagtagctaattatgttaatttaatatttagggggtaaaagttacagttttaatctacgagattcacctaattggaatgagtttcaaaagtatgtgggaaaaatatgtattttgaatcacaagctgccagtaagttaagcagaatgtcatctgagttatagacaagaaggcaggaagcctggatttgtatgtagctgtttctttgataaggacagagcttcacataagtttaccatcctttctatgtaacataacaataatctattaaatatattcttatggcaacatatgaaatactcattattatgtcctttttacagatgttgaaactaagggtatgaggatatgaaagatacagccacaggtacagtataaaacagtaagaagtagagcttggattagtattcaggtctgtctgactgtaaatcctaggcattctcataacaccacactgcgtgaccttgacccagaccttgacctaggtgcttaacttatttaagtgacagttcttaatctataagaaaaggcttagattaatttatatcagaaatctcattggctctcaaattccaaaaactcaattattcttgtgtttaaaactgaaccacgaagcactcatttaatatttattaaataacattgaataaactattaccatcataccttatacagcgtttcagaagtacaatctgtagacatccaaaatctaatgttaaatggctagcactgagaaaagtaaagaaacagtaatttgctatataatttgggaaaaattcactagaaaattagtttgctattttgtattatgttgtaaatgtattgagggaactgtcttcaaaatataaaataatataaaatactaacaatttgttttgaatagtttagttttgtcatattaaaacatgatataatacattatagtgctaaactgagattgataatataatgttgttggtttctgtcctatattaagaataaagcaaagcaatgtaaatattttaaaagtcattttgtagaagataaaactgaaagctaatgttgactgaaagttctctgccatgtacttaaaacccagtaataactgaaatgtcaggaaattgaaatattaatattttaccctcacaaaatattaactccttatgttcaatactttttttttgatgtttaactttggtatttcaaggaagaatgaatgtactaaaaaacacacacacacacgtctttccttttgcaatgggtgaaaatttctagcaatcttgttccaaggtaatttattgtattttttaatggatgctttaaaataaggataaataataccaaaggcattgttttaaaaatattttatattttatgacataaaataaaaatttatagctaagtttcttttagttttgctaatgctatattaaggtggataacgtgtctgtaaaagggggcctggaatcatctgtgtagtagtacctacatttagaaaagcattttaaaatccccaaaagcagtaatttgttttttggtttttttttttttgagacagagtctcgctctgtcgcccaggccggactgcagactgcagtggtgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctctatctcctgacttcatgatccacccgcctcggcctcccaaagtgttgggattacaggcgtgagccaccgcgcccggccagtaatttgttttttaaagtgtcgtttaacacttaagattctctgacagatgattttaagataattcagttcagatttgaatttcagagtagctactaatgacagaagaaataaattgaatttcattaattacaagtctgatactttaatcagtgtgtaggcatccagagtcttagtacctttgggaaaagaggacattagtaatctgaaatgcaaaaaggtaatccagcacatatttttgttttatcaacagtattgattgagttgattttatatttccaccagttagtataattgctaaagatgaaaccccttccccagagcagttgaatttatagtggaatttgatatgatgtttactattagtgaaagtgatgacatataaatatatatgtttaaatattttagagatgagaatgtgtcttttattttgtgatgtagctgactttctctgaagaatagtggtttccttttaattcaaaaattgccatttattccagagcagttatgtattgcatgcattaaaagaatcatctttaattctaacaagaaaactacatgaaggaattctaatctagaaatttaatgcatatttgggtctgtctggctctaaaactcaagttatttttacatcatactgctgtcaggtgacttcttccacattctaaattgcaaatagtcataggatgttagagacggaaggaacgaagtattggtcatgtagtaaaactttttggaagggccaaaagaggtttatggacttgccaacaaccaacagatagtggccagactagaatttttgtcttctaattactgatatttgctgtttccaagctcctttccgttaccatttaggagcagttaattaaacacctactctcttgggacattgtttatattattcaactctctctctttctcatatatgtgtgtgtgtgtatacacacatatatagagttttaaaaagtgtgtgtgtgtgtatatatatataggttttttgtccctcttcaggcagtgcatagtgaagtggcatatatatagtagcactcaataaatatcgattagtttgctgctactattttgttattgtgttcttcagtattgctattttgctcttttagccctctgacaactgtaagcaactttctatattaaaattcttttgttgaaatacctacattgatatctagtttcctgattataccttaatacatacaaaataaatcagaaactgaatgaaaaaatatgtatagggaaaacataataagctgcatcacttaaattttgtaaattctttgctcatggtaaatatagaaatgatgctcatactgtgtttagtacaaaatgcagaatagtataatgggacataggaagggttggtggggaaaaaccttctgtgatggcaaagaagtagacatatattaagatgacaaggaggcctgtaatcccagcactttgggaggctgaggtgggagaatcacctgaggccaggagttcgagaccagcctggccaacacagtgaaatgccgtctctaccaaaaatacaaaaattagctgggtgtggtggtaaacacctgtcatcccagctactccggaggctgaggcagaagaattgcttgaactcgggaggcgaaggttccagtgagctgagattgcaccactgcactccagcctgggtgacagtgagactccatctaaaaaaaaaaagaaaaaacgaaaaggaaaaaagaaaaacgatgacaaggaagacattaccacatctctgttaggcattaaaaagactttatgttgagggagtatactcttctactcagtgagtttgtgtgtgatttgcatttgaatgcaaactaattatatttgctctaaagaaagtacgtatgttgtacttactgtatatactttgtttttctcataaggttgatgaatttttctcattctgttattttgtggggtagctagaagacgaagggttataggagaagcctgcaaattcaaggttaagtcaattggctcagaatgagtttttttcacctttgcctcattagcactactctttaattaagtctattataaatcacaaataacaaagccctttaactttatatatatagaaggagatgtgaatatatatcatatatatgcatatatacacagacacagatatatatacgtaggtacacactgtgtgtgtatgtgtaaaactatgtctatactgatttaattcacagttgttttatactcagagtaatatgtggaggctattttcttgtttatataaagaaagactaaaataaatactttaacctatatagcttgtaatttgtttctaattaagatttcattatatatagcttgtaacttgttactaattaagatttgattatcatttgactagaaaatagatgtcagtggttttggatgtacatttggtctcctttgcaaaagtggcctaaagttttgttttcaaatcactttggattgccatagttgttcatatgacttcactggttaaagatgatcagaataaataagtagcatctcattggccccttcctctcttaaaacataccagtgctgtattctagtgtgtggattgtagttgatatctcactctatatgggcatttctttgtatcaggtaataatactgccatcaacacacattcatttagtccctactacatgcaccttttgctgcaagtaaagaaaatacttcataagacatgtagatactttatttaaggagtttatgccctaattgggaaagatagaagcctgtgtaggatgaggtgattgggaagattatcatggaagatttcatggttgacgtataacttgtgaagactagtagaatttaactgtgtagaaacgaggaggcagagataggtggagagacaacatgagcaactgggttgggaaagaaatgagtgacaatgggttaataggaaggagaagggaattgaaagccagggtagtgtatggaattgatgaatgataatataatttccaaaattacttctttaatgtgtgttctgaagggaggaagggtcccttgttcaagtaagtgtgttaatatacacagtgagaatccaagaagggacagtaacaagcagaatatctcatacctgatgggccgtctgtatttttggtggtggggtgaaggacaaaatatatgttgataagtactgttatagaatattgatggaaccaatataggatttagaggatctatttacctattgttttaggaagataaatcttctagagataaactggatacatagaggagtaaaaaatagtagctcttgaaatctctcaggggagagctgatgacagtccggtctggggtgataacaatgactttagaggataaaaggtaaattcaagacccttttcaaacaaacaaatgaaaaacctgtaggattttgtagcaaattgcaaagtaatggtaaaagcgtacagtatatggtgactgaattcaattcttgtttgtactcttcgggataaaaagatgagaaatcagaaataagcccttgatgctctgtttgaggagattacaaatatgttggtgctgctaataagactgagctcagatacagaggagctagtgctctttgggagaagatggcgaattaaacatgtgataaacaagtgcagttggatggtaggactatccagcagttccatgttggaaattgtcctaagcagtctgtgagccttgtcctttgtgtaatcagattgctttctttttatcttttaaaaagcctgatgggaagccattaaaaaaaatctattcggactagtatggaaaaactattcacgaatctcattaaatttcacaagatttctttgaaatatactcgggctggtgtttatgatagcccaatttcataggcagagtcgatttttcttttcttttttgtcagtgacgcacatgaaattatgaaatagctttgaaatgactttaaatagtctcctttaaagccgtttcttacagagccatgtatttggcatctctaaacattttgcaggcaggtatttcaacgaagaacagagagctctgactgtgccagtttgaatcaggtataaattgcatagtaactaattccaaacttaactgaatcatgtatagcacaacttcaaggaataggtactgaagtattttgaattcttctgaaacatataaagtgtatgccacatcaaataacagatctattctgtatgttgtgttttcatgtgttgatttagtgtgtttgtgtctgagctgtaggcgtctcttgtctaccacgggggagggcgtatagcgtactcttaattgtgctgttagtcagtcctcattagcactatggtgaggaaattgtttctcacttgcttttattctgtggtgttgattaaaagcagcatgttacatgctcttggaatactctgtgtgctgacttctttgtgtgctgttccaggttgttcgacttgcagattgaagaggttaattatataacctccctgttttactcttctctcactaacataacagaaatgaaaaaaataggagatcccttagaagtgtgtggactctaagttacttttgtgtggtaaagagtaggcattggtagagaataaagacatgcatattattggaggttggtcctggtgtgacttttctatagaaggcattttaggaaactaacttgtatacagaaatcatgttttaaaaataacattgaaactaaatatgagatgatttaaggacaaaatacctactatattcctttcatggttcaaatatttggaagatatgatctttcctttggcataggcaagtcaatatactcttcacttagagactatgatcccagttgccatgaggtagaacatttgtggttctgtaaaaaagataccaaaccttatcttataaatcaaaacttttctggcttcgtttgaattcacttttattctttcaagacttaatagttttgaactggaaagtacattagcaatttctttgtccaggggtcaatgaatgagaaaattcaaggtcaaaaagatggaataactacccaagaccacacaggcatgtagagaagaactgggatttgaactgagatgtttaactcctggccaagaattcttaaccatatacagtcctccctcggcaaccatgtgggattggttctaggacctcccaaggataccaaaattcacagacactcaaatctattatataaaatggggtagtatttgcatgtaacctgtggatatccttgtatatatttgaaatcatttctagattacttataatccttaatacaatgtaaattctatgtaaatagtggtcataccatgtttagatataatgacaggaaaaaaggctatatatgttcagtatagttgctgttttttttccctatgtatatttaatttgcctttggttgaatccatagatgtggaacccagagatatggagagtcaactgtacttatttccacagccccagtctgtaactccctgtgctgtttcttagcctaatgcttttatacgtggttcagaatgggcaatatgttctatatccttaggtgtacaaataagagtatgcactatgtgaggatatgtgttcatgtgtgcatgtgtgtgcacacaaacggtgtatatgggagtcagggagctgcctaaaacagattgacagtgggagttgggcagtttgaggaagctgagcagaatgaaaaagcaggagtggattcttccagtttgtaggttgataaaggtgagctgtaaaggaaaatggttttgtcctacatgttttcctctggttttgagtcattattgttttggagccactgccatggtcatcatcaacctttctgttccctttaacccagtaatattccactgcaccagctactgccatattagtggtttacagaacccagattcagtggtacaatgagctcttgttcaaggaatgaggtttctctgtgttacctaggctggagtgcagtatgtgatcatagcttactgcagcctccaactcctgggctacagtgatcctcctgccccagcctcctgagtagctggggctataggcatatgccaccatgcccagctaatattttatttttttgtagagacaggggtcttgctatgttgcccaggttgatcttgaactcctggtctcaagctattctcctgccttcttagcctcccaaaattacaggcatgagcaaccacacctggcccagatttcttaatgtaacatatttcgataatgacacatataagacaccctggaagtcctgcaaatccatgatgcaggatatgggtggagaattcagttttactctttttttttatttaaaccaatattttccttactgaacaatctcaagcacatagagtaatttatttttattctctggcacttgtctcccctgagtttgacccttcctgtttctccttaggacttgtgtatttgactaatagcttaccagttttcaattggaaataagtgattttttaaaatgtagttttcaggtcatctcacataagtatgttttgtgtcttaattagattttaaaaataactgattaaaaaaagtaactgattaaggtcatgtctttaattgcttatctatccccattcagtgtctaatatgatgcttattgcagtcattagtaaataaaccattaatgagctaatgctgtctgtaaacattcatgtaatctaggtgtttctactatgagtcttaagaatttcatttttaagcatttttatatctacacaaaacaagatgctcaattacaagtatatttggggaacagagaaggaagtattttgaaggcagaagagtgaaacaggttatgtaattgataagatgccataaaactgatatcttatagttccagaatattaaaagaattatgactgtgtagcacagtacagttaacaacaatcctgaattgattttacctgaaaatactattttggtcatgtactgtaacatttgtacagatacacttagcaatttgactaagtgtacatgtattaatgaattcatttttagtttaaaagcatggtcactggaatcagattttctagctttgagttgagactgtgtgatttttggtatattatctagccctgtattttagtttaagtaatttaaatgaagtaaaaaaataaagcaaataaagatttacaggtgaaatagattctaataatacattctatctcaggaaggtattgtcaggttaatatttctagtctttaaaacaggacctggaaaatagtaagcattggattaatattggctattgttatagacaactaaatattctacaatatgacattaatataaatataaaataaaatgattggaataatttgatttcaggtttagaaattattttaaaatattctttcttttattcaacaaatatttgttgagcgctttcttttttcgttagagttagcaacattaatatcacctgtaatttgtgttatctttgatctttatagtgctctaacatttacaaaggccttccacatattatcttaggtggctttcctgtcaaaactatgaagcagctaggaaaaatgatattgctggtttatagatgaagcacctttccataggagtgcaaaggtttacctcattgcaagaatgaaagcctaggtcacttctcttttcactgtaccataccatctcctcttatgtatcttggccaggcatgttggcttatgcttgtaatcccagaactttaggaggctgaagcaggaggattgcttgagtccaggagtttgagaccttcctgggcaacatagggagacgctgtctctacaaaaaattaaaaattagccagctgtggtagtgcgcacctgttcctagccacttaggaggctgaggtgggaggattgcttaagcctgggaggtcaaggttgcagcctggatgacagagcaagactgtctcaaaaataaaaaagaaaaatagaaaaagaaaagaagaagaagaaaatcatcttgcttacattcctgtggaacatattgttgcctctgcatgttacaatgtgatcttttggatgtagggcaaatctgtgttgacttggagtcttctaaggttggatcacagtaattccatccttattatttttttaaatttttagaaagattttctgaatattagcaaattttgtgtattttaaaattgaaagtatttgatttattgagaaaacatttaaattctgatgtgtctttttattcttttgtgtctgtcttacccaaatcctgctttctctttttattttttcctgtttgcgtatctgatttcccagcctcccacattgtagattccaagaccaacctggttatttttctttaaacacaaacagaaatcttaataaagggtggggggaacaaaactgcccatcagacatgtaatgggtttctctaatatacctgaatgaattgattactctagcagctcactcagtggaataaaaagtgaaaggcactcgtcatgtagttgtaaatttattcattgcaaagagcctccattaattttatgtaatttggtacttcccagtagttgctactggagtggttttgtgtaatgatgtcctctggaggaactctattgcatatataaattttaaagggcgaaaagatcctcagagaactcacaatcttaactgttgttttgttcctgtgtgtactctcacttttagaaatgcgttcatctgctgtatttctgaacctaagtatgtgcagaactatagcaataaaattatgtacaaaccagttgatcttgtgttccagtaactatctacctcacctcccccccgctccccccaaaaaaaaaccaaaaaaattaaaaactagtcactgtaggctctttttattttaaacccccttaatcaaatgatgctagattatatttgcttaagatctgcctgatgtcagtgtacagtaaaatgtgttttactgtacccttggtgcactacattttaactgttgttgtatctaaagagtgagatgccttttcatgcctatggaatccctgatgtaattgagaacctaaaggagtaatgactttgatgaggcagttttagccagtgctgagctctcaacttttattactgaatatcaattttgtatacaaggcccatggcagtcttaatatgccttcatattttatcttgggtgtgactggagaacagttgggaaagcagaggtaaaccattaaaatgatgaccatttttagcatttttactgtctacttgtgagtttgtatttagctattttcatatttaccatctacttgcttttgtgtgggtgtgtgtggattcttcttgcttccaaattgtgataactaaatttcctaattgtccttaggtcttgtcctatacttaagtggaattgttttcttctggaattctctttcttctgttggtagacagaatttcaaaattcagtttcttgtttgttggcatgtttgtttgctttcaattagacaattcgattttgagataactttactgagaaagcaaaagggagtaatcaacagtgacatcaaactgttttagtgcttttggaataagattaaaccaaatgtttaaattttgttgaaaagcagaatttagtgagactgtgcctttttaagaaaattacttatttgcttctgagaagggtgagatgtttaaatttgcatttgataaagtaaaagggaagacagaacactctaagttacatattagcctctttactactattggcaaaaataagttttgtttaaagttctgcctgtggggctcagcagcccctcacaatctgtttcctgcccttcagtaaactttctctgaatgacagtgtttgtagatggaggaaattaatttaattgtcagcaatagatgtgtgtatttgttatacttggtagtactggaaaatgggaggatggttacattagatttttgatcctaaaaataattatgagtcatcaaagtgccagtaaagcaataattgtgtaagacattcaaaacgtcttaggtcagagaaagaattaagtctctgagaaggctagttgaagggtaggtgataggacttatttgaaaacataattctggtttctctttttacatccattagaattgaagcgcttcccaccaaaacgattaagatctagcttgtggcctgagataaatattgattcttgaagtagaaaaacgatgatttttgaatcccatctctttaagatatgcacttttaagacttcaaatggccctaggggattttagtactttgtatggaggaaaataagcttgaatgtcttttccacacctccttttttagtattttctttttgatctttaagctaaaactttttttcatctattccatttttttaatcagctttgtatgatgaagataatgttattctaaagaattcataaactgctttttatatttaaattcttatattaattgtaaaaaaacctgttatttcttaaattaaaaataatcttcttgagatttctatagaactattgtcagcttttaatagatttatggtctcagagtgaaggacaaggtattaaatcaattaagataataattatattttgttcgataatatcaaataatatagtgacatatagtgatatgactttttaagcatatttgtgcatctttataatcaattttactgttgtcttatgctttgaaaatgtatttttctttaaaaagaaggtttgtctggatctggtggccatatcacactcatttattctacaagcgtttgttgttgccgagaaacagaatgtaagatttgtgtgcagtaggtttattggagagcactcccaggaccaacacctgtgggcctaaagagagttggaaagagggagttgaactttgatgcggtaggaatagagatgtgagtcagccctatggtgagctctggagctgggatggcttttgagtttggtctttacagtcttgcatttaccagggaaatagtgcaaccctgagtggcacagctgtgagtagtcagcagctaatactcctaaaagtcaagggaaggatatccttgattctgaaggggaatcctgactaggggatctggccagtgccccacagcatctgctgcagttgccccccaagtatcagactttgctggggacaccatgctaaacaaaatcagatatgctctgttcgttcaagaagtttacatctagtgatgaagatatattgttcaaaattacacgaattaaagcaagcttgtggttgtaatagatgctagtgcatgatattatgaaagccagtagagtaagaagctaaagagcaattatgaagctataggtaaaatacttaaaaatacatatattgctggtagtcaaccaaatctttatgcaagtttgttactggtttgccttctctaatataagttgatcgtgtataatatttttcatgctactttgtgtggacattgttttagctactcaataactgaaatgcctattaatactcaactcaccactccctggaatactggataaatctaatttagatgattcagcggacacaacgataatgttatatttacctactcacttggaagagtgttactgtatacacattagacctgattatttgagaaatcacaattgcagctatgatattttctgctgaactttgacgttgcaggagaaattgtattttctaaataatagaaaataatagataatagaaaaaagagagctaataaaggaaggcttctcaggctgaatttcaatcatagttaaaataacaatactatatctgattttaatgatctagttgccaagtgctttatatgaattattttatttaattcttattagcctgtgattataaaaacattacacagattatgtaatttaatcttcataatatctctatgagataaatgctctattatcgccattttacagatgaagatactaaatctagagtcttcatataactagtaggcagaaaaaccaagacttaaggcatcttatttgggattcaaagaatactgttgaaattgcccattctccctgccaactagtcttcaatctgtgtcacttaagacttctggacattcctactccagaaattttcttagcaaaatattatgtttatttaaaacaatgagtaggtagtggaaaaatcaaggattacttaaaacataaatgttcaacaattcagaggcaaataaacaactttaaaaagtgcttccctgccttctatagatgatgaaagttaattaatagatcaaggcaaaggactggccattactcccattcttgccccttgctctcattgtccacacagcatagagagagataattttgttgaattttactagttcgctacctacatcctttcatggcttcccattgtacttcaatatatattctttagtttggtgcctagcactccaaccacagatggtgtcctcaccaactttgttcaagtttacatggtttctttcagttcttctaaatgctaagctctttcccacctcaggcctttgcatttgctgttttctgtgcctagaatgtgctttcttctgcttttcacatgactatgtttttctcatccttcagatcttgaccaaaatgttacttcctcagcagagccagtccaatattatcgtactatttaaagtttgtttccctttttactttctgtctttgcaccctgtgtccttcattgcatttgctataatttgtgattattttattttttcatttggttatttgttacgtaggttctttacaaagctacaaattctatgagtacagggctggtgtctgtcttattccttttctttttttttttcagagcttggcagtcagtgttttgtatcagctgtggtaatataatggtctttctagtccagccatggtgaatttgacatttttacttgctttttgtttttaggccctttaaatgcagaacaaagatttaaatttaaatacagaaagaattgttcattttattggaaagtcatatgggcccttatacagtgcaaagggtatattatctgttatgagttaatattcattttggttgaaaatttatatattatcctctataacatcagtgagggaagctacacatgaagtaactcagttttagacagattgactgtcaaataagtaatgattattccacaagacagatatcaatggccataatatgctatattaatgaaatacgtttactgagcatctactttatgcctagccaccttttagtttttacggttatagagaaacataaacaatctttcttcatggaattcatagtctaatgaggggagaattattaattagaaatcacttttcattgcaaattgctttacattcatgtccgtgctaacagtgatacaaatgcacatattatatatccattctgtgtgtgtgtgtgtgtgtgtgtgagtgtatgtttaggttctgatattgtttatgctcatataggtctggtagccctttcagaagtttgaattgacataaattgaagactagttggcaggaagagtgggcaacctcagtagtattctttgaatcccaaatgagatgccttaaaaagctattctcctttaaatttactcctaaggcaattcaggcccatacctaaaatgaattagatggatatagcttattgtaaaaagtgtttagtttcttaaattgtgtaaattgtgcataatttgggcagtttaaattcagatatatcttgtcttaaaaagtcttattttgaagtagtctctcaaataatatcttccatgtgttaataatttacatctttaaaaagatacctatctgattcactcactagtagtgtgtatatatatatgattgaaatacttgtaaagagtgcctgtttgcaatatttattgatgtattactctattgaaatatcttcacatttcttctaattgtattagccctgtcctttaataattttagaataatattcagactcttattagtttgtagttagaaaatgaaccagcagagaatgttttttgggcaaaaaagctgtgattaagtaaaaggtaattatatgatgctaatatttatttttgtacgtcttttactttgagcctgtaagtttctcactgcattaactgcgaactgccttaactcatgttaaaatggttggagtctcttttagttttattaatttgccaagcaattggttccactttgtgataaaaaaataaaaattgatggatactttaattaacctaaagcatttaataaaaatgacccgatttacaagaaaaaaaaaacattaaaaagtggggaaaggacatgaacagacacttttctaaagaagacatacatgtagccaacaagcatatgaaaaaaagctcaatatcactgatcattagagaaatgcaaatcaaaaccacaatgtggtaccatctcacaccagtcagaatggctattaactaaaaagtcaaaagatgacagatgctggtgaagttgtggagaaaagggaacccttatacattgttggtgggagtgtaaattatttcagctattgtgaaaagcagtgaggcagttcctcaaagaggactactgtttgacccagcaatcctattactgtatatacccaaaggaatagatattattctactgtaaagatatatgcacacatatatgttcattgtatcactactgagaacaggaaagacatggaatcaacctaaatgcttatcagtggcagattggataaagaaaatgtacatatacgccatggaatactgtgcagccataaaaaggaatgagatcatgacctttgcaggaacatggattgtgctgcagcccattatctttagcaaactgaagtgggaacagaaaaccaaatactgcattttcttacttgtaactgggagctaaataatgaaaacacatggacacaaagagggtagcagcagacagatggtgagaggagggagaagatcagaaaaaaatatctattgggtatgacgcctcctacctgagtgatgaaacagtattaacaaaccctagtttgtgtagtatgtcaaaccttcgtgacatgagtttacctatatcacaaacctgcacatgtacccctgcacctaaaataaaagttaaaaaaaaaaaaagacctgtaaattcctagattaggactaaacgttttcatttgaattaaatatttaatcatgttgttttatttttatttcattttatctttttttgtgactttcagtatcacacatagaggccagttaccttgataatagaaaatgaaaagtaaacattataggctgaattccttatagaagtgaattatcaaaaccattttaaggtttatttacattttcctttaaaaatgcgaacaaaataaacattatcctgaactgctacaagaaaccaaattgttaaatgcatttattctctctttaaaatgttaatgacttagtttcactgttgtgtaaagagtaattgaagatctaagtttcagcttgctatgtcaaagagcgagcagttggttccatttgccctggacttttgtggatttagcactaaaagccctgcatccagggaaactttctccttagtcccaggtaaagtgtaaagtaggatggttggccactctaatgtcaagctgaaaattcttcttactagtacactcttccaatcatgtgtctagacagctattctttgtatctgtacattttcaaattctttctaatatgaagttttcagaaattaatttgttttatactttaggtgtagtgtcttatagttttcctatgagttaggtggcttttcctttgaaaatggttacagattaaaaaacaaagtaaagcaaaatctcatttgtatagttcatatttagataattaatttgggtagatagcagcctaatatgtagaaatgaagaagttattttaataaatactagtaaatctgtatggtgtttttcatttattactgataatttctttttctgttgttagaataccagaatatagaccattaaaaatggaaaaacatcagttttaaaaattgacattttcagaataaaagaacaaaaaataataatagtatgtttttatttaaggtcatgaaactaatttaaaactcaagagtgttaggaaggaggttttatatagaaatggaaatgcaaagagatattccttttttctacaaagctgatctgtggtatgaccataagctaattgaaaagaaagcatgtaaaattaaactcataagtgtttggtttccatgtggtcagtcataaggtattgagaccaaaacctgactcatgtatgaaggaactaaaggtggtcaggttcaaggccttccaactagagataaagcatttatttctattgcatatactcttgctgattttattttgtctcttagcattgtcactttgtgtgaagtagctacaatttttttttgaagaaaataattccaactttgcccagtggccaaaaattatactttaactcctgacagactatataaaaaaatgtgtgcctctggtcccaggaggaaccaaatggctcagtcagcacaattcatcattactactggcaaaaataactcagcatgcctgcgctgcttggtggtgagtcagtggcatcatattcatatactgacagcaatttttttctttttaggaattaccctctgtatcctgagccaaaacacagagcagtaagattaaattaggtatcagtgttttaaagagcaaaggctgatgttattttaaattattaattcattttaaaaggtcaagtagggtttaggtgctgaggtgatgacagaggtcaatttgatgatggtcttgatcttggggagcttatatcttatagaaaatatgagatgtacttaggtaatattttcagcacagaatgctgagttactggtaatattcagtgggagttcacagggaggaatgagaatgaatacttatgattgggagggtttgttttatttattcagcagtttgaatactactgtgttttaataggaatttttaacaaggagatttaattgtagctctgactgatccaatagtccagcagaaatttactgaacaatcagaataagtgagatatttaaatgaataagaaatcactaacatacattttgtttcataagttagtcatgatcccatggagggacacagacaaatatcaagtatttgcagcaagatatgtgttataatgcatttgtaaaggatacaatttctttcttatggtatatatttgccttaagcatttatatgtatttttttcatcaaagccttctatagtcactttcgttcaaattggaaaatgcccaccacattctctcattacaaaagctagtcttcatttgtcaaatcaataagtcaaatgagacttaacttgagtaagaaaaagtatgacttcctttttcagtttaaataaactaactatacctccttccctagcatctcatttctgattcctaattctaagataaatggactcattgataaatagtctgacttacagataaaatcatggagtctgttctctagttagcggcctgataaactaaaaactgctgccttccccatttcttgctttgctcttacagaattctccccctagaggaaagctctcagttgtctccagttgcttggtgctcaggagtttttaagccctggccagtgcatcattgtaagatttgtaacctggagaagatcatttgtgaaagagcaagtggaggtgggaaagaagagtggtcaaaaagagcattctgaaggaggtagttgtaggaaagaggagaattgaaaatcgtggatctggaaattgattcctgtgaaatcatccatacccatgtgtaccctggaatgactttgcattttgaaagtgattcatgaaagacagattatgaggtatgagtaaaattttcctagatgaggagggaaaaggagacagttaaatagttcagagaatacacagaaagtcttgaaacgattgtgatgtattcaggaaaagtagaaatcctcattgtgtcttcaggatagaggtatgatgtaggagtggcagaaggtgagactagaaagcagattgggttctgtttgtgaaaatctttgcgtgctattctagtaatatgtaatttagactttacctatgcaggcagaaggaagacacagtgaccttttagctcggaggtgctattacaggcaggtaatttatatggcagagtaaaggatggagtgggtaagttgggagatgagacaggaagcagacacacagttgggaggctttattcattttttattttatttatttatttagtttgtttgtttatttatgtatttatttatttgaaacgggtctctctctctgtcacccaggctgaagagcggtggtgttatcatggctcgctgcagctgtagattcatacatttaaaaatgaacaatattttcctccacctctgaaattgagatgcaattgatgataagttataaggttattggtgatttttttttattttaaagatacaaaaattaatgatataaagtctgtgaaaaatgtaattcaagtagaggtgatgttggcccaaaaattaggaattgcaggtggggatggatagaattttagagatatttgtaaagaagaaaaatctggttgacatattaaaaatttctagacgtatgactaaatgcttctaaatattagaacttaaggtttatgaattattgaggcatttatgattctgctgcaaaatagattaaaaaataatccagatctcatggaatcacactgttgtgagttctgagaccttaaacaaaaaacattttttaataaagaaggaactgtatttatctagccacctctctttatgtatctcaatactggtgataaatggttccaaatatagttttttcttctttttaatatctctctctctttttccaatctcttgggcattttcttctatcctttcccaatttttttcgttactatctcacttttctttttgccctatttgccttaaaaacaactgctactcacaaagcactgtctaccttttgatttcctccttttctacctctccccattcctactgcccttttcaccctctccattgtggatgaaactgggaatatgtacagtacagaagggaacagttaactcaacatttggcccaagggttatagtggagactgactcctaagagctcaatttatactaatgctgccttttgattcattttttttttcacccaataccatactgccaaactccctagttgtttcttcaagtcagggtttacttttgcaaagaataaatagatcaaaataggaagcaaatacagttcttgaaaagtacaagaacttttagagagaagaggctatcataaaattatacacttttgctagaatgtttatctgattcttatatacttggtaattaaattctgaagaatattcactttctttgtacaggggaatcagcagcatccagaaccttgtatagatagctggcttcttagacccagcctggagactcaagctgtcttagctttggggctggacagttgaaattccattcaaaaccacaaggcatttttcttttaatgtagtttggtgtgtgtgtgtgagtgtaaaataatgaataaaagttgtattacacttgtcgtgttcaatttgtcacttaggttgtattgaattctttttcgattggtccctaaaaaatgttttgtgttcttgtaccacctgcagcacctattgaagagatataatttacttattaaactgctgatcattttattttacactgcagttatttgcaaacccatataataatactgtagaaacagcttattgttttagtgctaagtagagtgacaggagtttgcatgctggttgtccaatcaaaaatgaattctcaaaacagtccctcacattttattaattggaaaatcaaaaccagtatctactgggacagcaccaactaaactttctggtggaggttatctttgtagagtttgtatttacttccagatcttttctattgaaatggctctttcacagtcatttatttgccattgactgttgttccctggcaattaattaagaagagggggatagagttcacttctattaggttccctgtccctaccccattccaaagttaaaatctttgatagttggctgtttgtgaattgcagtacatgcctctaatccacaaaaattatttttttggcaggaaagaaaagccccttttttatgaaagattttttttccctaaatatgcatggagatattttgttgtgatttctcaagaactgaatgagagtcccaaattaaaataatttgaaaaaagaaaatgtaaaattccattttgcatggtgcctttaatcaagactctaatgtcatttgtttggttattaagtttccatgtctaagattgaaatggtttatatttaaattaaattatataaaaatttatatgctatggatgctatgtgttcataattttgaattgtgatttaattctcataaaacttcacatattagcacctcaataatttttgctcagaaatgcagaattattatagttaaatagcagagtctctgaaagtatactctgaaagagcagtctcatggtgatttcaaagagagttctgtttagatgacaatagagaatttatatcatgaaacattcgttgaaacataagtgttttcaatatttgttgtctacttagaaaaatgattttgcatttatttaaattatttgtcatattagattttatgtgccatagaacttaactttattccatcttgggtagcttgaatcattgaagagagaatcccctttaaaaggcctgttcatagcaaagacatgaagtcaacctagatccccatcactggtagactgaataaagaaaatgtgataaataaacaccatggaatactatgcagccaggaaaaaagaatgagacatgagctttgtagcaacatgggtacatggatggagctggagaacattatcctaaatgaattaatgcaggaacagaaaaccaaatactgcatgttctcataagtgggagctaaacattgagtacacatggacacatagaagggagcaatggacaccagggcctacttgaaggtggtggggaggagggtgaggattgaaaaactacctattgggtactgtgcttattacctggatgacgacataatctgtacaccaaccccctgcaacatgaatttatctgtataacaaacctacacatgtacccctaaaacaaaaataaaagttttttaaaaaaagaaaaggcctgttggatgatgagagaagttctgttcactctcctctaagcaccactagtgtgattgaaacatgaggaagagaagttaaaattaaattgaatggccttctatgtgccaggtacatttccttttcaactcctgtagtatagaataagaaaaagagagttgatcaacaattgtactcctatatgtgataatactacataatttagtatataaaacaagaggggagacgtagcagattatgaagaaaaagcagtggtcaaacagaaaagaaagatttagttgaactttaaattataatccagtgaattccttaggaaattgatgaggattcattttcctaatcgaaatttaattgtgttgtgttttctgtttctccatacatgtgttgtctttattaaatgtcatttatgtgtatgtatgtatgtatgtatgtatgtgtgtatgtacacacctacctaccattacgctatagacatctgtgttttcaacattgaacctatcaatagagccacatttgttttatttttggaatgcttatttaaagtagatcatgtttaattgcaaaagaactataaacatttgtacctgcagtactgcgtcgtgtccatcatataaaaaaataattatcctgaaccatggacatgtttgtggttgtaaatctgttctcttttctctgcttgaagtgatagtgtttcatgatatcagtattcttcaagcatttatattagaagacaccatgaatgcagaggtgaatgaatcatgttcttacatgagagatttaactctgagaggccattgtaaataggatgtctgtacattttgaagtcttaggcttcatatgaaaaaaaaagaaattcctgtaagatctttgagtaaaaatgttacttgtaaaggatgtgccaggtttcaaggacttcccagtagccatagtatgaatacaagaaacacagttgtgcatttggaacttcaattcagttataccgtgaactgaattgatgaatttactgagttagaacttttttcgtttttttgacagctgttgaaaggatctttatagagactccttcacgtagcaaaacttttttatgtatcagtagtctgcagcctctgacttagaccatttgtgttacaaatatgcactacgtattgcacagaagcctgggttattgaaacatgtaaccatttcaatatcaggaggttctgcatttttcctgttttgtcacttttaggaaattttgccaggtgctggatatgacaacaactagggtggagaaaggaaggagacaggtgtgcgcaagtacctgtatgtgtgcatgtctgtaactggaaactagggaagattgcaagaagcctggagtcctgaatagttcacagatatcacagatttaggtcttggcagaggtgtttcagcacagatctgttcactagtgttaaagaccttcctactagggcctatatctataaggtttttgtcatgtagaaagaagaataatattactttaatattagattcaaattttcagggatgtcagcattactatcatgaccatattgtgtaacagtttattttccataactattttctattaaaaggaaatacaggttttgtcacgctcatcatgtttcttactccccacactgaaacacaaatgttcatctttattgagaaactgataacttgattgcctctgtttcacatattgatatttgctttttaaagtacattgacacaaagtagccagtattaaatctacctgtatcccagatgttttagagaagaaaaaggaaagtcgttcttttcctattagtagtcatcatatcatttcttaagtatattttatgtatacaatacacaaagacacctttactttttctattttaaatttctcttaactgccagaaaatctctgtttaccattgcttttagaactatccttaaacataaaatcctaatttgctgtgcccgtaactgataccagcattctggaaccaataaattatttaaaatccaaataactgtgtatttcaaagatacctaaagggacatttgcaaaatggtcatttgaactatgaattttaaatcatctcttggtaaccaaggcttgtaaagaactatttattactgttgttccagatcacgagactttttttaggctttattcatttaatggttacatttcttagattattagcttattcatttattcaacaaatatttgttgagccctttttaaagtgtccgtcatttttctagtcactggtgatacaaaagtgagcatatttaataaaaatatcttcatgctcatgaagcttccattctagtgacagaaaaaagataaattataaatcaaatagtgattgtatggggaaaagtaaagctagaaaggaaaaggagttgtgctgggagatgttccatttaaaacagggtggttagggaaagtctcagaacagtaacttttgtaggaagacctaaagggggtgagggagcagctgagtacttccatggggttaagtgttctaaccacatcaaatcccaaatctctgaggcaggggtgtgtctgctgggaatttcggagaggagagttgggttgactggtgcagagtgaaataggtgggaaagcagaagagggcaaaagaggcattgtgtgtggggagtgaggaagatcatagaataccttgtgagggctttggcttttctctgaaggaggtgagaaaccactggacagctttgagcattaagagttactgaagatgtctttggaaaccctaaccatgctttgtgtaatgaaacttatttatagtattggccagttcttctgcaccatcccccctgccccgatttccttatttattcagaatattgaatttcagaagactttatatttgtaacacacatacctcaaattagctacggcaggtttttcaaagtccagcttcaggtgatttcaaatatacaacagtgtgttagtgtaggtttaggcagaaaccagcctgctgctgctgtctttctccctggagcgctagcaatgacattttgaaatggaaatacagatgtcataaagctattgtagaagtaatagcttttaaaggagattttcagactaataaaaatttctcacctcaattaatagaaatgataagaaatgcagagaagaaggagtaaagggccttgactgatattttcctggattggaaaggaggagtaggggtacaacagaatgaaagaaaaaataattttgacctaaaaagccaaaagcatctcaaaaccaagatgcttaggaatcctttaaaaaatccagctggtaaagacatataattagagtggccatatgtcctgttttattcccaggacagtaacgatttatgcctgctgtcccagtgtaattattaatagcacccctttcattcctcatagtgtcctggttttaatgataaatttgtggtcacccaacatgagtctgtaactgtgcttcacaccttttatgttattagaagtcatttcaatttttggtgttttcataattttagtttaatttagagtattagtgctaattagccccaaattttgttttccctttaatttttttcccctcttggaatggttttataggtttgtatttaaaaaagattggagactgttgacttttctggtacttcagaagaatatacatttcttattttaagagatgtttatattgaagtttattttctctattttttgcctgttgaatgagagattattttagatttaaaaattatatgtggtttccagagcgttgctgttataatgatattaagtaattatacactgaagttatgaagttttcagttttcatttacgtattttataaaagcattagtttggtttatggaaggagattggcgagaaaaatgtttctttttaaagggaaggttggaatgaatgctttcatatgtgtgtccagatttgctttgcaaatacagtatcccacattgaaataccactgtactataaatattgctataacagtcttatggagatgtaattgtggaatcaggggaagagaactaaattaagagtcaggaaaccttaattctcattttgttttcttggtaagtggaatgatgattttgccaatatcacttaccctgtctgtgccttagaggtctctgacctaaactaagtcactgggctgtttggcagagccaaggagtttaatatgtttgaaacaattttataagttatgatttctatctaaatctgagattgcattaggtctgagggaacaaggaaagcccttttaagtgagatagttacatttctttcctaaggaagttctgaatcagtaagttaattacctctctcacctagggaatcaattagctaattataaagagagccaaggtcaaatttaagccagtctttccattagtctaggaaactacttagttcatttcttcatgggggaagtgcaggagttaatgtgaatagtttgacaggtttgacagcttgggcaaatagacctaagtagacctttcacaatgacttctgtaatttattgaaagtaatgtgcattaatagactgtcagagatacccaaatgtctatctttcacatacaaatgatttttggattaagtgcaccactgacctgcatgattggcatggataattaaattttaacttgtgtctttgcagctaatctagctcttgataactgtgtttcagtgtaggacatagctttcatcagatatactggagcaaaaatgaatatgtttacataggctaaagcatattcctttttaatgaaagttcgttcatatttgtatttattgattaagagtagatcctcatactatccttgtacgattggcctatctttgatgtaaatgatatttttatgaaacacattttcatcagtgcaatgaatcatccattcctggatacctgccaatagatagttatgaccttggaataaaataacaattgggaaaaataatcagatttccatatgtaatgttgggcaatttaaaaaatataaggtgtacccttcctctagtacacttaaacacacagaattgaaagaaaaatgaagttaatcttttgtgtattattgtatttatggactggaaaaaaacaatggctaaaaagaacaattatggcataccattgttattgaatgtatttttaatgtgtatttgaggtggagttgagggtggaaagttttacaaactgagatatctgattctgtggggaaatgaattgcgtccacttatattatcatgtggttctcacatatatatttgaaattaaatgactttctctcctaactaaaggaaaagaacaatgtgtttgtcataagggcaaaactgttaacttcataaaattcctaaaataatatatatgaacaaagcagtgatttttccagtggtcttaaaaagcttgataaatgattgcaatgatttaaagtatttttagaatgcatttataatctgggtttcaaatttaaatacaagttattttatatttatgagaagtaataagaaaaattcaatagatcgttaaagaaaacaaaaacaagttaaatatttgttagatatctcttactgatttgatatctcctatttttaagtgtgtttgggtaatattaagaatgcaatctataagaaagaacacgtgtgaactttcagttatctcagctaccagatagcgaataagccatacatttcttttagagggaagagtattttgtttcttgaaacagaaaagttactaaatgatgctgttatatattatttttgtacaataagtatgttttggagttgtaaatatgattatatatatgcagtcatccttaagattgacattcacgaaccatgaatatgccttacatttctgtgtgcccattgctggtgttggacttgaattttttatgtggtttttcaataaagtagtctgtttagaataatttcttcttatatattcttttttattttgttttgttttgttttttagcgaagtgaatggaattctcagaattccagttgggaattgtggttgtttttaaattcttgcatctgtgaagggaagccaactagaatgctgtttacttctcaaaatatgcgttttattttaaacaaacttttaagtgatatgacctagaatatgtcagatctgacagagttagaaacatttgaaatagatgtaaaatatcattttactaagcaattcatagggatagacttacttatttctgtacatagcactacagaggcaactatatatttcatataattccatgtgagtcccttggaagaggcactatagcgtggctgcttttttatggccgtctgttactctttctatcacaaaatttaacactttacacaatgtacacttggaattagttcttcctaccacttggtaactaatgaaaagtatatgtgaaacttagaatctatggaagcaagtcatttcataggaggaatttggaagtctttctcttaccaaattataatatgaatgatttttgcttagaattgttcaactctactttgacataatttttgataataaaaattctattcactggaatttctgttaaaatactcatgtaaagtggctagaaacagaatagttggactttctcatgatttaattcaaataggacaatctgtttcaataaaactacaagaggaatttaaggcaaaggtgctcatttgggcttagcttaaatttttataatgcaaacttggaggcaaaactgtgactggcacacctgccataatttaatgtgaatgaataaacctttgtgtgtgactgtgtgtgtatgtcagttattgatagagaatgtgtaagagagctgtttgataacagacactgtcctcaggtgaatcaggaaattggggaagtaaaataaccaattgtttcatttgcatgtaacagataggaagaataattaagaaaaacaaacaaacaaaaaacacctgtttgcctagtgtcagttgcacccagataagtttatttttctttcagcatcagaaaagctagatctttttattaaaatccatttatctctagctgagatgcatcagtgattctgttaaataaaatttagtgttaatactgttatttgagagacattttagtttgattataaagagatagattcaaatagaactaaaaatggttttggtaaaaaaggaacaggttaattttttcccttctcatttgaccattattttagctattaagtaaagtaaacaaataaaaaaaaaaacgtgctgtcaagtaattctgaaaaagaaagctttgggtatccatagaattattttaagaaagtgttccctgaccttgtctcaaaggatttgaaaaatgtgaacatcttttataaaaagtaggccactaaatctgatttcctttatatgaaaatattcgtatgtattgtaacaactatataagtggcagttaaatatgttttcttcctaagtgtgatcatctgttttacacttaattgaagcaaagttcttccagttttctgattataatgatgacatggcgtgcaagaaaccagagcgtgttaatcaaaccttatgattaagtacttaacttcatggaaaatgatcattatggacgttcagtaacatttatttggccaaattacatgtaaagttagttccattcttaatactataaagctatgcatttgtgtatctcattattgaaggaaatttagaaatcttttgagtttgaattccctcatttcattttgcaatttaaacaatacttttagaaaatcagtctgcattgttacatggaatataatttgtcaaccagcctctcccaagatgacagtactgaagactgtaatgtgtttcaaaatattcattttattctaggtgttgactacttttaggattgccttaattaaaaaaaatagagcttctaggaataaaagttttattgttcaccatggatggttgagaataatataatttaatacctcatttgaaataaattacaagtgacattttcttgtaggcttttctactgaaagctaggtgaaacagaatatgtacttagtttaatggtgagattttatcaaaatctagttatttttaaagagattaattctcttctgtctttgcctccatgctagtttttaatattattcacaagatgtgattcagaagctgtctcatgaaaataatatactagagctttacttttaattgtacttctgtgtatctgcaatgttcattatactctagaatacttcgtgaagggagaatagattttattaaattgtgaagcatgcaatctgttaactattaagtagaagaataatctggattatacatagtatactttccagatgcagtgatgaaataggaaactttgaagcacaagaccataaaattgtagcatatcagactttgacaataaagccccagtcacacccttccattttcccccattgtatgccctgctgcaaagtaagattttaactttgatttcataacacctagctcagtgtcttgacacataataggcactttaacaaaagctttttagtgaatgaacaaactcaaatctttagcaggtgttttcaaagggacaatgcgtttatttgtgctgggaagaagtatgtggatagccagtaaaaactatggagtacaaatagtggtagagaatattcttgtatttttcacttgtgtctgctttaagacttttgaaaatgtgtatttctgtacatttcagcacttaaaacttgccactttttcttgcatacccatttacttcattttaggtctctattcttttttttctcagagagtagtttgctttacagtttatcccaccactgaaatattatttgagttcctatcttatcgggatgttggatgaactatattttccgttattatacataatttttttcctttgttttttctaaatgaattgtttctggaaaggaatttaaactgtgagtaattattattcagctttcctagtgtttgtgaaaacagaagttgacctcatatggtgagagctatgggaaaacttgggtgtaacaacaacaaaaattaagcaaagggaaaaaaaatccacagtaagggcaggagagtatgtttcaatcctttaacattttaactctgaaaaccagttatttaatgctaaaattcagtttttaacgggtttttaatgggagtttttaatattagctgaatagtatttgatagtaaagaccaattatcttttgatttaactcaggatttgctgaggttaaatcttattatttgggaaaggggcattattccctcttccattattattgaggaggaaaactagtgtattcttcatagctccatttaataactctctcttcctctcttttatctttcagctttcccttcacactcattctttgacagtttctcctcttttctctgtttattcttccatcaagtttattaagaccctgttccttgctgggctcttccaagacaggtagttcatcctcaagttccaaaaaatgaagatgagtaataagactatttcatttctttccttttccaaccttgacaaacaagtcttttattatgatatgtgtcccttgagcgtcactcggggcctctgtctggcctgtgtctaccccatgcaggaatgtagaaaaggtccacagtttgactcatttttggggataaggatttcaggccctcagtttctgcctcatccagacacttgtgcagtagtcacactgtacaaccgactgcactggaccttgtcttaggctgattcgtgatttaaatatgttcccctaaacctgtagatttggggatgtatctgggatttgtgcaacagaagaaatggctatatatgagagataaatatgtgaagcccctgaatagcttttgaaaacgcaaagcgatttgaagattactgtcactgttggctcattttagcaataaggaaactgagctattgagaagtgaagtgaaatgcccacacctatgtagtcggtgagtggcagatccttgactgattctctctgctaacttgagggccagtaaacactacactgtagtgtttcaactcactcaacatgtaaacagaattagatttcatagtctaaatattgaatatgtttctgaaagttattttagaatactagttttgtttaatagattaggtagtttagaagagaatagtgtgaacagttgaaaccaaatatacctgagtgtgcatccaaactctgctacttaatagtagagtgaacctgaacaggttatttaacctctttttcttaatctgtcaaacaggaacaataaacacttattttacatggttgtggtggagtcaggccccaaatccacatattcagaactattgataccagagtaaagtgctccagggataaatgaaatccacagacaatgtccagcctcagtttatctgctactgtggctcatttcttcaacaaattttagaagtttctaagagctagcaccattgagttgattgatgctcctaaagagcatcttttacttacgtaattttttgaacatttttattttcaccgatcattgaattgtgatattcatatttgaacgtgactttaggaaggaaatgtttttagtagcttctttgtcaaaatggtttctgatatgatttgccataaatatatgtggtgattttatttaactgtaagaagtaggttatggggctggccaggtatggtggctcacgcctgtaatctgagtattttgggaggcccaggtggactgattgcgagagcccaggagtttaagatcagcctgggcaacattgtgaagcctcatctctactaaaataaataaatgaataaataaaaaataaatggatctggtggtgtgcacctatagtcccagctactcaggaggctgaggtgggaggatcacctgcactggggaggtcaaggctgcagtgaaatgagattgcgctgctgaattcagcctgggcaacagagcgacaccctgtcttaagaaaagaaaaaaaaataaaggaaagttttataatctacaggccatttttgtagcaattgagcagttctacaaagtggttttgaaggactcacatgtttttggaatatagcaccaaaatctcgtgatctgctggtgaaatataattcataacaccatgattgggaacagtaaagaaaatacaggattcaaaagtgtataattatggtcatttgttatcaccactagttccttaatctgagacagtgtcatttattatgcaaatgagaaggaaattatgtaatttaagtttatttgaggaccatgttactattttcccttacagggtacaacgtttaaataatatttttcaatgagaaatcatttataatgctgcgtaatttattgattatgaaatatctttcctttgcattcatatgtaggtcagccaaaaaaattcatctcaaaaagcaccgtaatttttagattcttctattagatattaaatcttggaataaacatttaagatttagggactttctcttttaattaagcgagatagttgtttaatacaagatgttccaaatttggtaatgatgcagtctgtcatctactgaatatgtcttctcttcactccttagtgcttttgttgagctttggtgatacaactttaattttaaactgatcacattgtttctaaatctttgctagatggcgttcatctttatactatatggaaaaatatgtcacattgaaaatagattagtagtgttttaaaataaatttacaattatatcagcaatatatttgttctggagccatttgcattagctttattaaattagaaattttttaaatgcttacatgatgaaaacaactgaaggttagttttatttagttagaagggacattaggattagaatggtcaccaagtccttgtctctggtacacataattgaactttctttccccttcatttagtttttttctgtaccaaaggaaggaaaatgctttcactgtaacaaattaagagtaaattatattttgcttacttggtaactggattgttaatagataattaagttgaagagaaaaaaatagaaaactttcgcttgattccttttctaatattagaaatgaggaattgggaagaaatcgataataatgcatgtaattaaagcattctgtgttttggtaaaaacctgatttagttacatccaaatattagagaagtctatttatattctctgatattttgcttaatgcctttggctagctgaatagtttttgttttaatttcatggcaatttgcatttatttttaaaactttgaaaacagatttctctttttggcttcaacgcacatactacatttggtaaatgtaatatataacactgtgaattattatttatattaattataaatattattgtaaatattgcatttggtagaaatgaatttccctcaaggtacactcaattcagagaatatataccagacaaaatctcaggaaaggacatgagagttttcttaacaaagaggtacattgttatgctgttacaccttaaggatgaaaatgtttgattattgctattagagtgaatagtgtttccctaacattcttctcttacattttggctaaagaattatattaatttaaatgaaaatgaggtaaatgtctaggaggaaaattgacctcgctaattataggcatgtgcttaatcagtgtcagtgattgtggatttctatgtagtcagagcttatcaaaataagactttcataacaaaatttggccctttgcctttgatcactgattatttcagtgagatctcccaggtgattttggtggctagttacatcattaaatctatatgaatgactccttagaacacattggcttgaaaaggggagcttttacagattatcctgctgtgggaggagttagtttcattattgagttttgagtttcatctaataggtagaaattgaacttgctccctggagacaatgatcagtgcagaaagccagcacgtcttactgtatggaggtcattgttgaatggtggcctatcattagtcttgatcttttttctggtaactcacaactcagggagttgctatatgtttctgattttgctctcactttatgaagtctcataatgataatgataaatgtttattgaccacttagtacatgtcaggcattgttttaagtttttatattattattattattattaatcctcacaaccactttgtgctgtcattatgcccattttacagatgaggacactcaggcatagtaggattaaataaattacccaactgtccagtcctggtaggtattaggaaaaggatttgaatacatgtaatcggagtcttagagccttggggcaagcccaactttgtaacccaagcttcttcaatgttagccccccaaaataaggactaaatctcttatttgagagtaaaagtccattgtaattaacttgagtaaacatttaaatgactgataatcttggttatctctggctggcatatgagtacagattgagaatgtcttaacgctaggtttgaaagtggggggaagatgggagcgcctacatctgtggcaaccctgtcacttgtcaaaaaccaaagattttattttctttgcttggaattcttcaatttccttcttctctaggtagattttttagagaaataacaactacttttgataatctacaatttacaggcattttcagattaatatagcgagctttagtggagagggcatgggatttggagtcaagactctcggattatgtcgtggctctgcccacaagctgtgttatttttaccatttaatgtgaactcgttttcttcactctcttaatctataaaacgaacactgtgatacctattacatagggttattctgaagactgaatgaaatcatacatatgaaaatgtgttaaaaaatgtaaagcatatgtggatagtgtcttatggttgttgggtttttttaagttgaaaacctcatattcataaaagagctctttgttccaaatgataacttttcttatgccctgtagagcagccaaattaagaccgctagatcagttttatactgaaattaaatattgggaatttacttatccatcattggtttgaagatacctaataccatttagtaatcttcaaatcatatttgacttaaaccagtattatacgactacagtcacatactattaagaaaacactgtgtgcattataggttaaaggatattaacttttattgcatggtcatacactgtttcatagtatggtgcacatatgacttaatagaaatcaggaataagaaactttttaactgttttcaaactgatgaacaagtatagtatgtcctttccttaaaaaaactatcatatttatgactttgattaaaatttctggctagttttactgatggtatctattatagaacattcatgtttgcatgaactaactcaatttgtcaaaatgattagctatttgtttatagtgtactttctgaagacatactttaagatgtgtcaggaggactgagttttataggaaaaatgttgggaaatgaggcatgattgatcatcctctgagataccaaccagacatatagattattcagatcgctaagaaaacttgccataaataaataaatttaaccgtttataacatagatgttttggagctcctgcccacccagattttttttttaataaaacatctattaaaccagaattatagttgggaaatactgccgtatacataaatgttcttggaaaagcccagtagtttaattgctgctttgagccttccactaaagacacattatactcataataaaattctcctatttgcccatgataatgaataaaattcttgtttagacaaccacctttaggccgtcttttttgttctttttttcccccttcaacttttaaatttaggggtacatgtgcaggatgcataggtttgttacgtaggtaaacgtgtgccatggtggtttgctgcacagatcatcccatcacctaggtattaagcccagggtccattagctattctacctgatgctctccctcccctaacaccctccttgacaagccccgatgtgtgttgttcccgcacatttaaccatgtgttctcatcattcagttcctactttataaatgagaacatggcctatttggttttctgttcctgtgttagtttgctgaggataatggcttccaactcaaaccatgttcctgcaaaggacatggtctcactgttgaggctatctttgtcagttgccagataagttccatcctgttagaccaattagatggtataagcatttacttaatacttagggcttttgtgatatatatgccaaatgagagttttcaagtataccccaaaatgcaggcatgtcgaataaaagaaatcctgtgggaattcactgaaatagaataatgacaaataattaagaatatataagttaaacaaatttgaattcatacttcacaccagtattgcacaaagcacttttgcaagtgtggtctcagttaatcctttcagtagcttctttagtaggtattacttactgtctccattctacaggtgatgaaactggtttcttaaaaattttctcaaggacacacagctattaaggctattatgtgaagataggcaattagataaatcaaaactaataaccatgacagtttgttgcatgtagagctcagtttctgctctgtgttgctggaaattctcagcagcaggttaactaacatgctttttaaagagtaaaggcagaggaggcacattttaaacaaaatcacaggccagtctgagagggaacagctagctttgatggaagtatttattttgtgtagaacccaagctcagtgttcatacgtggaaataactttgagggactcatttatctctggatcaactcatcaaaaattaaattaaaacaaaaaatatgtaccttttacaagctgaatactgaaccagttgttccttgtaacattttggtctcttttaaggctgggagcaattaaattaagcaggcagaagagccagataagatattcaaggagcaaactgtgcttgcagaataaacattattgcatttagaaaattatgtggtgagatgtgaatcatataccagtaaatcactagacaaatgtttttttaaggctttctatgtccatcactctgggtagggaatagtgaactcaaaagtaaagagcatgattcagggaaatctggagaactggatgtgtactttgggttcttcccttaattacctttggatcattggatgagtcacttatctacagggaggggatagcaagggttaaaagcacagccccaaagcaggggcctgatgtgagccctggcttcccctgcttatttgctgtgcgatcttggcaaagtcatttcatttctctgtgcctgggttttggaatataaaaagtagaataatagtacccaaatcacaagactgttgtgaaaattcagtgaagtaaatctgcgtaagaattgactacatctcagatactgttctaaacaatttatatgtatatatttacttaacattttatcatttcattgttattataattactactcttactctctttgagcctgtttcttcaactagaaaattagaacatgaaattggatgatatttaagaacataactacagatgtgtaaactttttttgaactttgcagagaacttgtctaatgatttgtaggccgccttgtaagagtaaaaattaatactggcagcgaatgttttatattttaaagacaaagaaataaacacaaaccaactaaagaatgctgtattttggtaatcaaaatatatttttatgaagtatttagtaccaaggttgtggtggatttggatggagagcaagctttgtgtgttttgagaagttgtgctatttgaatagggatgattaggatgtgtggccaaggaggtaaaacaaggtagttgttaatcataaggaatacttatgaaatttgtgttgtgccagtaatgggccaagcaccttacaaatattagtttgtttaatcttcaatggtccaagcactttacaaatattagtttgtttaatcttcagctatagcatagaacaattaaataatgtgctcaagatggtacggtttacctaggcagtctggcttctgagttcatacttttaactccttcaccttactgtctctgaaaagcttgaagaaatgtttgaaattccctggaatacttggggtactgagtaattgattatagccggaccatagagtttgaggatcaggtggattaaggtgagataatcctgggaacttggagaaatagtctggtcattatcataataatccagacggggtaactgaggaaccagactagatggttactatggtaatggtgaggaaagcttggtggagtggaccttagcctctttgggtcacagactcttttgagaatctattaaattatggcctttcttctcagaaatttgtgcaacacataaaattgcgatgaaatttcaacaatctcctaaaccctttattcgatgctttactcagctttgcttttccttttttgtaataactagttttctgaagttctgtaatttttctttactttgtatttgttttgtgttctatgtgttctcttttaataatatttaaaaatatttcactttctttagatacctgttcatcagtcactaacaaaatctaattttggtgggctcttgatgacttacttaacatatccctaattattgcagtgacattttctatatttttcttcttttgtttcttgagtacaaaagtgatggtagaccttgtggccagtacataggctatctttacagtgatccacatcattctatgtctattcatatacacttcttatttgtatagcagcatctggaataggaaaattatgtgcataaataaaatacatcaatcttacattcaaaattgtactttaaatggcttcttgtcgtgattctgatccaaaattttgtctttgcttctaggacatacttttttctttcttgagcatggcgatccccagggtaattacagtctagtggtaagggagttcagaagaggttgggtgactgattattgtttgttttgtttatcatttggtgtgacagtaataattgggtcccccttggctatgtagggaataagtattgccaatacctttgggaaattgctctagtaaaactcacatgctatttaggattttgctttaaaaaaatgcaatgtaacttggcagtttggttagttgaactcaaatttatattcctcaaatcataaaaaattgtttattttctccttatttctttgattattcttgaacttttattgcattttggactgttaaaatctctattatggaagtataaattatttctttctaataattacaaatataaatattctcaaaaatcatgagctattgaacagtttgttttgaagaatatcagaaaagcaattgtagaagtttctatattttctgcctttgtctttataaaggaaagttgcttttacatagtttccatttatgtaatgagtagaatgtgagatttttcttcctccgatatgtaatgaatgcatgtaccctacatatcatttaagaaaataaacccgatataaagagtattagcaaatcaaagaatattttgtttcattatgaattactgaattcactcttttgggaatgagaaccttctactgatttgaattatattccaaaaaagaactgacagtgtatataaaccttcaattatatgccataaacaagaaatgatatatttcactgaaatcacataagacatgtatcttttaaaattatttaaaattctgtttaaagagagtatattgaaattgtattacacctttctctttctttgtaacagagagtattgtctagtaatctgtaataaaagatatttgtgaaatgtggaatgtataccatcacggatatcccctgatgttccttaggactatcgtgaaatatagaactgaatatatgcacactgaaatatgccatgccagcatccctttgtatttagtgtgctaagaatggctccattcctctcctgtggaataaaggacatggattttgtggtgaggtttctcaccattgctctaggtgtggaactgcgctgtggttgttgagaacaatgggaaccaaagctctgaataaatggagtattatcatgtatcaagggacttcaaaacaaaatacaactccattgttcgagtagcacacacttatatcatctgattgtgtgtgtgtgtgtgtgattacttttcacttaacatatcctatatcttacatttatattaacctgttagtagttctacatttaatcctgattatttcttgagttaaattttaagccagtgagtgattttaaattatgtgataataaaatatagtgtatttctagtctgctagttgtgacctccatatatgaaacttgaatgaaggcacttgcagtgctgcctaaatgactgcccatcatgcctaaatgagtgtgtttaatctggatagtgaaaaacttatggaactgaagctttttggatgctttggggaaccaaagtcatatatcatgggaattaacattattctgcttgccattatatatgtgcttaggctgagttagatactctagttattagctactcttttttttttttcttttttgtttagacggagtctcgctctgtcaccagcctggattgcagtggtgtgatctcagctcactgcaacctctgcctcccaggttcaagtgattctcctgcctcagcctcccaagtagctgggattacaggcgcctgccagcatgcctggctgcttttgtatttttggtagagacggggtttcaccatgttggccaggctggtcttgaactcctgacctcaagtgatctgcccacctcggcctcccagtgctgggattacaggtattcgacactgtgcccagcctagtttttagctactcttaacagctgtatttctcaataaatttttcatttgtgtctactggtaagatttggattcactttgactggtagcctgtcatgcagacactaaaaagaagggaaaaggaggcctttgtccccctgaactacttctgactcttgagttgctgagaaagtgttagtctattaagtcttggatattgcaagtttagcaattaaaaatgtctttttaattgaatcatacttcaataaatgtatattaatagcattcttataaactaggaaaatgttcctttaaaggaaatatttgaactgctttctgaaatcccatgtgatagtgttttaggatgttagcagtggggcactgttgtactgatgtaacattatttttattgttacagggataattttgcatcataaataacaacagatttatttgtgaccctgcattcacatatgcgatgaaaatcatttagtttttcaaaatgtttgcaatttttttttcttgtcccttttcagttttctatctgttgctcacttttgatcacatctgtctgtctactctttgatatgggccgccagcttcccccacaccatgtggcatccatggtacctttattctaatggctacttaaaagacatttacatttactaactgaaggtttcagtgttctgttgttttggctattgactatcatttttataattatatacttttagatctgaacaaggcatttttattttctattctgtcttcttagactgcttctagtaccacagaagtattaaataaattgtgagtgagatggggaaaagacaatcctttcttacattgactcaaaaacacatatcaaatgccagagtactggactagacactcaatgggacttgattgttaatccttgtacttaattattctgttttttgagtagtgatcattgattgactcattggttggagtgagatttgatgttacctgtaaatttgcaactggcattataattccagcaatctctttccttaattacttgaaagtttcttttatgcacaaaatttaccttacgtatggatgcaaattatctcccaagagtggttcttttttgaggaaaggaatgcagtttgttgtagctttattataaaattgttcattttccatttgctggattaaaaaatgcatgtttgatttttaaaccaaaattgacaagttcactttaaagataaatgaaacaattgaaaatgaaatttgagagaatattattgtaggtggtagtcattaagacattccaatttttaaatagatgtgtgaagattatgatttggggagtgaacattagaggtgcagagaattggaacttcctgcatgattctgtgttattcagatgagtaagtggttcttagaaatggtgaaccgcagactgtggatgagaacagatctggtcatcagaaggaagcaaacagtgtaagcattactgaaacgtggaaagacccagagggcctgatgttttgctgcagcctgctctagagcctacccgagtagggcatattgagccagagcaggtgggaattatatgcaaacctgggaatttagctcctgcccttggctctctggagggtgactgtcaggcaaaatatttcaatctttgcttcactgtggtcacagatacaagatgctgtatgctggatttattattttttaatggatcaccttttacatgcaaaaatggttaacattcttaaattgtcacttaagacttacattatttggtatcatttgggacatatgtttgccattttattaagaccctttgaaagaagagaaagtcaattcattaaataaaatgattttgatgcctataggtgttttaaccacagaggatggggatggtaggtgggcatgtgggcatggaaaatgtgttggcccatagagttgaatgaagaaggtaaaaggaacaagttatgtgtgggaatagattttttttttcctatcaacttaccagtttaggattgaggactaagaaggcaagtactatgttttgtaaggtttattaatacaaaggtttctaaaatttatagtgattaaagaacttctgtcgagtagttcaactcaatagctaaagtccttccttatatttcatgtcttacttaggctgttgagttgaggatttctgagtggtaaaatgtacctggattcatgtaccccagagcttaattataaataaataaataaatttttaaaaatgtacctggattaaataaagtttcagaatccctgggtactcctcatttctaaggaataattatcatgtttaaagggactggctcacttgagaaataaattcgtctagtcttaaagtatctattcttgtttgtttcttgattttcttattctcctatggcatttttctctggagaagagagtaaatgttcaaggccaaaaaataaatgtataaataaaaagcctctctctttaaattcatcccagtgaggaggatttcatgcatttctttagtttgctattctggggattagtgtaaatatcatttgctgaaaatattgttgtaataatttcatctagtatggagatccaagatagttggggtacctcatggtgtacctgaatatatatatatttttgaagaaatttaaaaaacattgtagagtagacttgtataaaacaacaattcttcaattatatatttaaattttttaagtatttgacttaaacatataaattaagacatttaatatttataattctaagtttaatctaaacattcagtagcatatatttcaaaatcagtaaatataattttgcttttatcatgcccatgtatgcaataatttgtgattggcattgtccatgtgtcaatcactggacttgtgtgtataacttttttttttttttttttttttttgagatggagtcctgctctgtcgcccaagctggagtgcagtagtgccatctgggctcactacatgctccgcttcccaggtttgcgccattctcctgcctcagcctccagagtagctgggactacaggcgcctgccaccacgccctgctaattttttgtatttttagtagagatggggtttcaccgtgttagccaggatggtcttgatctcctgacctcgtgatccgcccgcttgggcctcccaaagtgctgggattacaggcgtgagccactgagcccggcctacttgtgtgtataacttttaaattttgaacaacattaaaaaaatcagggccaggtgtggtggctcatgccaataatcccagcactttgggaggctaaggcaggaggattgcttgagcctaggagtttaagacaagcctaggtaacataatgagaccttatctctacaaaaaattaaaaaaattagtcaggtgtggtggcatgcacctgtggtcccagctactcaggagactgaggtgggaggattggttgagctcaggaggttgactgaggtgggaggattgcttgagctcaggaggttgaggctgcagtgagctgtgtttgcaccactgccctccagcatgggcaatagagggagaccctgtctaaaaaattaataataaatttttaaaaatcagcttttatttaaacttatcaataatgctgaaatattttgaaaccattaaaataacttttttcaaataatcttcagtgttgaatcattattacataattcattatataagccatttgcaattgtaatgaagtaaccaaaatatcaaaaattaaagtagtgttgtgatagaacttctcaagactgcatgcagaggaagttgtggactgtcactcatttctgtgtccttgaatccttagactcaagaatatgtggtggaaggagcatgagaaaatctgtacatgggaaggataaagaatagatatacataaataagtatatttaaatatatatacataaacatttaaaaactattttgaaattcagataataaaagaggctctgtcctgctcaggtacttattttctctaattaattattaataccttatagttgaagaataattttgtttgtttgtttgtttttttgagatggagtcttgctctgtcgcccaggctggagtgctgtggtgtgaactcggctcactgcagcctccgcctcccgggttcaggtggttctcctgccttagcctcctgagtagctgggactgcaggcatgtgccaccacacccagctaatttttgtattttcagtagagacagggttttaccatattggccaggatggtctcgatctcttgacctcgtgatccgcccacctcggcctcgcaaagtgttgggattaccagcgtgagccaccgcacccggctgaggaataattcatttaattagtctgatctttattaaataattgcttgtagcacatttcagatttaatctcaaaaagtcctgggtataatatatattctgtaagcctgagaaaaaagaagaatgcttatttcaataagtgctttgagtaccataatgccctttaacacattggtatgttatgtaagatactattttgctatatttttatgtgaacattcagtgagcattcaaatgaggtattcaatctgctagcaaaatgatcaagacacatactgtatctaacaactgaatacatatgaaggctcaggactggtatagtagtatttagaggaggtgagtaaggaggtttctgacaaggatagaagaagtcatcatagcagcaggaaaaaaacccagtaaattactaagttgtgtttttatttatagatctttgaaaaaatcatttttaaaaattttaattgtaactggatatttctgtttacaagtctaatatttaaccatacttgagatggccatatgtatttttatttgaagggaattaatatctataataaaagtgaaagactttcaaacacgcaagtgatgagtgtctgaaggagtagcgtaagtagaaccctagtaaatatgttcttacagttcttaggggctagctgtggttaatttttagctctctctcccagacagcatgttttgtgtatctttgcatccagaatatccattctgtgcataaataaacacatatcccccatactgatatacttttttttaatctaggagaatataagttaaacctaattgctcaatattagaacccaaataaaattcagtgaaaactccttagtacttacatatctctttactctttgttcagaagtagaatcagaattcacgtattttggtggtggagctactttttatacttcaactggcatatgttttacaatagacatattctacttttcataagttaaaaacaacttcatctcctggagtcatctaaaaaattaaatatttataatatactttaaataagagaaatctgcaactggatcaaagagtttccaagaattcagacataaccttaggatagagagacacaattttttcttactacttatatatttttttctcatcatctttaaacttgttctttagttttgcagtttaacactttgccaactatctcaagcaaaaactaataattataccacctggtaagctcttcagagcttgggttggcttatgtttgttatctgtggcccatttcttcctgctcctctcactgcctagcatgggatacagtgcatagttggtgcctaataggtgctgctggttgattgattaattgatatagtttgattagcatggtggactgtgacatacacaaatgtccacaagggaatagatggtgttccaatctaaggaggtcaggccagaaagtgttttaagctgtgtctgacatgtgatatgcttaagctgttctcttaacatgtgctgacataagtatctttgacagtccttgttcacacagtagccacatgaaatatgggacaagagctgttcctgtacatgtcctgattccagagagggatgaaataaatgtgtctggacttgcgaagacattgcatctgttgtggttgattgactggtgtggagcttgttaagagggaaaattaaagtgcccagcattttgtatgcgtttacttatggtatggatcagtggatctcaatctgaaattcatatttgtgtaacctgggattaggtaaaaataggccaatgccctggccctaccctaaaccagttaaatcagaatctctagacatagggcatgggcatcatcttttaaaaaagcaattctcagtgtgcaaccagttttgaaataggttgaggttttgtagaaattaaaccaaagttgggaaagaagaaaggctaagaaatttaatttccactcaccttgttctcatttacttagaaggatgcagggtctagaataccactgtccagtaaaagaaagctagataagcaattttaaatgttctagtagacatattttttaaaagtaaaaagaaatagttggaattaattttagtaacaaattttatttagcccaatatgttctaaatattattatttcaacataaaatcaatattaaaatatgaatgttatatttaactttttaaaatactgtatcaagtcttctaaatacagtgctaactgtggatttgcagcatatctcagtttggagtagctattttttgagtagtcaaaagccatatgtgactagtcagtacaatattttgtaaatatagagggtaaagtgctggaatcgaaatcaggagaccttagtgttagtttggctagctagtgactaatcctttgacgttggatgattcactcatcctctctctggacttcacttccttttatttagtatgagagggtcagtcttgattgggagttttctagttttgctccagaaagcaccaggattgtgtaagcactccttagcagccatcatcgaggagaaaggaggcacactgctttaatccctttctccttcggatatacttatgtttcctggcataattttgtttgaggggggaaaaaaaggaggaaaatataggctcaaaagatcactaggctaaatattctcttgaatcttttttgtcagcatttataggactactccaggaagaggtgaggcagtaggtagcctgtttctgatacttaaaaatatgcattggcatatttttatacatcccaggttacatgaatgtgaagtccagattgagatctactgattgataccatataagtaaaggcacagaaaatgccattttaattctttccctcaaacagtctccacaccagtgattcaatcatgacagatgcaatgtctttgcaaattgactggatttagaaggcttgatacagtattttaaaaagttacatatcccactagtattttcacggaccatcttccagtcaaggtgtcaccatggcaatgaccctcagatgtttcctattaaatagtggaatcccttcagtagtggcttaagtgactcagatttgagaagcagaaatcctagatacctggaactatcccagagtgatagtggatcacttatgctactgaacacatgtttgtggtctaaaattaacctaccctcaaactcagaaagtgatccctggatctttctgagatgtagttcccatagtcagccagaatgagggctaggattactctggctgcagggtttttgtgacttgaaatgtgtttctctctggtaaatgtataactgacaacagctttaataatagttatatagatgccaatatgggaagcatatgagtttggttcataggtagactagtaacctttctccgtatcagatagataaactctctgctggaaacagcagatagaaaaagaaacaatttcatgtcattgacccttgaaaatcagtctctgccggatttccacagtcaatgacatgagaacataatcctagctcaatatgttgtttgcctttaaagccttctgtgatgttttctgttaggagtcagtcaaggacttacatgtcccagattttatctactttgctgttttattaatttgaggaaaaaagtggcattgagtgggaattgtgaagtagagaaagctgagaaggtttctatctatttttaggatgcttctaagaagtcttagcactatattctgtgcttacaggcagttacaaaaaaaattgttttggaaagagccagcccaaatatcaacagctatttctgaatttttactaatgtgcacaaacgtaatttctctagtcctggcctgctcatgtatcaatgaaagcaacttgttgtaagactcaaagcaaaggaaggaaggggaaatccaattttgttgtattaagcgtagcaactttcacaatgaattaattaaataaatgttttccaagctgattggattctttggtctaaatagtttttgctcagtatttggcacaggtcttcatgcaggattctaggtgaatagagaaagcaaataaatgtgacctttgtaaggctggtatgctttttatgaagccaaaaggtgcacaaatacacaaatattagcccagtcttattttttgtcctagaaaacttttcactggctggcggcatctctgtgttcagtctttggcatcattactgctcatcttggttccctgcaggctttgccatctgtttaactggtaaagggccccgtctcatcaggatcccttccatccaattggaaatagagccctctgattggcctttttcctttcctttgtcccccctgtttatttggaaccagcgccaatatctcagagcaggtgtctttaccttagccagttaccttaggattagcaattactggaaggtaaaagatctgcagtggagggtggagcatctgttattgcagtgatcttggccttggatggagtctagggacttggagaaagactaattcatgaaggtgaggcactccctggggtgctctcctgttgcctctcaccttcgtaaatgctttggcactttcagatttaattctgtgatctatcttaagtttaatcaggccagcaagtgcatgtgtggcagagacccactgcttttatctgcctgacaatatattagcctccttcccttctgtgctcctgtgattcttgcctgacagttatgcagagccacttaaaccttcactgttgcctaaaacaccttggaaaatcattttttaaaaattcagctcttgcccttaccacaagcatccttttgaagtttacccctttctagcccccagcccatatcttgactcatggtctgcagcctggggaatttgggggagttgccaggtaagatattttctaatctcaaaacatacataaagacctgcataaagaaatgtggctgttgaaaaacatctacatgttttcctaacaagcatactctatcagtcaagcgaggaaaagcagggagagcagaggaaaaaaaatagaataacccccaaatgcctcaaatttaatgacctaatttcctctttttctcccctccttgtttaatcttcagatttcttttattacttactattctttggcattatacattttgtcttttgtttttgtattatgtatctattgtactataagctactcaaaataacttttggaaaataaaaggagtatttgtgagaaataaatatctctcagtattagaatttcaattctaagaagtgatttattaatcatttttacttactaagccctatcgagtactttctgggaagtaatgtagtttatttgttacaggtattctggcatcagactgctggggtttaaactcaccaagttatacacataaatcactagataattatcttgggcaaggtgcttaatatttttgagcctcaggtttctcctgtacagtaatgttatgggggctaaataagtttatatataaacacatgtatgtatgccttactcatcttacagttttatcgttgtttctgattttattacctaaacgatgcctggcataaaataaatactctataaatattagctactactgttactatttactctagttagtataacaatcctcagatagatgtaatcctcacttcacaggtgaggtaactggagccgaagaaggttatttaacctgctcaaggtcataagctggtgagtgtgcagagtgcaaggttcgcacccaggtttgtctgaccacaaaagcctcctgctcagccaccaaatctgccaagactgcttcaatatgacagcatagtgaaatagatgtggctggattgtccagaaaatcatgcttgcatccatctgtacaggttcatttcccagtttttcttttctgttagttataatttaactcgggattacaaatctatgccattagattaacacaattttttggcataggtctcctgtaagtcttgcttctttgagagacacttttaggaagggagagggccaagtttattccgttaacatcaagtgcttctcctgagagaggagtcatccagtggagatgctgtatgtctgtttcataatgcacacggcacatgaaagatacatgggatgatgtttatgctgcttgccagatacttctagttgtccagtgaatgaaccatcatgtgaaacagagaaataatgagtttttaaatagcttattggccatttattgcaaatttaacctttgtggtaccatctctgaccatagacctttggatgcagggcaagctagaggagtttagtgaatgtcctctggcggaatgagtgaatgaatgtactcacaaatgtagaggaaggcattagctacaagagagcttcttgctgttaagaagatgcgggtgagtggaagagagaatgattgcttccaagcctgagcaataattggactttgtcactgtgtcatttttaaaaatacctgtatctcgtccctgacatcctgatctttcacttttaaggaggtcccttcagtgagagcatacacactcacctgcaaatcctgatttccttatcagtagtcagtgcacttttgcctttttgctttcagattcctgctgttttcttatacagtgagtagattagttatctcagatgtgactttagttagagcagcaaatctggttgggtagaccttttcccactcctctaatcccagtagaggagcctgttttctagtggagacccatctttgcacaagttggttatggttggatgtataggaactattttctttcacagagttgattattgttgaactgaaaactgcttttcattccttttctttttaacttaatcaggatattatagatgcaagagatagtactggatgaacaagaactatcaattttgtttaagcaatcacattatatctagaatcaaaggaaggatgcagttcttaatttttgatagatagcccttgatcatattttaattcagccactctaaaaatattatattagttggtttgtgatgaggatggatatttggtggttattattgcattgtttgttgttgagttttggctaatgtaataattagacctttcttctttcagctgttccatttcctccaagtcaccggcttacagcaaaagaagtgtttgataatgatggaaaacctcgtgtggatatcttaaaggcgcatcttatgaaggagggaaggctggaagagagtgttgcattgagaataataacagagggtgcatcaattcttcgacaggaaaaaaatttgctggatattgatgcgccagtcactggtaagtcctgaggagggaggttgcccacttgtatacacattttgttgtttatagcatgaaatcaaaagtcctagttaccagtgagtcttcaaataccttacccatcataatcttttactgttgaatctatacattagagtagtaagtatattatacatatatacacatattttcatgtgttaaatatctgtaagattgcaatgctctaaaaagtggaatgcaacttagagatggtgatgatttctgaagtgatactttaagaagtgatattgtttttaagtagaaatactaagtggcacacaggatattcattgggaaagattagacaaagtatcccgagacttccacaatggttgagtaagggtataagttaaaacagtggttttcaaagtgtgatccccagactgatagtatcatcatcatcaccatttgaaacttgttaaaatatgcattcttaggccccactccagcctactgaatcacagtacctggggtgagacccaacaatctgtgtcttatccagccctctgtgtgattctgatgcacattaaagtttgagaagcactgaactttcggaagaaggacacatttttttctcttttgcccgtagcattttgtccctacaaaatatcttttttttttttttttgagatgaagtttcactcttgtcaccaggctggagtgcaatggtgcaatctcggctcactgcatcctccacctcctgggttcaagcaattctcctgcctccacctcccgagtagctgggattataggtgccatcatgcctggctaatttttctatttttgtagagatggtgtttcaccacgttggccaggctgctcttgaactcctgacctcaggtgatctgcccgcctcagcctcccaaagtgctgggattacaggcataagccaccactccgggcctttttattttttattttatttttcgtgttttagttttgttatttcttatggtcagatacatattttgtgtaagtatgcttctcttaggccataaaaattaaatattgtcaaaaaattttgtatgggctggacgcggtggctaactcttataatcccagcactttgggaggccgaggtgggtggattacttgagatcaggagtttgagaccagcctggccaacatagtaaaattccatctctactaaaaatacaaaaattagctgggtgtgctggtgggcacctataatcccagctacttcgatggctgaggcaggagaatctcttgaacccaggaggtagagggtgcagtgagctgagactgtgccactgcactccagcctgggtgacagagtgagactccatctcaaaaaaagaaaaaaaaattgtatagtatacagcttctaataccagagactttggatctactctttatggagtttgcttaatttacaggttttcatttttgaagaagctaaaaatattttcctcttaaatattattctgatttagacatagaatagtgttctttttgatataaagggggcatctaaaagtatttcatatatattagtgattgctaatttcttttaaaattattggtcttcaaatgaatatttgaatttgactgttaagaaagagataagctcttttgagtatcagactacacctttctttatcaaaatatcttgaatgattcccattctagagagattgacattatttacattttatttttgtctggcaatgctattttttcttatttgtaattcagaagtattaactatgtttagggtcaggtagaggaggaattggctcgaggaacattaacccaatattggaccagtggtgagtaagtcaagccagagacttactctgtaagttactgaccgataacttcttttgtggaattcagaaataagcgtagtagatatgtaaactctcaaaagaagtgatcaatattttataattaaaaagccactaccatattttcctctagtccttccctcctactttttattaataaaaatgtttcagtctcagatgtttagagaagagttgtactaacatttgccatggtttgcccccatttaagaaaaactgaggaattaatgtcctagttattggaaatctagatattccttcattcttttagcattttttaaagttaaaatgaacaaagactttctcttcaagtgttcataagacaatgaaaggtttgggttcatttaggatttttttcccctaaaaattcattatgttttattttggagaagtcagaaggaccaggaagccgcctagtcccctgactccctgcatctgtccgtctggagagggagtaaaggagtgtggacttgccctcacaaagcggatttagcgtgtggatttagataggtgagcaaaccatcttcataggagtagagatgaagtttatccagacaagggggccatgaggccagttctgtttttttttttctttcagctaacatggctgactagactggtagctgtttcagatttttaatttgaagactatttctgtgttgcagacattttgtaaagaaaagtatttttcctctttgacatttttttcccaaaaaatgtagttgaacttatctttgtattcttgcaaacacacaaatggaacgttgaaaaactgtggccccaaatcagtgaggcaacacattttggtgatccaatttaatgaaatgtttattatacatttacctggtacaggtggtatatatcacatacatgtgaataagacctggtctttgccctccaagggctcagaatataacaggaaaaaatggaaacagatatctaaccaagcataagtacattaaattgttgactaaattaaaggatataacctaggtgtattcaagcaaattaggaagtatccaagtggatatagctaatttaaaaccaaaatgtgttcctatcttctaaatgagtatttccttgacagtgctccttgattattacatttcatctttgagtaaaagaaactattaaatagctggggtcctacctgttgtgaatatgcattgagaacttattgaaagttatggctatggatgataaaacatatgagacatagaatatccaaggtctaggtaagggagtcagacacataaagagataattactataagttttttaagaactgtaatggaggtacctaaaaactggtgtgagaactcagcaaaaggaatgcagagagccaagaaagtattgacagattacatgatattgaattgtatcatgtatgataagtacaattgtactatgtgaaaaagatggggaaggatgatgtgagcagagataacagcacatggaagccactggtattttttgtaaagtggctagttatgttctttgaggtttgctgtgagaaggcagggtttcagaagggtatgagaggtggggtggagatgggaggatgagactgaggctggaaggttagggttaaatattaatctctataaccagcacttactctgataccattctatagggaatgggggttgaagggatctttgagcaggagagttacataatcatgtttgtggctggaatagtgtcctggatgagatgagtaggaagaggtggggaggaattcttaagagtggggtgattaggaaactttcatacttgttcaaggaagccatggcagggtagggggatttaatcctatttttattacaagaccttttataaaatgagtgttcaagttgattttaaaacatctgattagtttgtatttaaaacgttaatatctcttaaagtcttcttgaaaacagtaagatgatttgtgcagggatccaatttacatttctccctgaagttctcatattttcctgttttcctttcacttagcagagaacattccactcatttgtaatgcaaaagcagaccgggagcttaggttttttgaatagaatgatttagaactcatgttctgctctctgggcagaggggataggccagcatcagctgggcaaactgctaatctctctggtttgcctgtttcctgcagtgggggatttgtccctgggtcagcagaggattccctcagtgccggggcctgccatttagcatgtcaggcagttgccaggagaaccctctggctttgttcctggatgtgagagtggactggtggccaagtttaaggtcatggcagtccttcccttacagcagctgacgtcaattaggagaattccccttgcctgcactctgaggagagttaagcagggataggaatctggtgtcttctgggacctaaaagatcagtgtttattctcctcatagtgtcatttgtcactatgaagcaatgtggccttagtttatatggagataaaatattttgtctggggcattttgcccacttgtgattttagtggccaaatctttagggcctgtcctgcagccagagacctattttggtacccagcccactgctggcaagtcagcacatttcagtcccagcctgtggcagccacacatcattttgatgtccatatactccttaatttcagcccttggttaaaaaagtgattatattataaaaggtgactgcatgagagccaaagtcctttgatctgttcacctctggtcttgcaaggttgttcttggaaacgctttttacaaatgtgaaaagggagacaggtggagtcagtgtttccaaacttgaccatagatcagaatcacctgtagggcttcacaaaatacagattgctgagttctgcctccagagtttctgatttagtaggtctggagtagggcctgagaatttgagtatctgagttcccagataatgatgatgctctggatctgggaccacactgtgggattcattggtttaagaacctaaactgaagtctcatagcgggtaagctgaagaccttgccttaaacaggcatttatctacatatcctatgcttagctattatactacactattctacttctgcattgtagggttaaagtcttgggcttttgttcccgtgactacaatgttttcctgctcattactgaagaaaacatacaaagaatactgatgcgaagggtcctcaagaagtagaagaaataaattattttgactgttgattataatttattatattttaaataaaaagtgtgtttctataatacaagcaggcaggatgaaacagaatgcttggcatatttgggacatagagtttatgtgtgtagtttttcccagaaaaaaacattcgtagttcttttctttacaagctcttggggagtttactatagaaagttgctactggaacagtgtatcaaacaaaaaatgtaagccaggggctcaaaatcaggtatcagtgagctgagtggtaatgaatacagtattctattaagaatagctgaaccatagtaattcagtatttgtgtgtacgaatcagtaatactctattaacatcaataaacatgtagcgctatctatgggaaacatttgacagtcattacaattacgtcatggttacatgaataactgttttactttaagacacagtatacatatcccttttaacatcccttttatgttctcatgaattggtacttttcacaaataatgacatatttaagcacctttggtaaagcaatgcctgttgttttcacaggaaggtaaacatccccagaattattattcttaaaatttgaaaacaatcactggcagtaataatgctctaattcttttggagaaggctaaaatatattaaaatcaatactatcgtggctttaagagaagtggtgtttcaggtaatactgaaatgcctccagataaggaaggaatattttcttaggtactttaaggaaaaaactgtagatgttttccttggtctacccaggtaatactcatattttcaatctcatctatgctatattcatttttatactcatgtttccaatcttatccatattccatcttctcactgaagtgttcctaataatttcagacttcattgattttattctctttctgagtcagtaacatgtatggactataatgaacagtctgaaataccagtcactgactggttccgatccatgacaaaattttcactgatccagagtgaaaatttcattttcattttagcgaacatgctttctttttgtgtatgacactatggtgacagtagatcataattttttatagttttttgggggataaactgagttgtttttgttttaaagctaacacttgttaggttcttttggttttgtttttttttttttttttgccgttcactatcataaacactgtactttttaactcttagtgttcacataaccctgtgaaaaaagtactgttatcagttccattctacaaatgaggaaactaaagctcagtgaaattgtctatcttactatggttacccagctacgaagtgccagaattgggattaaatcccaagcagttcaactatgtctatttctgttttatttgggggtggaggttaatgttacaggtttatgaagtcattaaatctggaagtaaccatatgtaacatgacattaactgtattgtcctgaataatatttttgtttcatactgttatcctactaaatgttgaacatctgaggacataaacatgcattatggttttgtggatattattctatttaaaaataattttagtataactgcacggctgatttgtacatagtaaattatgataataatataatggaaatatacgaaaacctctagagtatgtgtttatatatgtgtgtgtttctttgtgttagtgtaaccatttacatagcagttatctttttagtctgttctgttttcctgagtttgttgattttattgatttctgtcttcttagtggagcgttttggacacagacacatgagatagttgacgaacacccaagtctgtttggaagttgtttcttacagaagaatctgtggtttagtggatttataaaataaaaagaatataaatttttcatgcagctagtttactattttgtaaagttactgtcttggtatataaagtgtaatattattaaaaatataaactaaatgcttttaggtccacaccttgctaatggaaaatatattacctgagagaaggccttcaggcagttcagtcctggctttgtgtttgacctggaggtcagatagctattcttctcctgtattttgtctgccttgccagcagcatcactgagcattgccttatgaagtaacatgaaagtctgtggaatggtttgatacctaagtcagtctgttgaggaggtagggaaaagccttcaaaagagcccaatgttcttttcctcatattaaaccctaaaaggtctatgtagcaaactatatacatatatgtaaatccatatctaaaagagataacaaagtcttaagaagttacatttttagatcgcgttcatcatatgaaaataatatttatagcaaaatgtattttgaaaaagtaggattatactgattatacaatgacagaaaaaaaatcttatccatgagataatcaagtgtttttcagaaatttttatgaaacaacattgtattttaatatgaagagtagtaggaagaaaaattttagatagaaataagggaagcctcaaatgattaaccaagttttcttttgccttgtgcctctatttttaatgacttatttatcttcatataaatagatgtcaagatcaccattttatttcactgcttttcttttcagattcatatatttttgtcatattcaagatagtattattgttagttttctctggattttatgatttgtgtcagatattttaatacgaaaagatatacttggaattcatgaacctgattcccagaaatgcagttattaactctcacgatctctgaatgtgctatctaatttaagatgccatctggtggtatgcatttgatacacctagttcttttaattgctctcagaatcatacatcctatattgcttatgaagaatatttttgaaatgacatgcagacatttgttttcatttcaaacaaaggatcgtttgtgtttccctttccgttttctcgaagtaatatgcatgtttgctttggtctttgttaataagcataatctgattctttcttacaaagcattataatcaggctgcaagtttcagaactcagctttgctcacagacatttgtagaaattcattatcctctttaaaattctagttacatatttttcatttaattttaaaaggtaaagtttgagtggatatttggataccatttggcgaataagagattctcagataatcaagcatgaaacacattattcatttgaaattctctttcttatgttttaaacattaaaggccaactccttcaaaggtggaccttagcttaatctcaaccactgctttgccttcttcatgagataagctggtaatatttattaaatatatatcaaaggtaggtgaaagctagacattaaattgcctgtattattgatataaaatatccattccacttgagactctgaattgaggaaatgttaaaaatacatgagaagattttagctccttagaaaataatttgtggctggttagcttagtttattaaggacgtggtggcaatgagccatcttacagacttttttcctcctctgtagcctgtttagaattctcagtttattttcaaacttctggttcagtcagtttatcttaaaaaaaaaatgacagaaataagaagaggtgataataggaagtgtgatttaatctctgctgtgcaggtcacctgaggtgtatcacctaatgacagtgcagcagtaactttattttctccctatccagcatggtgtccacattaaaattgtgaatctctaaattagcattttgtgtctgccactttctacctttgtaccactcagcaggatattcacctctttaaatctcagctttctatctattcagtggtgttagtgtcatgcctgtcactcagaaagagtgaaacgctgcaaccacagcacagatatgcccaatgagtagtaaatttttgttgttattgctgtatctgttactattgtgaccggtattgttgttatgtatctgttacatcaactgttgattctagtgtatggtttttggtgattagaagtatagacaccttataaaaactccattaatttggataatatagcttgcagttccccttttgtggatgtaagtaaagactgagagggctgtgctgtgacagagtgtgcagatagttcctcctaaccacagctgtcccctacttaccttttctaaattccaaatgagttttaattcgaaagaaaataaattttgttttcatgaacatattttgcgctatcagtatatcaattagaaagaagaaaatgaaaaataaaaaatgggaaatatgagctattatatattagaaaactagaagtaaatagccaaatatatgcaagggtgggctttgctaaagagtcccatgtcaaagtaataatttctttatatttgatgattgagaatcatttggatgtaaatacattttcatttcatgtttgggtaattgactttttaacagttcatggaactaccaacaaagtgtacattatttggattttacatttcccaaataatatgcaactttagattgctttctgacatttaaatcagaaaaatgttgcagggattttcagtgagtttttctccctctcattggcaaccctaaactatttgggggtatttcgttctatacctctttgtcaaagctttctagggtttctagaaagctcaggctgtctttataacaatttcttagtatgtttcaacatgctaataagaaaacactaggcaaatatcatttcagttggggaaatgaagaaattgtaagttaaaggatcatgcgtcaaaacaatataatattgattggcctcaaatacgcctttattcttttgtacactataaagaaacttaaaccatttttagataggagctaatatttcagcttctgttttaagcaatgaatgaactcagcagtaactctgggagataggtgttctttggatatccatgtaatagatgagaagattgagacatagaaaggcttacagagcttgcccagggtcatagacttaggctgtccacagcctggagttcttggttctaaggccatgacccttccattaaaatattactcaaggccaggcagtctggttccagagcccagtgtcttatgaggcagggaaggtggccataaaccattgattaaaatactcttgaataggaatttctcctaatattctccactaatgctttgaaacaggtttctaattgacacccatgtttataagcatcaaattattccctcaacatcatgcaacctgtaaagaaggcatgctacaggtagtgaagttagtgaggtgaagtaaaaattagaatgtttgaagagctagttaatatttttaaagtgaatacatagtttttattttcttttgtcttcccccacatgaccatgtttcaaaagtttagctttagaagttgctttcaagtactgtgttagagatattggaatcattttaaaacaatcttgaaatccttctaatgcccctcaatgaaattcagataatttacataagacctcagttcctgttggtcctccagtgaaggatgaaccccagaattattttcttcttcttccttccacctctttcttcaaaattctcatcaaatagtatttattgtataacacataaaaataacaaaatattattacctcgcaaatcttgtctgaaattttactttttttttttcctagttagaagaattttggcatgcaagtgctgaattattttatatatttgggctatctaaggagacaatttaaacaactgactttagcataggaccaagtaaaatttcatgatggcatttgactaccatttaaaaagacattttggacctcccttttggcttaactaaggcatatagcttgcaattttttgcctcctgctccttcttgcatttctgtgggactgccgcagctcccccagtgactgattcctgcttgatgcggcagtgtgcagccataagcccttgcctcaccctggaataaagcacctagtttagcccttcccttctaactccaagtgctaaagaatggtaattagcattctttggacctttactacatgcctaacaatatactaaaggttttatatgctctgttgagcaatcttgtgaggtgtaggtactgttgctattcccaaagttagagaaggaaatctgtctagtagatacatagtgtgagctacatgtataattttaaattttctaagagacacttacaaattttaaaagaaacaggtgaaattatttttaataatgtatttcataacttcagctttccaaaatattttcatttcaacatgtaatcaatataaaattgttaataacatattttgccctcttttttttactaagtcttttacttctgatgtttattttatacttaagacacatttcagtctgactatatttcatgtgctcaattgccacttgtggctagtagctaccatattagcacagttatagataaagaagctgaagcttggcaataagagccttagtaaatgcagccgcaggaatcaagtgcagggaactgattctgggcctcaagctctcaatcagcacagtataccatctcaggacctggatagtttcttccttcaacttacaagcatcaccttgttagattcttctgtggctttaactgcctgtatcacaactaacgagcatagtcaggttccattctctacctatttctttctctttcagttgatcctgtggtgttagctctgtgtctttgatccatttccctgttgagtcaaaggacataaaattacagaccagtggaagtctatgggagtcacttctcttttttctgacctagctacttttgtcttcccataattgtgagcttgggcctgtagaatgtatgcactatttgctacttacagttagaaagcctctgtaactagccattcctcatagtagtgattctcaaagcagtgtggcacaaggttcatagggtaagtgtatcataatttatgatgaatcaggtagggttgagcgatgagttattgaagcaagaatgtggaaaagcaaagcagtgcaatagccttgatagagaaagtcaacagcttccagtctgtctttcacacaacatcaaataaaaaaacttggatcaagaaaagggatgagatgcattgttcataatggtgacacagtgcccattttatagcatgtaactttgagaatcaaaatttttttctaaaattgctttcatatatttttaatcacaaatatttttgattttgagatatcaaatagagttaaacagggcaaaggattttgatagttttcattagaggacattgtaacacactattctgtaggattgagttgatcatacactattttatctcaaccttcattcgtctagtttctattctttctaagtggtacacatggccactcagctgaagactaaatttcttagtttcctctatcactatatatggctgagtcactaagtttttgtcagtgcggtatgaggaaaagtagcatgtgttactttcagatcatgcaactaaaaattttaatgtcttccttgcttccctttccccttcttgccaatactcttaggatggcaggagctgaagatgccattctaaccatgggacagaggtcatatgtcaggtatggcagagcaacaagacagaagggccactgggtcccaacattgtgtacaagccatgttacctcaaattgcttatatctaaagaaataagcttttatcacatttaagctattgttatagctgggtctttttaataaattttttcacctgcattctaatactgtattagtttgttttcatgctgctaataaagacataccagagactgggcaatttacaaaagaaagaggtttaatggacttacagttccacatggatgggaaggcctcacaatcgtggtggaaagcaaggaggagcaagtcacattttacatggatggcagcaggcaaagagagagcttgtgcaggaaatctcccatttttaaaaccatcagatctcgtgagacttaactcattatcatgagaccagcatgagaaagccctactgccatgattcaattatctcccacctggtccctcccacaacacgtcggaattcactatgagatttggatgggcatacagctaaaccatgtcaaacacaaaatctagatttgttaatgcctttcctgcagattgttacctatgtatcctaccatagctaccatcagtccctgccgcaaaccctgttcttttccagagagaagccaatatattgttcttttaatgaaccttgattgtctttgtttctctaacttgagatacatccgagtaatttgatctatctgaggtatgccttctgttttgttgttgtggttttgttttgtttttccccaccatcgtgaactctgtacaatgctcaagagcaggctcaggtcctacgtcttctggaaagattttcttgactcctcagatagcaaggtctttctcttcccctagttcccagtgcattttaatacttaagcctgttttatttaatgtttattaggtagtatcttctctctcccagctatcctgaaaattccttgagggaaataactgtatctaaaacttcttgaaagcaatcttaacatctgtcccaatgcctgtctgtattaggtacttaatgattgtttcattcaatttgattttgtttaataccaataaaatgttaattgaatctcagtctatcaccttaaaagttgataggtcttagagatacttttatgcaattatttttttaaagaaaaattaaggctgctttccaatttttcctggttttattgtcctagaaatagagaaaagcacagtatagcccagtatgacaacttaagagtaaataatcacatatgaaattgttcaaaatcttacctttttattccatacaaatcactttacaatcaaattattgtcaactcttattttgatttcgataggcttcctagtgctcatggttataatttataacatccctaattgtgctgtttagcctgtctcaccctatatgtaagtctcctcataatttcttatctaaagatgtgacaactcatttgtgtgcctctcatggcaaattcatattgctaaacattcatataatcatagaattgtaagatactttattttgtataatcctttcattgtaatgtgtttcttttttatgtcaaatgtgatttttgagtggtctggctgcaaagtatagtgggcttttctgtgtatttttatcaaatcctgcttttagattccagattatacttatttgaggaaagttaaaaattgacaaaactattcgcataacagaggaacctccactttatttttactaaaataaattttaaaacacttttgttttccctttatattctaagttatgtaaatttcatttctttgaaatatattattttatttgagctttgttatgttacctttgtagaccttgttttaaaaaggatcctcaggtttttagagtattgagtatttgatatcttttctgatgttaaattccttctacttagtagccatcaacatatttataaatgcccataatatacccagtaaaagtctgtgaaagtcgagatacttagtatgttatttttttaattttaatatggtgatcataaacttgtgatggtctaccaatttgaaaaaattctcatgaaaagctagtaaaggggaaaaaagtacttaccaatattattttaacattcttaaatatttttaaaaaattatcaaagcaacacttattctattttattttattttattatttttagagacagggtcttgctttgtcactcacctggaatgtagtggtgcaatcatagctcacggtaaccctgaactcctgggctaaagcgaccctcccatatcaacttcctaagtagctgggactattatgtagtaatatagtgtgctaatgaggtgcacaccaccatgccctgctaaattttatttttttgtagagactcactatgttgcctaggatggtcttgaactcctggccacaagtgttcctccctccttggccccccaaagtgctgggattacaggtgtgagccactgcgcctggccaaagcagtatttattaccctaacatcatcatgacccgtaaacctaatttaccattagtttaggttatgggtagctctcaaattcccagtatgagaatattgttggtgaattctctattaccagggttactgtagtaagatataatgctaattattgattcaaaataagaaatttcagtaattatcagggaaggtcaacttccagaataaatttaaggcatacaattataaataataggaaatacaacttaactgtcagatgtccacaggcagtaggttaaatgtggattcacatgcaggccttttaaaaatggcctgcaaggagagtggttttattttcacagtctgtccttttttgtctcagttatgatttttgctagctccctagtgacccatagctatgttttagctttttaccaattcttagatcatgagtagaacccacttgttaattatgggtgccaaattggatgatactacaatttatccttcaaactggtacacttttgaaagtaaacagggaagctgttactaattatactaccacagcacatttaatccaggactgttccagataaacagggatattaggttttcctagtactatgcctcgaaggtccccagtttccacctctgctcatctctgctagatgtgaccacatgttcttaatgttggccaacttgcacatataactttgggtgcattaatcatggtcctatcatttttgggtgactacagaatgatgtactacaagtgcagattataactatctgcactaacagtatggaggtgacttcatataaataatattttacatgtaggttttgagtatgtttgtatttgaatgtagacctgagtgattcttcagaaattaatacagtaaaacattagaaatttaggacagtgatggtggagtgggtcagttagatgtgaaaaattgtaagaaaacatttcttctagacatggaagaataggcattaagattgacaaattatcttgattcaaatattttaaaatatttttagaatttgtatttattaagtatttaccctgaaataagtactgcacgaagcatattcattcagtattgtccagttgctcttagcatgaagtcactggtgtcaccttgatggcagtgatgagacaaattacttgtttcacctctttaaacatcagatagattgctggggacaaagagacagcatggcttccaaccattacacaagtcccccttctgcagccaggatcatgtctaggatgatgcagttatggaagacagcatgctgagtttctattaatttgatgaatcaccaaattgagaccagtggtggtggtgtccagggacaaagtgaattgcttcagcagtgggtagataacccactgtttttcagttaactttttcagcaaggtaataatttccttgggatggtatccaaagggtggcaaacctctccctaaaagtagtgtagatgaaatctaggctcagttctgtagctattttctttaactagcactctaggaaccactctaggaaccaatattacacttacatgaggacttgtgatgacctggacacctcttttgttttctacgatgagagtgagatgaaatggagggggagtgggtgatcgttcgagagatagttcaagaaagagaagaaaattgtggggagtcaaatatgatgaagggatttgtaagattggtgataacaagaaacagttgatttgaccaatagacttaggttccacagacaaaataagaatcattgagagttagccaggggtcatagaaataattatctgctgactaagagtgaccagggaatgctagttttgaagatgaggaaaggatttgtcagaggtggtttatgtgtggttggattgaatctgaggaattaggacaagaggggcaatagtaacacttccattaatatgagggctgtgtgaagaacacttaccaacttgagggttttatgttagatttagtgatgtctaggtgtcatgacaaatgtaaatgcttatttctagaaagggaccagtggtaaaattatgatgggaatagacatggcctttttgaggatagacctttagaggtttcggagttgacttactctggataattatgcaatttagaatggtaaaggcaaagagaggaagggttttagcaaaatatgtatcctgattggtcaaaggactctgggagcacagtaccaaaagtctgtccagtagaggtcaatgggagacagtgtgactatatttgttagatagaatacattattttcaggggcagtatgaccatgattttaaataaaaatttcagatgtaaaggtaagtcttttttggagcagattttgattttttgcttaattaatcaaggcctaatgctaaaactgttaagtattcatcatgctactgacaaataaaatctgaatatttgcatataaagtaaaactgaaacatggattcatgcttgtgttctagattctttcacataacaactgcattttatgtgtaatgggcatgttttaagggtaatgctttgccacctagtgagaagatcattggctttagaataaaacagacataggctctaatcctgcccacaagttacctaacatgctcctcatttaaacttctgtgcaagtgattgaaataatttctactttacagtgctgtgagacttgagataatgttgaaaagctcctcacgtaataactgatatgtagtaggaactcagtgaccaaaaaatatcacttattaccactaaaattgatctatgtacatatattcactgaaaccttctgtaaatggatggatatatatgtttatatttagtaaacagaaaaaataatatttcttggtatatagtagtgtactctggataatgatagtcattgttataggaattgtgttttttttttgtgcttaattcaacagtcattcctggtaagatatatcaaagatttgctgatgtattcagtacttacttcatatttgcccttctgatgtaaatcagaaacaattaaaataatttataatagaaaattcaaaaattcaattcatagaatttatataaaccttttcttactttgtttgatgtactttcttagcacctgaattccacttttcatttgactcatatgagttgtttgacatttgttttggttccaagtaaaagtatagttgttttgtttaggatcttcttgacattactgaactacaataatccctttttttcccaagcttaacaggaaaaggagggtgaaaataatagtattagtgaaaactattgtctaaaagtgatgagagtacaggactactatgaatcaggaatcccgagagattgtgccagttctgacaatgtcttcctgtaattcatgaagaggttattctaggtgatctcaaagcccttgttggttttcattctatgaatgcatttcttactccaactatatgttacatgacttcaaagggaatatcttgattagtctaatcagggtttcctcctgctaccctttaaaaacacctctgtgtcaaagtaagagataacctcaacttttgttattgtgtgatttaacttcccaccatatgatgaattcctgaacattttaaaaccactagttttatttttgtgagtacttcaatatccagaatgatttctgtcgttaacgtaatgaaacttccactcctacatgtgtttcttttgtctttaaaatatagcaggcctgtttcacaaaaacattttcttatttaaatatgcatgcttttatattcttctcatatgaataatatgtgaattgactactttttaatttgaataatgttgtggctatagaaaaaagcatggtgaaaagggaatggatttaggaattttaagtaaaatatcctagtatatcgtatatctattgatattttattggtcacattttattggtgtttgtcacatttcactgtggttttttgggggggcttcacagtagttgtattttagtcacagtaattaaaatttaataaacagttctctgtgattttctctatcttgattgttctcaagggttagtcatttgccccatatgtctgataattggtcatacaaatctctgttgctaaattcttgactttgaagaatgtttgattttcttctgtgctattttctgctctaaatagtcatataattttacttttggaagagaattagagactactccagctactggccttacagattaggaggcttggagcagtcaggcactgccactcacagctggaaagtgctgaactaggcccagaactctggtcttctagatgctcttgtggattctctgcaccaggtcccccgacccttctttgtttgtcatctatttccttccgaataacaatggagaaggtgatgactttacttctgcagcacgttattgttgcttttgcaatttaatttctgttggctgtattaaaatttaatgtttgtatacactaatacatttaacagttattcttcagcaatagacatgagtttttctactcacaaaaaccctgtagatcacataataactgaccttttcctactgacctttaaataaagcaatcccttaatgtactgctcattttgtccttgacccagagctcacttctgctttcttacatcatgtttggcagcgggacagaggtaataacctgagaggcgtgatgtttgtgccttccatgactacccctgtttaactgctgggaaagtttccctcatcttctcccgtaattatttttaaatgtcttcagacttgagggagtaaggttttgtggagaccatataatgctgatgggagtgtactagagatatccattctgtatttcctgtggaaaatggaataaaatagaatgttttcagtttcttaaacttaactcctctgtgtggtagaatcaaaatcattgtatttatgcctaaagagcaaactactccactcctatactgaggtttcttactggcaattcctctccatttgaaaatagaagatgtttcatacaccaaagagcactactttctacctgcttctttctcatcaacaatataggacagactcaggcatacacatcttttaatatggtatacagctgcagaattacaaagaattaatatgcatgtatcgtagatagctttaagtccctttggactccttagatgctccttttttcaccaacattctaatagagttataatacagcattgcagctggaagaaacattaaggctaaaaccaaatcaggtagtatgttgaaaggaatggtggacctgccactgaccagctggaataatcttggagcaaatcacttcaactccctatgcctccatttgctcattgataaaatgcatcagctaacaaggtacaagaattacctggtgatcccttttctctgatttcattcaattatagttggctattactctttcccagaagtctaccacaggtcagcccctaagttctaattcaagctgtcaactttagtcttccctttaatttctcagaagtaaaacgttttttcttttacaggccccttccagtttctatagcttcagaaacaaagatgatgtcattccagcttcttcttccaaaaattctttgtttcttttctttagtctttgttttaggatttgttttcaaggcatttacaccttttctttctagcattatagattatcttagatctttgttatgtctccaaatatttttcgggactttaagtcttaccttagtcctctgacttccccctgaacatggatttcacaaagtacacccctttatagccatagtgcctggattcaacccagctctgtcacctcccagctctgtgactgttcaagttacgtatactgtgtttcagtgtctacctagagttgtggggattaagtgagttagtacctgtcaagctcttatagctgtctggcatatagtaagtggtatttgtgtgagtgccaggctttacaatcttaccgcaggctttgttccctttccctatctcactattcttggccaactgagcatctcaccttccccagacttacacttcatgtccttagactttatattcttttagattaagaaggatacctccattgtcacccacaggctccccttaaatactttacaatatgtataattttgtgtttaggtttgcacacatattctttatattgttgtcatcctaaaagttattctcataatacttaaagctttcatacattgttaggaagaaatgttgtacttaattcaagaagatgttttagaaaatatttaagccagattataagaatacataaatacaaaacgatgtattatttcttttaaaaataagtgtacctaaagtcattgcactttagtgaagaattccctaaccccaattaattttgtgatatcttaatgaaaaaattaacaaatggtgtggttgtttcacttccttgaaaatacatcgtttaggttcatgtttcaaaagagccaattttaagcaatactgaaggagacaatcttattgataaaaacataaatatttaatagagccatagtatattaaaagattttgaaaatataaagttgattgatttcagtaacttccaaactatttgttaacaacgtggttttttttgttagtttgtttttctggcggggtggggggggcgtagtttttgtgtttgtttgtttgtttatttgttttaagaaagggtctcattctgttgcccgggctggagttcagtggtgtagtcatagctcacagcagcctcgaatgcctgggctcaagtgatcctaatgcctcagcctcccaggtagctgggactacaggcacccaccaccattcccagctaatttttaaatttttttgttgagacaaggtcttgctctgctgcctagactggtttcaaagtcgtggcctcaagtgatcctcctaccttggcctaccaaaatgtgaagattacaagcatgatccaccatgctcttttttttcttaatgaaatatttaaatgcaaaattccaaatataaaacagagaggttattattatattaatttagctaaatcaggaatttttttgattgaaaaattaaaattatttggatggaagacatctttgctaaactgttatttaaaacttatgtatgcttgcagagggacctcatctctgtgtccattttcatgtctctagctatataaatcctgacatcactgtctttctagtggataagaataagtgtgtagtgtaaatatgatactgttacattttagcaattaataaaaatgtcaattgctagggctggatataattgcagaaacgacctagtgtttcactttgctgtttgaaaaaaaaagccctctaaagtttggatctttttttttccttagcactcaaattgtgaaccactaggtttgcaaacttttgtacatccaagcacagcctctctcttaccacaggccaaataaacaccctgcctaccacacatccatctattcctcattgaaatgtacctgagcttataggacatttcacttacacccctcaccccctcatcccccaataaaggcaaaagccctgttccattaatccctaaaagccactgtcagtgcccagaatctgtctttagaatctgggctgtgttattattacactggcccaatggctctacttttacactaagaggaagaagttgtagagaggagtctgaggagggaagttggcttgtggagctccgtgtacatgtgggttatcataaatctgggaatgctggatttaaatgtccagttaattgttcttcagtgcaaacaaatctaatgtgtgccttgtagttaattgattttattagtctgaattgtgaaaataaagtagcattgcaagttttgaagcctttttttacaggatcattaaaaaatatatttaagtgaggacgtgggttttagaaagaatgagaacttagagagttatgtttaatatgtcttgtgggaataagaaagcaaatgaattcccattgtaagttagaatttgtcctgatttaaaaactagattcagcttccctctgcattagaaaactaggtgatttcatggaaatagggctaaacctcctaagactcattagagaagggaccacatgtgcttagaaaggagtctgaaatgaggaagggggacaaagactcgttttaagattttaaaagaaaggaaagtgaggaaaacattttggggacatttagtcacaagggaactgtgactaactctgttagtcacagtgctgaatacttttttacatgttttcataattaaggtcctaaataacctcacaatttggtaattaatgtagcaccaactatattctaggtattcttgtaagtttttggaatatatcagtgaattagaagcaagatgggtacataattctctctgtagatgaaatagctgaagccagtaatgttaagagcttgtctaaggccgcagatagaagtgtcagaaatgggatttggaccaatctctctggttctatgctcaggttgtgggaatatagcatgaatttctagacatactcatgttgaggattttttcccttacaataggataataatacctccactgcctgtcatgggcttattgagagagtcaagcggtactctggatatgatggcattttgtttcttcctttctcccactgctctccatcagtactttgatagagcactaatgctctggattaagtcatttacaagtatgactcgtttaataagaaatacacagctgtagtctacagactatcattcattcattgaatcagtcagtctacaaatatttattgaatgctgtcatgcattaggcattgtgctatatatggcagtgacatagtaaatgagagacatgctcattttctcataatccttatatcctagcagaaatcggtattaaacagattacacaattgcatatatttgtggtaagtattacagaggaaaactagagacatatttatgtctcttatacctatgcctgttttttaccaagtaaattaattagtaaattaatgaatggtgagaataaattcttctacaaagtcatgactgagcatgggcactctagagttatgccagggttcataatccagccttatgcctactgggctttgggactttacatgagttacttaacctttccatgttccagtttcctgcagaatggggataataatagttttagaagggctgaaagaaggaacattgggaaacagtttagaacagtgcaagatatacagtgagtgcacaataagatttagctattattatttttattactattgtcatgtagcggaacttcacaggcaagttctcttttaaccatagtatttacctaagctgtcaaccttctttgaagggtttttttttttttttgaaagaattgttcataaacgagtatgcatcagaaccaactatggagctttaaagaatatacatgtttagctcctattgtgggagattgttattcagtaagtctgaattgagctctgcttttcagaagctccacagatgaccccgattcacacaccaaggtaaaaacggatggctttcaaatgacacagaaaggagatttcacacatggcagggaaggaatgtaaactactgacaaccacccaaaggacttttctctgtgtaccttgggtgagtattgatagctacttggaaaaatgtgatagtaagtaaaacagtaaatatttaagtattcctgtagatgctagttaattcctttttaaatgggattgaattttagtactttaaaaaataccaaaatgattatttgcccaaataagtttgactagactagaatgcgagctccttgaaggcagggatttgtgtcagtttcacagatatattggtaaatgtatcagtaaataagagtgctcaataaataagagtttaaataaattgaatgaattttgaaagcttaagatatttggggaacagataagaatgattaattataggctgggcaagaatttttgagtgaaggtagatgaaacgtgattattctgttacttttcttagtaaaatccaagtataggtatatctaagaaaagtgcagacatgtagagaagagatgctaggtgtgaggttgacccaagcatggtgaacattttttggcaaatatgaaggcagtctcctgttgttatttttttttttcacctctcaccctacttccatgatattctttcccagcccttaactcctttccagttagttaaattccatttatttatttgtagtaacatgcaaaatgtttattgcttttgctttttaaattctgactgatgctctctgttatgtagttaactgtggctttagaattaccaggaaaaattatagccttgagggtccaggagattaaagcctaacatctcaggtactttgcagtatattctgccattggatctctatgggagattttcaacaagagtcaggaggagttttttttttcttttctatgtagttttatataattgtgggaaaaaatgtcttgatgctctaaattacagacttttgtgttacttgttctaaggccacttttcttttgttatttcaattggtaagccaagaatcttaaattattatctgggagtaatttaagtcacttttgtatcttgtgttacagctgttaattggaccacgtttaagatcagcaaatgctagcaaataaatactgtattttatatggaaaactatagaaataggggaaatttccataattgttagcagagccaaaaaacttgggccttgcctgataattagctgcctaaattcaaaatatactgcatgacacttactgtaaaatgaacagtcttttcagaatcaaaactgactccccaaatttaagaggataaaaatcaccaacatgtcttaaaagcatggtttgtaaattatttctgagtcagcattttttgaagcctcttcttacagatttctctaaggttgcaaagtcatcacataagagtcagcagtaaaaaaaaaaaggcatttacttcttctggtatataacatttgcatgctctacttgccttttagcagcttataatcagatgctgaaaacatattcacctatagaactgggtaaaaatcaaacccataggtaggcatttaataactgtctctttctttaggcctgtttcagtttatgttgatctcaaaggatatttagcatatatgtgccattaccgtgattgcttttcagctttaggataaaagtcagagtctgactgatgctccccagggttgccacaggtggttgggcatgtctgcactacacgtctcatgacatggtagcctggtaaatagcgccctctggagtactgtaggacatagccagagtggtcatttgtagtagccttgggcatgcacaccattcattcttgtctttgctgctgactgagcatcttctctacgcactgtgctaaatccatgtagaaggtaaaagtgatgaatttcacttacgagctttattagaatttaggtaatatattcactttcctaaattgcctatacatgattaccatactaggcactcagtttgatcttcagtgaacaggcaaggctggttgttgacctttgtatgtaggtataattgcttaactgcttatctgtagttcctgtttgcaattaattgcccttgtgcaaaagtgagcgtctcaatttcctgtttgcatttgtgactgaagtctatgaagtagctttattattgtttcattcagtacatattattgatcatccagcaaataggtataaaggggaagatagaattataaagaattataattcttatatcattgctttagaaggctaagatggtggatttagcacatgtatcatcatatgtgtaagcagatacaaaagactggtgtaaatttctgatataataagaggtcttacttgctagacatgtggatagtatggcatagctcctaaaaactaatttttaaggagacgtatatatggtcttaatagatattattcagttcagtacctgaacctttttgccatcagccaatttttagtctttctttcattggacctcctgagaagttgacactccctctttctttcaatactttcttcccttggttatcaggataccatgctcacctgctttttccttagtttgtggtcctttttacttagtctccttggaggttcttctccctcttagagtgtcccacaatttagtccttagacttccctcctctatctacattcactgcctttggatattttccctattgtcttgttctaaaaattgtcttttgtgagatgattcctaaatattctcatctttagcccggtcctttcctctgtccagtctcatatttctagttatctacttttctccatttgcctgtgtgagacacacctcaaatttaaacatttccaaagccacacttctgaccttccttcataaatctgttcttcctactttgccttccatcttattacacacaactatattcttgacatctcctttctattttttctccatcctgtacacagtctgtctgaaagttcttttagctctgtctttaaactatgcctggaatttgatcacttctccattccctgtctgcactagcccttccactaccttggctggattattgcagtggcctctatctaaagtgttctctggcttccctctgcccccattctcaacccagtggtcagtgtgatgctggtaaaacagaagtaccaccatacagcccttctgctcacatccctctaggagcttcctttcccactagagaggtcaagaggataagtgctttacctcaactccaaggcctttctgatcctttgcctgttctgcctttatgtctttctgatttcaactcctactcctgctacccttgttcattcacctcagcccctctggcttcccttctctttctcacacatgttctgtagtttgtgtcctttccagccagccagcctgtcacccacataattataccagccctgaccttctgtgtctgtgtttagaagtcacctcctaagggagaccgtctctgaccaccctgtgtgatagctgtgtcccccaaccctcaccacttcccaggtgcttgttatcacccctagattataatctccattgcacttatcattcattgatacactttgtagctcagttttttttatttattagttatctttctgcctctttagagtgtacactgaaggaggggagagatgtttaactctttttttcattgccctattcccagtgtctaaaacaatacatcacatatattaagctcttggtaaatacttgtacacatattcggtaacgatttaaatgttgactaagctcctctttgatgcttttttactaaagctgtctaggtgaagaaaactgtctggtaaccatgtggctgggatttactcaaaaaacaaacacaaaagtcaccatgcatctcagtatgcatccagaagcaatttgttcttaaggtgccttaaccaagagcctctatagtgatgtcaggaatcatcatccctattgctgtctaaagattatctcccctaataatgggcatttacagagcctagagagttatttctcttacagaaatgtaattttgtatttgtctcaccacttccttctattaatgatgccaacatgtttagttaagagaatggaatttggagtttaacttgaggcaaatcatttctcacctgtctttcttctgaattcagatcaaaatgctaaattgcacgtataattaaaggagggacaagaaagactaagaaaatggctgtgtgctgttgtttcagttttgaatattgtctcattgctttctaataatttagctcttgttaatatcaacaaagtaaataaatcataatgttttggcttgaacccaaagtagctttcaaatgtattaatataccctaaggaaatatacaatgtaagtggtaaccaacaaatgggtcttcatattgttgttgctttggaatccttagaggtaaaaagtattttatccgtcttttaaatgatgaactaaatacttttcaaatattggcttcatagagtgtaataaccatatgaaaatccaaattaacataatatgttctctccagaaataaactgtacaatgtggacttaacgtggcagggtgggccacttgcaaacatgacctaagcaatgagaaattgaattcaggaaatttagttttcttttctttttctcttttctctctgcctttttgggacaactttccattgagggagataaaatattcaggaaaaaatactctaaggagtcaaaagaaatttgtttaaatgagtaaacattaaatctttgtgttgagactgaattttgcatgataaaaatctgctttttgggttggaggaacggtgcgttgcactgctctcatgggacaattgtgtaatattttggcacgaaaatgggttatcagacaccaaagaattgtgtacctcagaaaagccaaagtaacaattggtttgaggtgaaaggaaaatctaagtgatgaaattcagagtctggaagagaatatgttggtgtttgattgggtgtagtgggaagaatttctttgcctaggagtacttcattatctaaatggttgttgtatatgtttcatcctaaaatacttttaagttggaatgtgcatgcaaattcaagtttatcttcttgaaatctgctaaatgaatatatgttccatattttatctggttgtatgtattctaattgatcccttatgacttaaatttttacttaactgatttagcaagtctaccatcttctacctttgatcattccattgctgtatcatccatctactttccttttaactaaccaggtaagactaatcttatttaacatgcaaaccacttctgttgttatatagaaaattttatgtagtatctatggcctggatgtcactaccaacaaagccaatggcagtttgagtatatctcagtaatgttatctgataaattccttttattttcatgtaaattacctattgtttcataaaaggctgctttgtgcttgtatatggccaattctcttgaaaggttagtacattttattgatgtacacatgtaagtattataatatttgaacaactacttagacatcaaagcagtttcagatgttcaagggtttttcttttattcttgggtaaagcaacaagggaaaagggtttaatataaaaattgtataagttgagaatgaggtctgattggttaaaaggttaggggactgtatgaagcacattaaaggttaatgttcagtttaagtttgtgtctgtctgaatctgtcttaaagattgtacaggtaaaaaaatagacatagcaaatgttttactgtttgtacaaagaataattagtctatatttaaaaatggcattatttcatttttcaatgtttgggaaaaagactgcctttatggaaggagaaatgtggaatgtctgtcttcgtttgattattcttatttttaaaccatgtgcagtatcccttacatcaaaaagagatacaaagaaatgttttctattataagagtcatccaacatgaaataaactgcttttgctgagtttgttgctgttgttgttattgctgcagcagctgctgccgttttgtttaatcgcagattccatagagcataaccttctttcaggaatcatttttttagggattcctgtactggatagactactgaacaaaatcatcaaaatctctcctcccctacccagagtcagtgctaatcactagattatagtaaaatgatgaaagaaatttaaaaattatatatgtatatatgcctatatacatgtgcaacattggcagccctttatctctggtagaaccattttttcttctaagttttttggtggattaggtatatgaacctaatcctattttaattatgatagatgctattggtttaatttaatgcctttgcagagcaaaagaacatactgacattatattttcatctgatcctcactgccctctctctgctgtgggggatattttactggtccatgaaatccaagtctgggaaccactgaagtaagtgatctcaatggttatttcataatcattctatgtaaatctacccaattaacagattttgcaacggcttttaattgtatagagccaggaccctaaaaaaaaaaaaaaacttaaatcccattatttttagaaatagcaagttatacagaactgataggaccttataggggacaagagggagaggagaaatcaaaacaattgattcatttaggaacttcttattgacacatattcaacaagtatttgaggtattattatatgccaagtactgttttaggcacttgggatatgacagtaaagtttctacaaagttccttactgtcttaacagtagaagacaaaacataataaatccaataaagtataaataagtaaattataaaagatgttagaaggtgataagttccatacaaatagaaaattgtatggggtgggataagggagtggcagggtgagggtgggtggaattgttaagtagagtggtcagaataggcctcattgagaaggagaggagatttgagcagacttgaaataggtgaagaggtagctaaggagacacccagaggaagggctcttcacagaggatcagttgatggcacaggaattcaaagatgcagtaagttatgattacaccactgcactccagcctgggtgacagagcaagacctcgtctctaaaaacaaataataagtaaataaaaaataaaataaaaataaaactgtgtcttataccaacttccacctgagatcatgatagaaatctatttattcatgataaatagctactggctaagcctttggccctaaacctcagtatagtgcctgaggagctagaccaaaccaaatgtaggactctgttctgattcccttaagtgacttaaaaataatgtaaaattggctttacttatttctacccctaaatcaaccagaaactttaaaccatggtgtacctatcatatatgccagagcaaaatatgtatcctaacacctactgctgtgcttccataacccagcccagggcttacgcaagtgtgaagagtagaaagagaagagagggaagcagaataaaaataaggatgaacacaccttgtccagatggttatttaagcctggaagaaagggtgggaataagaaaggatgagagaatattctcttgtcctcattaaagcctacatcaagcaattacagagaccacactgtctatgctacatgcttttgtgatctctttaaaaataccacaactttgacttgtgggccaatgcatatcctgaattgatagattcagatcattagtttttcttgagagaagggacctcagggcgaacaacaacaaaagccccagatatttcacactgaaaagagttttaaaacaatgaattaagtatcttcaaaatttttagaaaaagcagaggaatatatcagttcaggtttcttgttgctgttgttccctctactgcaaactgtgaactggagtccaggaaactgccatgcacaaatgcaggaaatgcctgccaaagctgtaactactccatagcccctaaactggtgactagaattggaatatggaattgccagttattaaaaagtttttaccaaaacctgtagtcagtagccatgtcaagtgctggggatggatgacttttaccttcctttgctttcagctaatcacatgatgtgagtacatctccttggctgaacctaagccttatccagaaccctaatggcaagggagtctgggaaacatagtgcttcagcttccagctcctatagctcagagagagtatagaagagtgtggtaataaatgctgactgacaattaaggtttctcaaaggcatggccattttctaaatgaagaagtgaaattaaatcaaaattctcatagggaaaggatgagtcaaatttgctggtgaaaacttttaaacccagggcaagatactttaaactgtatgtaattagcgtgcatgcatatgtgtttggggactccatttctttgagtggatcaactaagaaattcattgtcaaatgttgcacagggggtcacgtttatattccacaaagtgtcaaagatgcagaaatcagttctatacctgatacatttccctttatttatttatttatttatttatttatttatttatttattttgatggagtcttgctctgtcgcccaggctgaagtgcagtggcgtgatcacggctcactgcaacatctgcttcccaggttcaagcaattctctgcctcagcctcctgaatagctgggattaccagcacccgccaccacacccagctaatttttgtatttttagtagagatggggtttcaccatcttggccaggctggtcttgagctcctgacctcgtgatccacccgcctcagcctcccaaagtgctgggattacaggtgtgagccaccattcctggcctttttttgttttggccagagtcttgctctgtctcccaggctggagtgcagtggcgccatcttggctcaccacaacctccccctcctaggttcaagtggttctcctccctcagcctccccagtatctgggattacaggcacatgccaccatgcccggctaatttttgtatttttagtagagatgggatttcgccatgttggccaggccggtttcgaactcctgacctcaggtgatccgccagcctcggcctcacagagttctgggattacaggtgtgagtcaccgcgcccggcctatttcactttttttaacctcgatgtggactatcaaggtaaaatttttctatagaatgtatatatagccaagtcaaatgtctgcctgtgacaaaatgatcactttgcctgcttttaggcaactcctattatggtatgctagtgtagacactggccttccctgttcttttggaaacaaatgacttttctcttacacatcaactccatctgttctttttcctgtattcttctgaaatttgcaactttacttgaatttgttcagaattgtttaccaagtattgtaaagctctcacctgtatgtgttaaaaagagattttagaattgtgtaaaatcctaattgccaaccgagcatttttttatgtctgtatttaaatgattcttaggactgccagtcttctagagctaatgaatcctttcccatttggcagcagacagcttactgccaacttcctcccatctgataaatgttcccataacaacactaaggcagtctgcttagtttcattaaataccaaaattatagcctgagaaaaatgtataatgtattataccatattacagcaccttatgaaataattcatgagtgattgaattcattgtgatagggagaggcttgttcaaatactcaataaaaatgttatagtcacactttgcttaacaacagggaaacatcctgagaaatgcgtcatttgccgattttgttgtgggaacatcatagggtgtatttacacaaacctagatgatatagctgatacagggtctatttatataaacctagagaatgtgatgtagcctattgcttctcggctacaaacctgtaccacgttactgtactgaatattgtaggtaattgtaacacaaaggtaagtatttgtgtatataacatatctaaacatagaaaagacacagtaaaaatatgatgttataatcttatgggcctaccatcatgtaggcagcatgtccttggccaaaaccttgttatgcagtacgtgactgtatttctttgtagaaggaagaaaaagaaacccttgaaatctgagtcattattttgaacttcaacaaggattcagattttgtcttgatattagcagatctaatatcccaagtccattttctctacattcctaaaacctagccccttattaccaatttggataccttcactcacatacatattctaaagaacatcttcatttgtctgattaaaaaaatatttttaaagaatagttatactcttgatatataaaaagaagaaatagctattgattcatgaaaatcactatcttttagagtagtgtaagggtgtttgctacttgagagggtggatatgcttattctaagcaactccagtaacaccttgacttcatagaaatgaaagaaaggattattaataattttgcaagacttgttttgcttctcgagtattcacatagctatcccatagagcacactctgtgcatttaccatgatcggactcccacacattttattaatgcataaatttgaaattattgtttttgaccaagttgatgaatattaaagtttgaggaaactaaagaaatcacgttggtcattttcctgcttcttcagatgaaaaaatgggggcaaaaaggataagttatttccctaaagtgagccaaactgtgttggtaaggactagaatgacttatatcagtggtcgttgtcaatggattttccatggggaagtaaatgtacgtacttgagaattttgttagcgacttcatcattgcagtcactgtaaaggtttgtacttagcacacttctaaattgtatggcacatgcagttcaagatagaagtgtggaatgtagcaggcgtgcaccaaccatacttttatattttactttctatttcacatttttcttctctactttcccaaggtagttgtcaccttatcctagcttgattattataatgatgcatacatgaatattttttctattgggctattttcagtaagaatcagacagaatattttatagatagttcacgtttttgtaactttaagaataatactgaatactgcttccagcaatggccccatttctgtgtacagatggttttgatgtatgtatttcaggtatctgaagcaagcagaaaaaggcagcgctggttgatacctattttagaatcagccctacatccataaatgtatatttttgaaagatttatttctggtattttgcaatcctgttataagactatattctgtgaatttttaaagtagtgacaatatagcacataggatgggaataattttaagactaggggcattatgaggatttctgaatcagttttacttaataaaaatacagctgttcatttagatcattattaaccattaataaagctgtctttcttttgacaccagaaagaaggccagtctagttcactcaagtgacaaaacttctggtaaaaaatctgtcacagtctaaacctgtttcttttgggtggaagtgttgggttactgtaaaatccctggtctcttccccttagataatgtaaacccagattaaatcagaggctggcactgttcttatcctggggtagggaatgaggggctggggaggtgggtcagtgggcaggtatggggtaaggagataagagatagagggaaaaaactggtgagtacctagttagagcagcgtggcctgcaggaatagcactggcctctgaatcactgtttttttagaatctacttcttttccagttccaactttctaccacctaacgagctcttcttgggccctgcggccagactgccaggattggttcacatcttggctgactgtataacttgctaccttaagaattttggccacttacctaaaactcgctgagcctcagtttcctcgtctgcataatggaggtaataatagtacctttcttagggaactgtgaggattaaattagccaaacccccagaggaagctaagtcaactactattatcttggtttaagtttcttaataatttttgagccttagttatcttcattcataaaatggagtatcgtcactactgtgaagattaaataaaatggatgatattggttaaaagtacttaataaatgttactgagatatgaattaacttttagctgattaaaatgctttaactattatttgccattgcatcaaatatttgaataacaaagcttttactatgtttggtaaactgcaacttattcataggattcactaatttgggtattgaataaccagataccaaacaacaattgactgactcattcagatattatttatgggcaccagtgataggcaatcacagtagaggccacagttgaggtcactgaggccccaaaaacctagacctgccgtgtggcacctagttttaactactctcatgatttctcatctgacatttaattataatatgataccgaggcccaaagtcctaaacgtggaaactgaaaggagagcccccttaactcatcttcatttgaacctcaacaacaaaaaattaaaaaggaaaaacagttgctcccttcttaagtactgccttttaaaatgttcttgttgcacactgcttcaacttttctctgcccaccaggcttccatttgtgatctgtctgaaataactatttttgcataacacattctttcttcgctgctgatcttccctggagctgctgctgcttcccgtggggaatacagatgaggctggtgatgcaccaggagcaggccaggggactctgagatgatgactctttgtcattgtgaataattctctctgaattctcgggtttctggtgggtttttcttctttcttttcatcttcttggtataaatctagttttaattatttcacagaatatttgtctttctgaaagcttctcgtgcaaaacaaagacaaaacattaacatagtaaagttattttatcagtagcctttctctgtgttaattaggatgtatatcaatatgacatcattattttcattatttaaatgtactaaagtttaaatacttgtagcttttagacatgaattaaaaatagaactattttgaaactggtcatgaagactgagaggtttttttttttttttttttttttgcctcctaaggaaccgtttaggatgattcataaagcattttctgaaataaaaggcagaaccgtacaattctgattttaaaaaatcagggaattagagtacctcagtcttgcagctttaaaagagcagaagaaaaaaagcattgaacaaactttacattctcttgatgggtttcaaagaacatcaaaattatctaagtcaattctcttctgccagacaggagttcacttgcatcatcagcctttaagaactttgattcagcgcacacagacaccagtctcattttccttgtactaggttacctctaggatttctttagcctactcaaggcactgccatcctccctgtctcccaggcttgaaactttagagactgtcttcatttcttcttttcctcgtcccctttctctagtcagccactaagtcctacttttcatttcaatgtcttttgtgtcagctttctctttttcctatttctattgtcttcttcttgacacaaatgcctggaaggtgaaagtataaaatatcttgatattaccaaggaattaatgtgtggaactttcacaattaaatcactactgtcattactatccaataattcattgtttatttctacacctgcagttgcagtttacctggaggtactttgcatacagaaacatttttcatcacttactaagtgagaataggaccctggcctagggggaaaaacaaccacagacaaaccatacttccctgagaagcaggagcatagtgctggctagtgaattgctttcacaaaccgacctcataactctgtgccttagaaaaattagaaatgggaacatttggagatcacttgggaaaacttgaaattatgaatgttaatctgtgattgctaagggaacgtggtatttcctgcctattttgtctgtagtttgtctctttctcttctaattcatttttaaaactctgctagattaattttgctaaaataacgttttgcactcctcatttcctgtttaaaaacatgtagtgactcaccatcagttttagaaatcgatttaaaggacttcatgaaactggtttcaggccacccacagtttggcccatacctatctcctgttctccttcataaacctttcaaatctagccaaattgctttgttctttgtccctggagtatggctttctctttctttctttctttcttttttttttgagacacagtttcgctcttgttgcccaggctggagtgcaatggcacgatcacaacctccacctcctgggttcaagcgattctcctgcctcagtctcccgagtagctgggattacaagcatgtgtcaccacacccagctaattttgtatttttagtagagacggggtttctccatgttggtcaggctggtctcgaactcccgacttcaggtgatctgccggcctcagcctcccaaagtgctgggattacaggcgggagccactttgcctggcctggaatatgcctttttctattgctgtgctttattctgatttttgttttagaatagctttcaaatcttattctgtttctttaatctctcttgtgtctctctttatgccttctgggcttcacatggggactggtgtggttgtaaaggccccctgagttgagatgtggaagcaccctctgttacagagtgagggattgactcactgaaaagaactattcaagtcattcctgaattgcttacctttggtacttcttgatttagtaaagtagatttcctgttttcatatgaaaagcataattgaatcatagagcaggtactaggaatcagactgtctgggtgtgaaaccccactctgacttttactagctcttgaccataggcatagtttccgtatctctaaatgcatgtaagggtccctgtctaccttgtagggtggttgtgaggataaaaacaatacacagcacatgataagagctcaatgaatattagctgctgcctttgttattcgtattcatattattgtagatattttctgatgaatttgatactcgttcaccatttacttcaacacatttcgagttaaaagatatttcctgctttgagaataaaattatttcaagttaaaataaaaattaatctaatatacccttaagtagtaatgaggcatgtagttagtgcactgaagtagttatgtgcttcccaaagtgggaacttaaaacaaaaaggaatcttttaagcttaacaattccttatgttagtcatataattatcccttttctcagaagcctggggccaaatggatctgttcctaggagaaaggaactgtctctcctggcttaacaaagattcagtttaaaggctagctaccctctgagtcatactgctttctgatcttggagtgcttgcctctgtcccatgagaaagaaaggtggatgaacagcacttgcaggaaggaactttcatctttcttgaagccaatccaaggcctcagatgcagaaagaatgcctaccttacctcttcaggggaaaaggggtttgataaaggtgctctacataatgcgaatctgttttcattaattcatgcattcatctactcttttattatgcattcaattcctcaaccatttattgagtatatacctggtgtcaagcactgtgctagctactggacacgtcaaaaggaaagaatgagattttgtcctctgccttgagattaaggtagtttttttgtttgtttgtatgttttaacataccaagtccagtgaaatcttaaaatattttttatatggctgggcgcgttggctcacgcccgtaatcccagcactttgggaggccgaggcgggcagatcatgaggtcaagaaattgagaacatcctggccaacatggtgaaaccccgtctctactaaaaatacaaaaattagctgggtgtggtggcaggcacctgtagtcccagctactctgaaggctgaggtaggagaatcgcttgaacccaggaggtggaggttgcagtgagccgagattgcaccactgcactccagcttgggtgacagagtgagactccatcacaaaaaaaaaaaaaaaaaaaaaaaaaattctgggagtgaatgtgttctgaagcagatttacatttgctaaattccatgccaggcagaacaaatgtaattcagtgcatatttgaaattcataaaatggaagtacttgagtagttggagaacctgttattgaggtgaagaaactcaatcataattagagtcataatgattacactgggtagagtctaagcagcaatttctaaaatccagtgactctctattatctctgtgacaaaatgttggaatttaaatattacttctggaaggccaggtaatttttagatgtgttggaacacttttattgccccatagcatagctttagatttttttctttatcccaccctttccaccaatctgggaaaagaaccatttccaaattcttgtacagagtaaatcacgtgctctttaattgttggaactaattttaaattttgatactgtttataaatttactagtcagaattctgttacttgatatgttactttgggtttgaaaatgtttctcttttttattcactggtagaatacctgacttttgggagaacagcaaatatttcatggtggtaaacttgttttaattagctaacaggaccattcacagtttttgaagcattctggccaagaagtaatttagagtggaggatagaactattttcttcttgaaaacaagaaggcaggcaagcagtgttcataaggatgacatatacaagcaaatgtggtacttcataaaaaactgagttggttctattgttaagtagcatatttactccttttgacttggaaatttttttcttttaaaagtggccatgggctttatttaataacttttaccagagagcagcagagaaggccatgcatatgtccaaatgtattgtgcttttttttttctgtagaatccacatcctgtacaaccaaatgtattgtattaaaaatgaactgtgatagtaacttggtaacattgcaggaagtatgcctgagcacacagtggttctcttaatgtggttctgagattttcatgctgcttgtctttgttgacttaatcccactaggaagaggtcttcataaaattcctttttgctaggtagataacctgtgggagctgtttgttttttcctaagcaaggagaatacctacttgagtgctaataggattcttagtttggttttctaattggaagccctaattaagctctgacaagatctctttttgttgatattttgacaccctctttgttgacgtgattctttgttcaaagatcttttagcagctaaacaaacaaatgtgaggtgatgacaataattttatattccatgtaccaagtgtttatacaattctactttgccagtagtatatagtatcttcagaaatcttgaactatatgtgtactgttgaaatgaatgttattaagaaagatgaaataaacatagtaatttattttttgctgatagttgaacttagcaagttctattgttaagggatgtttatttggtataatgtcatgctttctttaggttccatgttgagaaaagcctgaattcttttctttaaaataatgcctgcctcattcagacccacacacagagtttctgcacatacaagtcagtccactgtccctacacaaaaccctttaatagcatctctttgccctttggatagaatccaaacactttaccgtcctaccacttcaccccgaatgctcagaggactgctttctgctttctgctttcttctccagccttctcttggtcctttccccttaatctccagactctagatttactagatacctaacatttaatggaatttgttaagctcccctttgacccagataaaccttactcaccctttgggtctcaaattaaatgtcactcctatgggaaatctttatcgacagaagtataccatctaatgctttcgcgttttttttccttttcttttttttagtgagactagtacacttagatttacttttaatcacacattcagtggcctatgttatctgtgatctttctagaatatatgtttatttcttgcaaggactgtttctctgcctctttcttcattgtgtcatactgtgcttgccccatggtaggttatcttaaatatttgcagattgactggttgattggttgataaggagaaagagttgtacaaggacttaatggcatgatagagaaatctgtttctagtaaaatttactcaagttatgttattgcattttatattattttctgtccaaaatctggtcttacaactgccaattttcttactttgttagtagcctatgacattacatgatcttacaaagtaaaatgtctttattcagcacctactacattagaatgtgatcatttggacagggtgtactgacagcttttagaggtaactcataaaaagaaaaatctttttcaaatatccaaaagcattatagatgtattattttacttacaaacacttctgctagttattctcaattactcttacctatttcttatcaagtttcataaggatttatgttaatacatctcaacctagatcaaagtactatatgattttccaaatattaaaagtgcatttttatgtctatctaatcattaatctatccagtcagtgctttttaactggaagaataaattaaaaacatctttaatactaaattgtggatatttagaaagaaatttagaatactacctctgctttcttcaaatattcggaaaaaattcttaagtttcaaatttgtagcaactcaaatctgcaccatacttctagttatgttgaaataatgaggtttttctattttgtatttccagaataataaaatatttgcatatgtatagaaaaataggaaacttggctgggtgcagtggctcacgcctgtaatcccagcactttgggaggccaaggcaggcaaatcatgaggtcaggagatcaagatcatcctggctaacatggtgaaaccccgtctctactaaaaatacaaaaaattagcagggtgtggtggcatgctcctgtagtcccagctactcgggaggctgaggcagtagaattgcttgaacccggaaggcggaggttgcagtgagctgagattgcgccactgcactccagcctgggcaacagagcaacactctatctcaaaaaaaaaaaaaaaaaaaaaaggaaaccttggcttagctaaattttgggaatattctttatcttttcctttgttgaaaaatgaaatgagagtaaacatttcttttttttttttttgatacagagtcttgctttgtgacccatgttggagtgcagtggtgcaatctcagctcactgcaacctccacctcccgggttcaagcgattctctgcctcaaccttcagagtagctgggactacaggagtccgccaccacgctcagctaatttttgtatttttagtagagacggtgtttcaccatcttggccaggctggttttgaactcctgacctcgtgatccacccacggcctcccaaagtgctgggattacaggcatgagccaccgtgcccggcctgagagtaaacatttctatatggaaatgaatctgttgaacctcattcagataaacaaatgaatatttggccagaacattgattattcaaccattatattcaaatcttgactgaaggtccatggtcacggtctgtgtgccattgatgaagtagcactttataaaaagctgtcaatgttaaaagtaatgtttaatggctaatgttaaaaatgaagttatatgattctaaagtcttcttatgaacttaattttgagatattataattaattttaaattttgattatacctttttcttttcaatagacctttgtggattacatgtaatttatagcatggtagagtgggcctagaagagacacacatgaaaaagtatggttatgtcccctaaggactgggactttaggagactgaactaatgtttccccaaataatatgtcgtatgctgtgatagagtccaaaaattagatgaaaataaagtattatgtgagtgccaaggaggaagcgattaatattaatttgtagaatcagaggatgctctgtagagcatttagactttattttgcttctatacagctttattaactattctatactgtgtatcatacataatgctttatttagcaatgttttcatttcagttaaaaaatactttggtcccagtaggttaatgaaaataaaaaaagattacaactgtcataccagtctatatcattatattctaatagtgataccaatcattacataaagtggcttattctcaaagcagtttaatacatgttctctcactagcaaagtgaggcaaataggatgttagcttcatttaatgaatgagaaacgtgaaacttagaagtgttgttagtaaagagcaagatctgttttacctatgtcttctattgccacacagagctctcttcacactgcacaatactgcctagaattctcaaaatttcaaagcacaaagaaagcttaagaactgttagcggtacaagaacagaatttggaagaatcatcagacaatcagacctaaagacctaggaagaataaactactaagtatagtattttgacatttggatttttaataatgatgggcctattctgaatctttcagtttcctctaacgttctgattattttattccttctatttcagtctttatatagtggggtgggtgaaagtatgtatattatcattctactcaaaatattagtgtgggtagtgtaggccagaagtcaaaaacacagactatggagttagatggcttgatttcaaatcctggctccactttgaatagccctgtgactttgggaccactgtactctctctcctagccttagtttactcatctttaaaatggaataacagctgtatgtgggcagtaggattattgtgaagttttaaataaggtgatctacataaagaccttactatgtggttttgctcattgcagactgtcaataacctagccattgttaggataatgatctaatgagatagctgaaatcttgagagtgctattgatactacctttgtctgccacttaaggtctaaattataatttaacaactgtacctaataatttgtgagtgtttgataaatgtttgaggaattaaaatattaggcttgagtttgcactgctcagttctcaactgttggttagagaaaatcattaagttgagagacttaatgttggatttttagtacctaatacttcagcagtgtgtacaacacaaagacaaaacaaacattgccattgttttggttctgatatcaaacttattctagcaaaattttttaacttagattaatgtttgactttcaccttttcctggggttgaactaatacaggatttgaaatgttaatcttttggttatataagctagagaatgaaaccaatttcttttgttattttctgattaatacatacattggtttgttaacctggataatttgtctaaaagtgatgttttctaacacttaggagaattatgtgataaagcatgtgaaggcaaagccaatttgtttaacttgtagcttcttttagttactaatgttgcaatgcatgtgaagaaagatggtgctttatgcattccaaattcaattttatctattttttatcataagcaacttctttagagtttaacagtttatgttacatgtgattatagcttcaaatacataattgcagcattttcaatagcattttcaaaaatactgattcctgaaaataaactttttgttactttttaaaatataggaaacttcaacaagacacaaattttaaaaaattatctttattcattaatatggcatgctagtaaagaatgtaagaacaatttctgtgatagactgctttagaaatcagaatatattatgctttaacaatttttttcctcatttggaatctgataataggatattctgagagatttgccagctttactctttttaacaaacatacaaaaggtgtcatggtaacatgtttgagagaacctttgactcttatctttcactaaagccttacactccttgtcctttcctgggtctgatggtacatttaccatctgagataaaagacatgctcaggcaccaggtctcttgggatcttaaagcactatcggaatccaaagaggtggcaatccagcttctttcttgttactttaaaatatatatgctaattcgatcgggaattcagctcacaaaagtaaattaattattctgccttaagaaaagtatatcaagagattaatatctctaagaaattcactatttgtaagtataaaaaataaattatggtaatgtttcttttcatggcatctaaaattcctgtttagaaagataaattagctttcatgatcaagacattaaataaataaacagcctaactacggcaactgagttaagtgttttaaataattctacgttaaaaagtgatattgagaaactagaaaatgtcacaaattttaatgggaatacttaaattgatataattattttaaatcatatatgtaatttaatattcagataattctttaaaatccatattcacccttcttggctttactttatatctagctcaaaggaaacattttttttccaagtacattttaattcagtaagaccagatttttcaaaatatcatgacaagacttagcttttagtgtatttcagcaataatgataatttcagtgtatcctaagggaaaaactgttatcttatattttggttgaaagagttgaaataaacattttgagagggaattgttattgtctacaatatgtcctagaccagtgaaattacctgattgtgtctattttggacagagacgtggatcttagccacagttacctaactgaccagattttggagttactcaatttccctcataataactagacacttgtgacagctagaaaaaataatgcagttaactttaattttatagtttctaatttgataaatattagctattttacagtataggctgttgctagccacagaggaaaatatagtatatggatatgtggtttgaatctacaaatctgtgtgtgggtatgggtgtgtgtgtgtgtgtttatatagagtgagaatgaactatggatgaacaaggaaaaaattagcaattgtagcaaatgaattgaatgcattacagttttaaaagaatagctcttggagagaatccagattggttcaatttcaagtagcaaaggtaataatatctgtgaattacctgtatgccaacattcttgtataatatttcaatgggctcagctttttctcttcactgtaataggaactctgtgtctttttttagttagtaccctttgatattctcagataaaaggcatccttttcaattctttgatcatacatgacagcaagccagcaaactctcattcatgacatttttgaaaaatactgagtcttctaatttattttaaataattgaacaacatggcaaccttttacagtaaaaagtataaaggaaattaagccagaatttaatggcatgctctaaagaacaagtgggaaattattggccataaaagaaaaactttgaactctaaatccatcattttatcaatttttgacaattcactgtattgcctttaacaacagagtctaatgggaatagcctagacttcgggacaaatctgggttcaagccccagctctgctacttattagctatgtgatctgtagcaaattttaacctttatctgcttttctcttctaatttgaaaaatgaggataaaaacagtacctatctcagaggaatgttatacaaattaaatgagatacagtttaagcatccctaatccagagcttgaaatgctacagaatttgaaactttttgagcactgacatgatgctcaaaggaaatgcttagggctgctgaaccaataagtataatgcagatattccaaatctgaaatctaaaaaacttctggtcccaagcattttggataagggatattcaatctgtactgtatgtcaagaacagtgcctggtagatagtaaatatacaataaaatgtggttcttggccaggcgtggtggctcacacctgtaatcccagcactttggaaagccgaggtgggcagatcacgaggtcaggagttcgaggccagcctgaccaacatggtgaaaccccatctctactaaaagtacaaaaattagcctggcgtggtggtgcgcacctgtagtccaagctacttgggaggctgaggcagaagaattgcttgaacccaggaggcggaggttgcagtgagccgagattgtgccactgcactccagtctgggcgacagagcgagactccatttaaaaaaaaaaaaaagtggttctttctctagtactggttctactactcctaaatgtcctaagtcaagttaattagttcatcctttataaacataggataacactgactttcaggattgttgcaagaattatgaatgacatatgaattatctagcacatccattaccctgttgcctgacacacagaaatacttggtaaatggtggctttactgcaaagctcctacctaatctgtattgttctttgaggtgtttttggataaagcagagaatatggatttcaggcttttagggactttttagagtagcagagactcaattacagaaaacacataagcataggtgagaatattccaacttgcagcatgaatagagaaaaacttcataaacttaaactattctaaatttcgatttctcatacttagatctggaccaggctgaagtttactttgaaaatatctgtgaatcaatggttttttgaactaaataaaatgtgaaacgtagttcaaagggacaagattagcttttaacataatatttttatgattttaagctcataggttatgaacaaaatgcttttgtattcattaaagccagaatctttaatttttagaaatagtttacagccatgtgtcaacttcagtgatgttatttctttttaaatattctatatttttcccactatttacatggattttcttacattttagttaaattctgagtgctttccagtaacatgtaattattgttgggtaagaaataattaattattctttctaattattttttgtaaccattagccattcccactttttccttacccccaactacccttcttagcctctggtaaccatcattctactctctgtcttcatgagtttaaatgttttaatttttagcttccacaaataagtgagaatatgtgatatttgtttttctgtgcctggcttatttcacttaacatcctgccctccatttccatccatgttgttgcaaataacaggatctcattcttttttatggctaaatagcactcccttatgtatatgtaccatgttttctttatccattcatctgttgatggacacttaggtttggctattgtaaacagtgctgcaataaacatgagagtacagatatctcttgtatatactgatttcctttctttttggcatatacccaacaatgggattgttagatcatatggtaactctatttttagttttttggggaacttccaaagtgttctccatagtggttgtactaatttacattctcaccaacagcagacaaagtttccttttaagattttttttcctgaaaacattatatatagagcagtgttttccaaaatgtgtacatcacagtccatgagaaatgaaagcaggttattgtgtcaatctagtatttttttatttaatgccaagaactagactaggaaagaaaatacgagtttactataccaatcaaagggaagtatttctaatttttgtatttgtattcatatatgtttataatggcttatgatgtaaaatatatttctaagcttgattagtgatcaaataatttacaaaagcactgcctaaagcacaaaaccttgcataaaatttgcattgttcagagattgtggcataggaaataaaatatgaaataggttttctttaccatgaacctcagggaatatctaacagtagattgaagtggactaaatagaatatcattcttctatttagctcagaaatgtttgttgatcatttatatttataggatctagagtcacagggttaataaatgtaatatctgcccttagtggtatcatagtctcctaggggagacagactgaaatcagtctattataaaaattatgatgcatgtgtaaagcaagaacaatttgcagggaataacagacttcaaagtgaataactttgtgggtacagatcaaaaggcagtaacttctgataaagattttgaaggacaaatagcagcttaccgagaccaaaaggggctagggaaagagcattctaggcattcaaatgtgtcctaaggagcagagggatgttttagcttgatatatttgcaatactattttccagctgagggaatgtgccaggagagagattggagagtttgtcaaggaaagtcccctatgctaaggataagtactttaagcttttagtatatacgtatattccaaagggtatttagtaaggaaaagacttgatcctatgtggtatatgttactattatgttttattcacttggacatgaatctgaagttagtgctggagggagcaaggctgaaggcagaaattccatctaaacttcatgtaatggtccagacagcgcttgaaccaagacagacatagtggcaacagcagtggtggtaaagatgataggattttaataaatatttaagatttggggtctaaagaaggagggtgatgagtggaaagagaaatctagaatgattttcagttccctggtttatgtgactggtttatgtgacttgatagatggtgatgccatcatccaagacaggatgtgtatgtaggcacaagtttgggcaagaaggcaatggattcattttaaatcggctgaatatgagcattttatgtgacacctaaatgaaaccacccagttgtaacagctgtttgtaatttctctggagttcatttgggagatctggtttagagacaccactctggagctatcattgtgtagacagtggtaaaatcatgcaagtggatgagattacaaagccagggataatgcctgcaattaatgaaaaatcaaaggaagtggggccacagagattgagaaagaacaatagtctagtggaacctgaggagaggtggactcaagaatacctgctgggtttgacagttaggaagtaactggtgcaatatgtccatagaaatggaatagaatggcctgggacaaggccattatgattatagtgaatcaagagtgattagggagagtgaggaaaaggaagatactcagggtggactagtctttcaggtagcttgactgaggagctatatgacagtagcaacagagaatgagagagacaagggaaaactttatgaccatggaagacattcaagtgtttataggcaaagggaaagaaaccatttgaaaagaagttagaaatagaagaaagggagtaaataattgatgatggagtgtgatccttgagaaaatagtcatgagaatactagcagactgattagctttaggtaggaataaagaccttctgagaccataaggaaagaaaaagtatgaagatagaaagggtgacgtgacataggaagtagagaaccagaaaacagagaatgtggatcccagcccactttctctcttacttgtgtggtagaaattaaactatgtgctgaaagtgaaggctaaggagaaacctggagatggtatagaaacctcctgaaagggtggctgggaaagagaactgaccagagacatggcaaaaagtagagtgagatcagcacagggattaaggtatatagccaaagaggccttgcacagtccagttccagaaaatgccactcctcacttgagtattgttgcctccctgatcattaaatattagcaaaaatactgtaaaatgatggaatccccagctgccttgctgtggaaaaatggattctacaagatgtttaccaagtttgtttccagtgtctattttcttacctgaattaattatgacagttgtttttaaaggtttactttgttttaagaaaagaagggaagccaggctcagtggctcacacctctaggtcccagctactcaggaggctgaggtgggaggatcgcttgagcctgaaagtttgaatccagcctggacaacatagtaaaaccctgtgtctacaaaaaagctggggcgggtgggtggagtaggttgtgagggttaaaggaggttatgcatgtagggtgcattgtatagtgttggtcccataattgacactcagtgattgatagatattatcattattgttgttgctattcattctgaaagtctataatgtagctttgggctgtatttagctttcctctttctcactgtctccactactctgccgatatcacgattttcttatcttttctgattcactaagcagctcttccttgtatgtcaaagtcaggtatagacaaatagttatcctatttcctcaagctcctggggatgagatttacaggaagtccaatttagtatttataaaatgcttacttctgtacagataattaaaatgctattcaggaaggcaaagtctaccgtttctagtatactttgcttccatgctaatttttggttggtgtctttaattgtattatgtattatttttatccaaacagataatttgtggtagaccacaataacttcttcttttttttttttttttaccttgtttcctcctctaaatggtgtgaaatgcttgacgattggagtgccttttcctatcatcctccattgacatgctaatgttaagttttattgtaccgcaactaagtggaatctgagattatatttaccactttgtgttataagtgtaagttcagcctttgtatcacccatcctatacattcattcgttcactcaattaagaaactttttgaggcagtcactgattaataagtcaggatgcaggagtgaacagtctccgttcttgggaagctgtgttctagtagggagagacaaagaaactggtaaatttaaagaatacaaaataagtgaggttgtaacaagtgctgtgaaagaatattaaagaagagatagaaagtgtcaggtaggaaatacaagagatggggatcagggaagacctttctgaggaaataactcttcagtagggtactcaataaataaagaggagagcagaggacatgtttaaggggaataattctgtaggtaaaggaagtgcaaaggacgtgaggtaagaattggcctggtatttttaggagagcatgaccactgtggccgaagcaaaattaatgactaggagagagggaagctgtggttagagaaggagtgggggccataacacaattcaaatatgacactgcaggggttttttgtttgtttttttgagatagtgtctctctcttttgcccaagttggcatgcagtggcgtgatctggactcactgcaacctccacctcctgggttcaagcaattctcctgcctcagcgtgtcaagtagctgtgattacaggcatgagccaccacgcccagctaatttttgtatttttagtagaggcggggtttcaccattttggtcaggctgatctcgaactcctgacctcaagtgatccacccacctcggcctcccaaggtactgggagccaccatgtgtggcccactgcagggttttgagcagagaaataaaacattggttttatggtatctttagattttaagtattatttctgtctccattatgttttagcctcttttttgactcatgagcaagtaatcaaaatgattcagtattctatgaaatgtactactagtgaaaagtatctcatagataatttaagctcaaatccccactaatttactttatgtgggtagaatactaaaaacagataatattgtttctgttaaattcaatcatgtgactcaaagaaatgagtgtctgtggatggagagacagaatcataattctgttactgtgtacacatattgggaatgcttttgacacctgcagtcattctgcatgataattctaatatcatttctctttgtccataacacaatgtttataacttggtcacagatacatttgacttttgccaaaaatgacttcaaaaaaaggactttgagtttcttcttcttaagtaaaaatataaacatattagggcccaatttttcatcttattctgaatcacataggtaatgcatcttacccagagaagataatactgataaaggaaagaagaggggaaaagaaagtgtcctcaaggcctaatattgcatgactaatcttctaagtgctgctgaggagagctgatcaaatctcccagcacttccctgtcattacagggcccagtgtttgcatagggcatgcactgggctgctgagatctgtgtcttgaaaggccagtatcttgaaaatgataatattattaagtcattagtgctgaattctgcactcagaactcagcatggatatacactaaaatctagtttaatttgaagagtaaattgcaaagagaaatataggatgagttccactttaaaactgacaaatgagtgttttcacaagtaatctcctttaggaaactgagagtgatgtttggacaattatgaattaccttttaaaaattgctatgtaaattattcattaatagtttagagaatttttatgctaatcattcacttctagtcataatactattctagtaaaatatgaaagtgctatgcagaattagttgggaaagcaatgtaaaagagataatttgttaccaacagctaaaattgtatggtaatgcctttttgccacatggcttaaaaatacccggaaaaaaaaaagattttaaagacttcaggtgaatttaactgtattgttctatttactctagcatatcttttcaagtagtaatagttgttgcagtggatttacaccccaagccaatagaaaaaagagttaaggttctcaaagccttttatcttttgtgttatttattgagtagttacaggacaaaagcacacaagcaaacccaacaaacagcaacaacgacaaaaaaaaaaaaaaaaaaaaacacaaaaaaaaccctcaaaagtcactttgggtagaagatccattccactttgtaaatttatcaggactctgttcatgttcactctttcctggcatatacccaaagcactgtttccacatctgtcatattcttttaggggtcgaataaagtatttgtgagctcccacaatgtacagatgcaaggcataatctgggtacttagaggacacagaaaggctgtctttgtcttctgaatgtctgcataaatttgtatgaacattagtaggagttaaaagaatcctgggcttgaccctatcactggtcagccaaaatacctttaatgggttgtccttttttttttttttttttttgagacggagtctcactctgtcacccaggcttggagtgcagtggtgggatctcagctccctgcaagctccgcctcctgggttcacaccattctcctgcctcagcctccctagtagctgggactacaggtgcctgccaccacacctggctaattttgtttttgtatttttagtagagacggggtttcactgtgttagcaggatggtcttgatctcctgacgttgtgatccacctgcctcagcttcccaaagtgctgggattacaggagtgagccaccatgcccggcctagtttccttaaactgtttacataaattaaaatacttggattgtttactgttttatttgaggattaaggaaaatagtatatgtgaatgttttcttaaaaagtgtttttcacatgttaggttttcataatattttgacattatttatatcacttcaatttcatatatttgtcatattataaaattattaacaatgaaaagttacaaatgtaaccttatgcatatgtagtatcatagtcataagtttacatctgtgaccttgtatgtaaccatatgtaaaatactcatgtattatatcagtatacaatgaatagtagagcaagcctaattagatttcagacaaataagagtgcagagtggaatgcttttgttatacaggggagcatccctaatctgaaaatttgagaattccaaaaggctccaaattctgaaactttttgagtaccaacatgacactccaaggaaatgctcattggaatatttaagattttagatttttggattagggatggataacttttcagtagataaatattctaaaacccaaaaaatccaaaatacaaaacacttctgttcccaagcatttcagataagagataattgacctgtaataatagctaccatttatataaacctactatgtttcagctaatgtgctcggtgattaaatatatcacacaataaaccaatgaatagatgtcttatttctgttttagagatgagaactctgatgttcattggagcttagttacttacccaaaaattatgcacttaaggaaagaaaagccaagattcaaatcagttatgtaaatatcaaagctcaagcccataaccattccaaccatttctccaaagggattgatgagacaaggctgcagacgtgagagagaaccagtttgtattgagaggacagaatatgttatggtagtgccatgatgaggaatttagatttctgtcatttaggcaaaaggcaaccattgcttatttctgcccagatgagtgatatgataaaagcaatacttaaagattagtgagatcttgattttacagatatggaaatacaactgctcgcttgttagtgacctgttttatataatgcagaataataaagacaaagtccttgctggtttgaattttttatttttttgtgcatgtgtgtggaaggtttttttttttttttgtggactgacagctgtgagttataatgagcttcccaaatttatgtgtacctactctcagcccatggagagtagtaaattgctctctttcttatgacacatttagattaggagaaaacgttgagaggagggaagcattgcattggctagttaaaactaatgtaggatgatgatcctgtgaaaagaataaaatcagccacagtgaaaagtaaaaatatcccacaggcagacacctagaccagagagagtgggtgctcagctcttccaaaggacatcagcctacccttgctctgggaagccctagcctttggtttggttgggtagggaagggatactggcattgaggtgctccacagagaagctgtggaaatgacatgattcccaatagcacacctgggagagcctggacaggtttatttgcgttctcacaccgagcatgacacctgggaactgcaaaccattcctcagccacagagacagccagctttgttgtctctgtaattccttatttaaagtggtcttttagttgtatttcagggcatgactcagtcagattccctactactccccccatcttgcctttttaattgctttgggatgaaataatcctaggtttggaaagtaatttagcaatcttctactgtagataatatcagaaaatccccactgtaatatgcctggtaacctgtactccattaagcaaatacttgttgagcccttcttttatgtaactacagaggtacatatttaaatagacacctctcttacagtcaaggaaaattatactaatcaaacaacaatatactttacaattctaaggtgcacttttttaatattttagctactatgaaatttgcctggttctcaagtggctgttggtcaaacactagtcatgatatatttatagttgtcattgcccgctcatgcacgaactcagttatagctgtttatattgtctctttgagttataagcattgttggaaccacgtatgttgagtttaattgctatttaatgtcttcaagtaactaaatgttattgttcaaaaacacacagacaaaaggcagtgaggtgcacattagtaatagaaaagaaaatattcattattgattggatgactgtctgcatttcccaattttcacacaaaacaaaacccaaatgctttgtaggaaggacttgagaaataaagattaccataagctgatgaagcctgttatattttcttgccaacatacaagcagaagagcacatatcatacatcaaacaaggaagtccagcaacaaaatccttgttataatactggagtgctcctttaaaaacattgcttcatgaacacttttttttttttgaggcggagtctcgttctgtcacccaggctccagtgcactggcgcgatcttggttcactgcaacctctgcctcccgggttcaagccattctcctgcctcagcctgccaagtagctgggactacaggcacatgccaccatgtccagctaatttttgtatttttagtagagacggggtttcattatgttggccaggttggtctctaactcctgacctccagtgatctacccacctcagcctcccaaattgctgggattacacacccggctgatgaacacatttgatagcacagatgatatttggtgtaaaaacatgaatgatactgatgtgaaaaatgactgatgagccaaagtcaatgggaagaagatttgggaatatattaatcaatgtttcacttataaagtatgataaagattctaagtgataggaaaacattttgttgtttaaaaatagataaactaatcatatgtcttataatcagtggtatattgaaatatggtagtgacagccacaatgcaatatactttttaatcctcagacagccctgcaaggtggaatattattatttcagttttacatatgagaacatttaaatgaatagttcaatatatcatagctgattagtgctagtgctgccatttgaaccagagttcaagctgtttacccaaagtaagttgccatgagtggagagaataattaatcagaaagaagaaaatgaaagtaaaaacaggaataggataaaataaaaataacgacttggtgtttcacactttgcttaaatgtttctagtgtgggtgagctcattacatcacagtgccagctattccattctgaatggttttcttgttataaatgaattttctttttcttcagttgaactaagtgggcttccttttaactttcactcatttgcttttattctgccctctgggggagaggagggaaccagagaaaataagtgaaaataagcttggtgcctcatgcatgaaagcctctctgatacttgagcacaggtatcatgctgccattgattctgttttttagaccaggtagcctccgtttttcttataaaacagtgtttcaagacccagaataatgttaatcctgagtgtattctgttttgccagtgtgtgttaaaaatacggagttcagaataaactgttgcactaagggtttcaacacagacatggcagacatggcacacattgcatgtaccaacgactaaaatttccaggacatttttcaggtgatcgttatggacccaggcttctcacatattgatttttttttttttttgagaaggattaaaatttttttattgttattatactttaagttctgtgatacgtgtgcagaaggtgcaggtttgttacataggtatacatgtgccatcgtggtttgctgcacccattagcccatcatgtacattaggtatttctcctcatgctatccctcccctaggcccccacccttccacaggccctggtgtgtgatgttcccctccttgtgcccatattttctcattgttcagttcccacttatgagtgagaacatgcggtgtttggttttctgttcctgtgttattttgctgagaatgatggtttccagcttcatccatgtcccagcaaaggacataaattcatccttttttatggctgcacagtatatatgtgccacattttctttatccagtctaacattgatggacatttggattgtccccaagtctttgctattgtgaatagtgctgaaataaacatacgtgtgcatgtgtctttatagtagaatgatttattattctttgggtatatacccagtaataagattgctaggtcaaatggtatttccagttctagatccttgaggaattgccacactgtcttccacaatggttgaactaatttacattcccaccaacagtgcaaaatctttcctatttctctacatcctctccagcatctgttgtttcctcatgttttaatgatatggccattctaactggcgtgagatgacattgtggttttgatttacatttctctaatgaccagtgataatgtgctttttttgtttgttggccacataaatgtcttcttttgaaaagtgtctgttcatatccttcacccactttttgatgagcttctttgtttttttcttgtaaatttaagttccttgtacattctggatattagccctttgtcagatggacagattgcaaacattttcttccattctgtaggttgcctgttcattctgatgatagtttcttttgctctgcagaagctctttagtttaattagatcctatttgtcaattttgggttttgttgccattgcttttggtgttttagtcatgaagtctttgccgacgtcctgaatggtattgcctaggttttcttctagggtttttatggttttaggtcttacatttaaatctttaatccatctttagttaatttttgtataaggtgtaaggaagaggtccagtttcagttttctgcatatagctagccagttttcccaacaccattatttaaatagggaatccttccctcattgcttctttttgtcaggtttgtcaaagatcagatagctgtagatgtgtggtgttatttctgatgcccgtgttctgttccattggtctatatatctgttttggtaccagtaccatgctgttttggttactgtagccttgtagtatagtttgaagtcaggtagcttgatgcctccagctttgttctttttgcttaggattgtcttggttatatgggctcttttttggttccatgtgaaatttaaagtagttttttttctattcctgtgaagaaagtcaatggtagcttaatgggaatagcattgaatctataaattactttgagcagtatggccattttcatgatattgatccttcctatccatgagcatggaatgtttttccatttgtttgtgtcctctcatttctttgagcagtggtttgtagttctgcttgaagaggtccttcacatcccatataagttggattcctaggtaattaattctctttgtagcagttgtgaatgggagtttgctcatgatttatttctctgtctattattggtgtataggaaaacatgtgatttttgcacattgattttgtatcctgagactttgctgaagttgcttatcagcttaaggacttttggggctgagatgatgtgtttttctaaatatacaatcttgtcgtcagccaacagagataatttgacttcttctcttcctatttgaatacctttatttctttctcttgcctgactgccctggccagaacttccagtactatgttgagtaggagtagtgagagaggccatccttgtcttgtgccagttttcaaagggaatgcttccagctttttcccattcagtatgatattggctgtgggtttgccataaacagctcttattactttgagatacgttctatcaatacctagtttattgagtgtttttagcatgaaggagtgttgaattttatcgaaggccttttttgcatctattgaaataatcatgtggtttttgtccttggttctgtttatgtgatggattatgtttattggtttgcgtatgttgaaccagccttgcatcccagggatgaagctgactttatcgtggtggataagctttttgatgtgctgctgtattcagtttgccagtattttattgaggatttttgaatagatgtccatcagggatattggcctgaaattttcttttttggttgtgtctcttccagcgtttagtgtcaggatgatgctggcctcataagatgagatagggaggagtccctctttttctcttgtttggaatattttcacatgaaatggtaccagctcatctttgtacctctggtagaattcggctgtgaatacatctggtcctgggctttttttggttggtaggctattaattactgcctcaatttcagacttgttattggtctattcagggattcaacttcttcctggtttagtcttgggagggtgtatgtgtccaggaatttatccatttcttctagattttctagtttattcatgtagaggtgttaatagtattctctgatggtagtttttatttctgtgggatcagtggtgatcacccctttatcattttttagtgtttctatttgattcatctctcttttattttttattagtctgtctagtggtctattttcttaatcttttcaaaaaaccagctcctggaatcactgatttttttgaaggtttttttgtgtctctatgtcctttggttctgctctgatcttagttatttcttgtcttctgctagcttttgaatttgtttgctcttgcttctctagctctttaattgtgatgttagggtgtagattttagatctttcccactttctcctgtgggcatttagtgctataaatttccgtctgtacacttctttagctgtgtcccagagaatctggtacattgtgtctttgttctcattggtttcaaataacttctttatgtctgccttcatttggttatttacccagtggtcattcaggagcaggttgttcagtttccatgtagttgtgtggttttgagtggctttcttaatcctgagttctaatttgattgcactgtggtctgagagactgttcattatgatttccattcttttacatttgctgagaagtgttttacttcaaattatgtggtcagttttagaataagtgtgatgtggtgctgagaagaatgtatattctgttgatttgggatggagagttctgtagatgtctattaggtctgcttggtccagagctgagttcaagttctgaatatccttgttaattttctgtctcattaatctgtctcatattgacagtggggtgttaaagtctcccactattattgtgtgggagtctaagtctctttgtaggtctcttagaacttggtttatgaatctgggtgctcctgtattggatgcatatatatttaggatagttagctcttcttgttgcattgatccctttaccattatgtaatgcccttctttgtctttttttttatctttgttggtttaaagtctgttttatcagaaactaggattgcaaccactgcttttttttttttttctttctatttgcttggtaaatcttcctccattcctttgatttgaacctatgtgtgtctttgcacatgagatgggtctcctgaatacagcacaccaatgggtcttgactctgtatcccatttgccagtctgtgcctttttattttatttatttatttatttatttatttatttatttatttattttgagacggagtctcacttttgtcacccagcctggagtacaatggcgcgatcttggttcactacaacctccaactcttgggttcaagcagttctcctgcctcagccttccaagagctgggaatataggcccccaccaccatgccccactaatatttgcgttcttagtagagacggggtttcaccaggttggccagcctggccaggctagtttcaaactccctaatctcaggtgatctgcccacctcggcctcccaaagtgctgggattacaggtgtgagccaccacacccagcccagtctatgccttttaattggggcatttagcccatttttatttaaggttaatattgttatgtgtgaatttgatcctgtcattatgatgctagctggatgttttgcccattagttgatggagtttcttcataatatcgatagactttacattttggtttgtttttgcaatggttggtaccagtttttcctttcgatatttagtgcttccttcaggaactcttgtaaggcaggcctggtagtgacagaattcctcagcatttgcttgtctataaaggattttatttctccttcatttatgaggctggatataaaattctgggttgaaaattcttttcttttagaatgctgaatattggcccccactctcttctggcttgtagggtttctgcagagagatcccctgttagtctgatgggcttccatttgtgggtaacccaaccattctctctggctgctctttacattttttccttcatttcaaccttggttaatctgacaattatgtgttttagggttgctcttctcaaggagtatctttgtggtgctctctgtgtttcctgaatttggatgttggcctgtcttactaggttgaggaagttctcctggataatatattgaactgttttttccaacttggttccattctccccatcactttcaggtaccccaatcaaacataggtttggtcttttcacattgtcctgtatttcttggaggctttgtttgttcctttttattcttttttctgtaatcttgtcttcatgctctgtttcattaaggtgatcttctatctctgatatcctttcttccgcttggtcaatttggctgttgcttcttctatgtgcttcattaagttctcgtgctctgtttttcagctccatcaggtcatttatgttcttctctaaactggttattctagttagcaattcctctaaccttgtatcaatgttcttagcttccttacattgggttaaaacatgcttctttagctcaggaggagtttgttattatgcatccctctgaagcctacttctgtcaattggtcaaactcattctccatccagctttgttcccttgctggtgaggagttgtgatcctttggaggagaagaggcattctggtttttggaattttcagcctttttgcactggtttgtcctcatcttcgtgaatttatctacctttggtctttgatgctgttgaccttcagatggagtttctgtgtggacattgtttttgttgatgttgatgctattcctttctgtttgttagttttccttctaacagtcaggcccctctgctgcaggtctgctggagtttgctggaggtccactccagaccctgtttgcctggttatcactagcagaggctgcagaacaacagattgctgcttgttccttcctctagaagctttgtcccagaggggcacccaccagatgccagccagagctttcctatatgagatgtctgttgacccctgctgggaggtgtctcccagtgatgaggcacggggatcagggacccacttgaggaggcagtctgtcccttagcagaactcaagcactgtgctgggagatctgctgctctcttcagagctggcagacaggaacgtttaagtctactgaagctgtgcccacagctgccctttccccaggtgttctgtcccagggagatgggagttttatctataagcccctgactggggctgctgccattctttcagagatgccctgcccagagaggaggaatctagagaggcattctggctacatcgtcattgctgagctgtggtttgctctgcccagtctgaatttccctgggctttgtttacactgtgaggggaaaactgcctactcaagcctcagtaatggcagatgtccctcaccacaccaagctcaaaagtcccaggtcaacttcagactgctgtcctggcaacaagaatttccagtcagtgtatcatagcttgctgggctccatgggggtgggatctgctgagcaagaccacttggctccctggtttcagccccctttccaggggagtgaatggttccatctcgcttgtcttccagccaccactggggtatgaaaaaaaactcctgcagctagcttggtgcctgcccaaacagccgcccagttttgtgcttgaaacccagggcccttgtggtgtagccacccgagggaatctcttggtttatgggtcgcaaaggccgtggggaaagcgtagtatctgggccggagagcactgtccctcacagcacagttcctcaaggcttcccttggctagaggagggagtttcacaaccccttgcacttcccaggtaaggtgacgccccgccctgcttctgcttgccctctgtgggttatagccactgtgtaaccagtcccagtgaaatgaaccgggtacctcagttggaaatgcagaaatcaccagccttttgcattggtgtcgctgggagctgcagacaggagctgttcctattcggccatcttgcccaggaatcaaaaattaattttaataaaaaattttaattgacaaatgataattgtgtccatattcatggtgtacaacatagtgatgtttcaatacatataatgtatgatggatgatcagaccaaggtaattagcatatccatcatcacaaacatttatcatttctttgtgttgggaacacccaatatccttttcactatttgaaaatacataaaatattaattctagtcatcctgtagtggtatagaacactataactcattcctcctatctagctgcaattttgagaaggatttttatgttagctctcagggcacatagcctcttattaggatagggaagactggacaagtctgtggcctagatatctctatgtgagggatgcctttccataaagactcaggggcttatgatggcagaaagtcctatatgtacatcagagatgtagtagctgacatcagtaaggatcctgtatagagcacagtccccagagtgagactgccttggtttgaattccagctctgctacttatcagcttggacaattgcttaatctttctcaattctccatctgggaaatgatgataaatacttgtactcacctcctatggttacagaaaggttaattgaactatttcatccaaaatgcttagaaacattgcttgacatattttaagactcaaaatgttgttgttgttattgttgttgtgcatatgtatagcaatagaactcaaataattgagtaatacatttggtgtatttgtttcttagggctggcctcaacaaagtgctaccaaccgagtcacttaaaacaacagaaatttattgtctcacagttctggaggccagaagcctgaaatcaggatgtaggcggggccttcttgcctctgaaacctctagaagtagatccttgcctcttccagcttctggtagctccaggcctttttttggcttgtgacagcaagattccattttctgcctccatctttacatggcctctctgattctgcctgtgttcaagtgtttctttaattataaagacaccagttatattggattaaggcccatcccaatcaagcgtgacctgattacatctgcaaagatcctatttctaagtatagtcacatttgtggctaccaggggttaggtcatcaacatatttttggtggggggtagagcacagtttaacccataatatctagaacagagacattcaaagtagaggaactggatgtaccagaagcaagcagagggcactaatggagttgggggtgaggtggaagatctaacaaaagctgatattttgacatttaactagtgaataggcctagaggtttctctgaataaatgatacacccaaatcaaacctcagataagggaaaacaagatttctgtcccctgggatgggtgtaaggggcagaatttggacttaaatcctagaggaatcagggtattgaacagattctcaagatgtaagcagtagacttacacttggcacttaccctgttcacttttggaaatgtctttccttaaacatgggataaatggcatcttggcaatttcaaagtgttaatgtactattaacaaccttcataaaaacagcattgtagattgtagttgcctggccattttccaacacaggtagattttacttatgtaaggtgtttttgagatcttctgggaatgagaatgtgtttattttctgtttttgatacttaactaagtttgctttgtgtagccaataggtattgtctcatctcgagagctttactggtggataaatatgagttcgtcaggtttttgaagtgtttaaagatacaatgaataaaaggtgcatcataaaaagaggtctattatcataatctctgtatctgtacgatcagaatttccatagtaatcagtcttgatttcctaaatacaggattatgactgtaagtgagaagcaataatctctgaaatattaaggaaattcatcttttgtatcttagtaaaaaagtattttgtgaataccatattaatgacaactgtggaaagagaaatatggaaattgtacttaacttagaattttctaatccttacaggaatttgaatcaacgaagattagatcatcccctaagtgggtttttatatagttgtttcatttccagttttccatgcctttttaacacttgatctttgtatgaaaactactgccatattcagagacatgagtcatggtacttaaaatgttttcaccatattttagacatcacaggatactacagtaggagaagagtagtctcttggcattcacaatttttacattgtaagatttgacctttcacagtagttcattacatgtgttaatttaactcatgcattattctagcagatttctcagcatatgaatttcattttggcttttcctttaaaaatattgtgtataaatttacctgcacatctctcttcctaccccctaccatgtagtatgagtgtttatttcctatgaaaaaagatatccatgaaaagaaagcaagttccattgaaagtgagaagaaagtgatgaggtgatgacttaatagccagaaagaatggcttcagataaactaaagaataaaatgtcatattgttcagggatttagatctgtaatataaatgaatctattataaattctatgcagaaactaggtggggtgaatataaaatggtttcagtgagttttccaggtcttgccaagattgctgaagtaagaacctgacctctagccaaggcactggaatggctactgcaatgatctttatgataaagagaaatatataagagtttttacttcttaaaaaatgcacaaacccctgcttgtgattgttgcctggaatatttttcccaatcccttttcttttgataataggcttagccttcctcctaccagtaggagggagtgaacacatgacccaaaactggccagtcagtatgcaccattccctggatgcagtgattgactcatgagtgtgcaggagaccttcagagggccagtcacatttatttcatggcatagttttgctggaattggtggatctaacttttaggttatcgagctggctggatgtgatttagaagatacttggagtaggtgcaagtgcagtaggtgaaagtaagatcaaagtgcagagagaagttgatcaagagtgaaagaggcaggcttcctttaagctcagatccatttgcgcctgaaggcggtgtttatattgtactgcattttatgagggaaagatatgtttagtaatgttcgtgaatggcaagatttgcaaagagcttaagagaagatcctgcaagtggcttaagtttctatagtatcttataccccccctgcctatgtgctaacgagcatttagacttcattagctttgaggctttgatgaattgaatctctattttaagatacctcgaaactctttgcttcatttgaagtacattatatttacaaacagtgaaaagaatattttacatctgtagatgaaaagtgaaagcaagatgtaaagtgcatcaattaataattcagtaacctgtgaatatttagctactttaataatgaatatcaatgtgaaagagctctgtaaatgatgggattttaaaagcatggtagtaaaatgtgctcctcaacaccaatacagttttctctttctttctttctttctttctttctttctttctttctttctttctttctttctttctttctttctttctttctctttctttctttctttctttctttctttctttctttctttctttctttctttctttctttctgtctctctctccctctctttctttctttttctttctttctcttttttctttttttgagacagagtcttgctctgttgccccagctggagtgcaatggcacgatcccggctcactgcaacctctgcctcctgggctcaagcaattctgcctcagccttccaagtagctgagattacatgcctggctaatttttgtattgttttagtagagacggagtttcaccatattggccaggctggtctggaactcctaggaacctcagctgatctttccaccttggcctcccaaagttctgggattacaggcatgagccaccacacccagcccaacatagttatttctatgtacttcattaatatgtaatttctattttaaatatttctgcagtttttttttctaatttggtcatattgtgtgaaaagtggtaaataagaaagcagtgtcatcttgcttgcactttacatctacagatgtaaaattgggaccatcagttacccattacctagcattcaattaaagaaggcaagatagaaaataagatatacaaaactctttaaaagcctagcctgatgctagtgatattttaacattgaaatattattgtaaccatttattaaggggatagttctaatcaagtggtgctaaagaaagctgtggtatagtaggaatagggagcttaccttctgccgaagtattaacctgtaccagttattctagctgtcttctgtgagagtactattctgtacaagttactacaactttatcaaattttttatctttacaaccactttgtatgggagatgatattgtccttattcttaagaacttgaggcttagataggtataattacttgccagaagcaagatagagtctttctgttgcccatttttcttccatggctcctctttggatgaaattcaagcttcctagcctggatgacaagaccctgattatctatcccttgttaatcttttggggggtttttttgtatattttgtagagatctggtttcaccacgttgtgcaggctggtctcgaattcataggctcaagcgatctgcccacctccacctcccaaaatgctaggattataggcgtgagccactgtgcctggcctgtcccttgttaatctttacagcgtcatatcttttcattccacacctaaacttcaagtttatagatctttcacttcctgtaatatgacatatgttgtttctactgtgagcaacattccctttcatgtcccactgttctgtgactaactcctcttcattcatcaagtttccgcttaagtaccacatcctccaggagacttcatcaagttcaccattgatgagcatgatgaatgagtccaccatgaacaatgcccattgcattgttccttcattcattcagcaaatatttattgaggatcccctatgtgccaggcactatcctaggccctaggaatgcaacaatagacaaagaagaataaaaatctctgcctttgtagcttgtaccctagtattattaattatttaattcagtgtcactcattagatgtttacttctgttaacattcttggggtctaacacaatgggatattaaaagaatgtggtaagcatttaatatttattgaatcaaaggagagatgaatggcttcacttattattttaatttataattgtcttgaagaagtcaaagaatgttctgtttggccccttttatcttttcacactgccaccatcataataccagacctcattgtcttgtgactgtagtaatgcagcaaacctcaaattaaaagcaactttttttttcaatttttcttcaccattggattctgcatagaattaccagatttatcttcctaaacattacaggaattgttctcctcgaaataccttatgctggaatttgagacccttataatataatgtcaccatccttctctgatttatctctagatgtttcacatatactctctgttcaatccagttttttgtttgttttttgcaatccacttattttgattcatttgcacctttctgcctagaggtctttcagcttatgacaaatttcatcaatgctgcaagtcacttctttttggttaagtcttctttgataatgtcagccaaccttcttttccttaatttctgatttcctgtaagaattactgtctatacctatagtattccaaagccttttgtaagcagcagaatctaccctgtgtcacatctgtaacataagtacgtgtgcacatatgcacacatgtacctgtgtacacacacacacatacaaagagctcttacatggaaatccaaggtataaaaaaagttaaaagtatagcttactgtactaatgaccctgacactcctcaagaacccttccactccacagaacatacttgaagccagtgttgtgacctcagtcacactggtctttggttcctctcactattccaaagaaaaagtcagaagtggtcaggatgacttagcattgctgagagaaaaattactttctcatgaaacagaaggaaagagtcatatttgtcatacctgctacagcaaccatttcaagccttgtgttttttgacttcccatcacttcccaggaaacatgtgcagggaacagggagtaaagtcagatttcatccctttctcaggttctgagacacttgaaatgctagagagcctctaaactagattcttctgaaactgttttagcagttcacatttcacatatgtgtggaccacagagaaaagtccatggtcaaacgtcagtgtctccttattgataaaaggccagatcaggagcagttaactagctggaggccccatctgttttctgttcatatgtgtaagtctgtatatcccaagcatactctatgttccttgagaaaatcagttgtatttgtatactgtaactataaagttactcattatttttaaattatttcatataggcttatcttcccaacaagttcaaaaaaataatgactattttttttaattctccattacacctatggcacagcaggtacttaataactacctgttaattaaaatgaaataaaatatcctagtttatgtacttagctattatttagagttttagaacgtttttctgttctgacatattaactttatatacaatataactgtagggaaatcaagcgttatttgtaaaatatatttcagatttgtgacatgactaataagagatttaggatttttaaagacacttatgtcttaaaactatgtattaagaacatctaaaatttttgtttaaatacattaagcaaggaatatagaagatgcgaagaattttggaaatttaatgaagtaatgtttataaggtaatgcagctagaaattgtgtggttttataaggcaaacttttctcaataagaagcagtttaataacttatcaaatacatattatgaatatgtgtttcaattttctgcattttgtcaaaggaagggagaagagttgattgataatcctgactgatctttttagcaattctagtatataaacaacactcatcatttttaattgacaaaaatttaactaaatttgaaattaggattgctaatgaatcacaatttattatgaaccagcagctattttatgttttccaaacacctgtgttaattttctatgatcactcagtttatatgccatatataccatgttaggcaaacatgatttttgcatagtttccttagatatttgtggtatactgaagaaacaagaaacttaagacccgattcatgtttaaattagagacagccacatatgtaaattttcaaaatattcaaagactttatggatgttatgatttaagtcagtttaagatactgtgacacctatttgttttatagaggtaaacaaaaatgattcatctcactgtggcatataaaaaaacttttatatagtgtcttcaattgaacattagtcctgacatgtaaatttaagataatctaatctaagttctcagatttttagatttgtacttcttttggacaaagaaaacaatctcatgccttttcttaatgtaatttgaaatttcaaagtgaaaacatcattataaaagtaaatgtaaagtatttataatttaacaattatttttagaaaaattatatatgctactgcctctgttgagtaatgtgatggatggaaatgggcaataaaatgatttgcccatatcagacatcaacgggagacctaaggcctaaacccgtaggagtttccagtacagagagggaaatccactgatgtcaggaagctgatgcttttcagtaccattgtttatatctacatcttctcaagtatgcccttcttgaagccatatttttatttttgttattatcccagtataatgcagcacaagtgaaacgtcaaccagtcttcagtgtttattcatcttttaatacagaatatttagtaaatatttcatgtttcagtgttttattcattgtttggatatttaactgaataaatatttctggaatatctacctagtgaaagatatgtaagggaatgaaagatagatttttaaaatctagtcagaattaataaatgggttcaatgcctttgtcagacttatttttcagataacactttttcttaacagattttcttagattttaaatgaaccttttcaaatatgtctgaacaatattttaataatttatcaattcacaattacatatttaatttccaaatatgctgcacataacaagtaagctcatatatttttactgagggaagtgatagtggataatcagtctaatcattcctttgcttaaggcatttaaatattgccatataagaatagcacttactagctttgttcacttactggaaattagatggagctgaatacttaaaagtcaattttagccaaaacccttctgctgatattcccactgcctataattgccaaattaataatgaatatgtggactttagaattaaatgtcattccttgcttgccttaagattttaaaatattaaaaacaaaataatcctttaaattgtcaaaatgtgaggactatcatgacaaggaagaggagtgattttctttttttccctatgtagaaaattttccttaactgagttttccagaaatctaagaaagttttgtgtttttttgtttttgtttttgtttttgttttttcaaaaaatccatttggtgaaatgtcttacattacttctgtttactccgtcacttccagcttttgaaacattactaccattacatagctgtggaacacagtggtcttgtaaatgagctttgctacaaaagaaaatgagactaactggaaactcgtcacggtgctgccactctgaaagactggtagtatcaccaaagccatttagagatattaccactcttagaaaatggaaattgtggagtatgagacctagtctatttgatttcagccttaatagctttcaatatatgatagcatacatttggataaaatgtggaaaaatatagaacaactttttgtgtagtttactcatggccacattgattacagatgtttaattcatctatctaaatcttgcagaacattcaaaatgtttcttaggtagacagtttctgaaataactgccctgtctgctgtttcacattttgttagtacataccatgtgccaagcttttttcttccttacattgcttgcttcattgtttaaaaaaaaaaaaaaaaaaaaaaatctgtaagttctgagtctccttatagatgaggcagcagaggccttttacaaatacctctcttgttccagttacacaagtcataatttactgagcacgatggtaaaatcctttaaaaatgtagtaaaaagaacagagtatgcatatgcaaaggaggagattggggaaagcaaattagaagtctatgcattctgtagacagtgaaagctggttcaagcagaatgaataagaaagtaatttaaaaagaaggcatcacttattgactaaggtcaaacaggaggaatacacataaaaaccagaaactaacttcaagcagaatgaataagaaagtaatttaaaaagaaggcatcacttattgactaaggtcaaacaggaggaatacacataaaaaccagaaactaacagcaattatgatgataatattccaaaaaaaatctgagtgaagaagaagaagaagaagagtaatagcaaacccttgtgataataagtgccaggtgtgtagtatgtgctgctattaaagtaaatgatgttcaattatttaatttataattctggtttcatgatagtcctttaaaggaagtgctattttgatgttcatctttacatgtgaagaaacagataaagagagattagctgattctccagggtcactcagctgattgggtggtggaaattggctttggaaccaagcagtctggcatcgtagtcttagttcctaaccattgcactatactgcctctccaaagggtgaaagaacatatccaggaaaaagcaaaatgccagaaatgaaagaatactgagtgagacacagtgttaagaaacactaagattttttaaaagccctagaaacataggcttggaaggcccaaagtggaaacactaagacagccgaacaccccagatctggacagtaatgacagtccatctttcagggtcctagagggagttaatctgaaacctgagatgagtatttctaaagtgaaaattagtaatttattaataataacttattaatatttatatgtagtttatatgtactgatcaaatttgtatacattcggctgaaattatatcaacttataatgttcatccaatactcttgatgggctggtgatgataatcaaggaccttgtaaactacataatgtaaataaattcacatatcaaatagccactggtttccaggactgaccaaacttggacacaagaacagggtgatgaacaaatttaattaaatactgtcataaatgttatacatacttacttgtaattatatattgtaattgtatattgtaattatatattgtaattatatattggcaccacaaccgtgactataatttatataatgctatgatgctattataaacccttaataattaggcatctttattataatattatttggtgctaaaatggaaaaatagtggtatcagatggaaaaaaatgcattccttattcaataaattaaatcttttaaagtattcaatcaatggaggaaaaactgcaaaaaaaaatctcagtggtgagaacactcatctttaggacaaaaacataaacataggttgcattaatttactttttattgattgcaatagtacactgtggtcataatgatggtattgtatatgcttgggcctttgataaaatagtttttaacatgtagactattctgttttgtttccatctgattacagttacgaactgagaattaggggatgaatgaagtatttagtactggtttattgtaattgttaataactattgtaatctacaatatattttattctttcttttttaatttccctgcactgtttctcattaacattggctaacagtttatttatcttcataaaacagcatcataaatataaagaaatgtttaaaatactgctattaatctgtactggtgctattattgttttgtatttgattttatagctttattgtttcttttaaaatccttgcaatttcatatatatataattttttattaccaaaaaagtgctggtagaaatttctgtatttaccaaattttgatttgatttagagactttttcattattgttctatatcatcaaaccagaatgacctggttaataattcacagtttgttttttataaagtgcctaaaacatatttatcctttgaaaaagtaatattccctatgggaaaatattattttgaaatatacctctttagtaaattagaacgatgttattttttcttatttagtttattttatgatacagatttctagatataagcaaatgctgtaataaactgcagtgtcccctttatctgagtaattgtctgattttagaagtttgtgcattctgttaatgaactacacatagctggctagctggtttgtacttgaacttaccatccacttatggttccataaccctggattatcaacaggaggaagcagatatatacttgtagtatatatctgtggttaacctctaacaaaacctctaaacaaaatctttctctgcaaaattgtagattttggaaaagaagaaagttttggtaaatagaatatccaaaaaccaaatcaataaattcaataaattaatctcctcatgctgagaattagacataaatttagttctttaacattatggattttattgtcttggggaactgtggctattatggaaaaaacactgggttgaagtaaaggaagctgaaagtagtgaggaactccaatggtgaaaattgctaaacgattcagtaacgtcttttctaaaggaaaaattgtgatctgttagtttagtatgaactggaaaaacttgtataagaagtttttctacttcatgcaagtcttccaagatgataaaagccagtattttggagaaactaaaaggtctttatagaaaaataaataatgagtcaagaattaagagcacttgacttctaaatcgtagtattgacacagtcttgctgaacagttttgaaatgctgatacattaaaaatctagttttcatttgcagtttgtaaatttattgtttcacaatttttaacaacatactcctctgtccccagacaacctaattttcgtaaactttaacatgaaattatatgatattataaaatttttgctcattgttaacaagttgacccaatgatgttctttaacggatttccctttcatacaggcaagtaaataggaccaaatgtgtaagtctttgcactaagtgaaagatattgttgagtaattttatgtgaaaatgtatattttatattacattggttttgtatcttctattcagggtgacagctgtatcagagttcttttcaagctattatttgtatagctcttatagtgaaaccttaccctaaggtgttcagtattatctactttggtttacattctctaatgcaataatttaattgccagtatgaacttagaaacaatataattctttgaaaaaataatcaaattataatatatatttatttgtagatttgctaaatttatttagacttgcatacctaacacttacataaaacaagattggttcttgttttgaacacctatcccttctcattaaagagctaccagcatctctctggatagaagatccaaggcaaatgcttggttctggtcatgtttatctttctgacctgtcctctctcctttgccaagattctattctcaaaggcctctttgtcctcaatatgctggctattatcttctctacttagaagcacactggttttagggattcttagactcgccctgtgactgattcattgttcagtttgtgtattgcaagagcttactcagctaactacaaagagtcccttgtcactgcccttggttcttatttttctctcatcagcactactttgctgtaatctatagtgagtaaagtcctgaacttctgtttaatgactcctggactaccacaccacccattagtctctgaattcctcctttgtggtgggtggctttatacacacacatagacacacacgttaatatttatgttttgtttgtatgtacttgaacccccatgcctgtgatttcaaagctttatagctttccaacagtgatattggggttgggggaagctcttcctttccctaagaaataaagacaaatactttctgcatgttatttttctgttcctatttcaaacctcaaaatgcttcaacttagatcaaaagtctttggcaccactcctttgtgaaaattatttcccataaagttttgcttaaaatgggctaatggagggaaggaagcaatattaaaaggcagttatgcaaaagtaattgtttgcttaggccttaattagtagttgattatttaggcagaagatatgtattttctgatagaaagagataagtgatagtgtataaacatcacaggatattggccactcttgccaccgtttgtttagattagcgatattcagaactgctgagtgacccgacttagggaaattaccaagatagattatattagattaattgcaccaaatagattaaacagctcagtgtatctgatagttcttacttttccagtacaaaacaaatgacaggttatttctcacagggaaaataaccatcaatatttgtgtcatatcaggttgctaacagatatgaatagtaatgctccagaaaaataaacttatgttttatttcaatatatttaatgtgttcattttgttaaatgctataactctctaaatttctgacataagtatatacagttctgttaataacctgctgaagacataataaaatttttggaatattcagccagatgaatggatattttcatagagcgctaggagtgttttaaatacttgtattgtgcatctatgtttttgatgctttttaaacatcataagtatttgggtaccccacccaccagcattctaattaggaataggaagcaaataatgggaagccaggagaatgtgggaagcatttaagtgtgaacttgccttaagggcaaaaaaattgtcagagcctggttgttcaagaagtgctgtcaaggccaagtaaagtagaagaaaaaaggacctagcctcctgaggatttgggggccctgagcaaccaagcagacagcttgtattatcagttggcattggcatattgtgctgctctttggacaccagtatcttgggtaaccaagaagatggaggatggggaccaatagtaagtgaatattatagccaggcaagcctttactctgtgtgatgtcatgggcccagcctccatccttttgggtatctcctggatactttagtatgttgaccactttcttcctgaaatttgatatcaaaatggtgaatgagataataggacttaaggataaatcccttatcttacagctgaaatatccaaggcctgagcaataaatacaatgaaatacccaaagacatgtggtgttatcagccttcttaggttcatccctccttcctagatgccatcaatcacttacgattctttcatataatagtgaagtcctaatctcacagcaacctagaatgagcaatgaaagaggttgcctttccagtgttcatctcctccacacatagcccctgtgagggggaccatactagtacacagaatgaaggctgtgtgtgctatgagaggctcaaaagcataggtgtatttagtaatactgaataggtaaggatagatccaagagcttgttagtgaatctgcatctctggagattctgattcagggcccataaatctgtagtttcaaaacctctccaagtggttctgatgtagagttaggtgggaaaacaaccataagatgtatggaggttccacattctaccccagacttgctgcacactgtattgaaacctgtgacttaaaggcttaaaataagcacaatctcagataagttgaaggcctttggtttccatcaaagcaaactccacaaacttgtcaatctctatcaatcacaagggtatctcaaaatctctggcctcttagttgaggattttcaaattaagcatagcgtaggcccaatagaataatcctagcacagcaggtgtttcttgtgtgcctcctgggcacacaagtgtctaggcactggggatatggcggacaagactgacaagttatccagcttagcagtggttatatttcagtgggaagaatcagagaagaaacaagcatgcaaataaatcaattagataatgctaattgtggcataattactgtgaaggatgatagtggagggagtttgctcctttgtacaggatggtcaagaaagaccttactgagcatgtgacgtgtatgtgagactttatggatgaaaggaaggtagcctatgaaaattcgaggaagaaaatacctccattttttccattatgttttattttgagttactgttttgttgggctttgaatttttctatgattatatgcacgtcattttcctttactgaacattatgataggtggtctttctatagcagacctatggctattctaaggtaaagtcagtgacagtgtgatgatatgtgtagctagatttcagggtattttgttttccatgcagagtttacagcaattacttttttctattttatatcatcaagccaaaatccaattattgcagtgatattgtaaatcattgagattatctcttatcacaaagttattatagaccaggaagaagagattaattttgtttttgtaaaactaaattcatgataatgtacttctatacttaagcaaaagaaaaaatatccttataatatttgcattgtctagagacatttttttttcattctggctgccagattatgcttcagttgtatgttagtgtctataactgcttaatgcctaacccgcagtttacaacctaaattaatgtcttggtatttatgtcatttacatatacagaggtaaaaatcaattatccttgaatcttcagacatggccaggaattaaaatggaagagtaaaaaagatacaagaagctagaaggggagagaaaggaagaagatgctttagaatgtctccagaatgccttccactccttattcctcccacctccaagcaccggagttctattctgtctgggaccttgacattttaaatacagccattttgaaatgccattttgatacagcatctgttaaattcttattagactccagaaactcttctaagcttgttacgatattaacacatttaattcttacaatagcccaataatgtaaggtaccagtatcacccccattttatagataaatacatttgaagctcagagaagttgagtaaattgtccaagttcactcagatagtaagtaatacagcaagggttggagcctcggtagtgtggatccagagactaggcctttaaatgataccccacaccgcctctaatgcctttgattaaccattttgtcttggggatgttttaataacagcctaaaatatgactgttaaacttgccatagagattccaaataatgtctgaagcctatgtcttagcccctcacttggcttcctgttgtccctgagcttaacttacaaatgtttgaccctcacctctctgttaggcagcaaggagagggagagagccagtagcaagacatgggctatacaaagtgtcagcgtcacacccattgacatgtgaagggctgcataaaattcgttgcaaggaaatgtcttgcttcataatttgtttccttgaagttccttccttcaacttccaaacctaatggagggcacgtgaaggcatggtttccagccatatattttctgttttgtaatttttggtttgaaacatgtcatatgtatgacagatataaagtttcctacaatttgagagaaagtggtgcttgtgataagtaatccataccaactataatttcaatagatacataggtagaagagtaattatattattacttgttagctaataagctttatccttgcctatttaaaaatttggtaacaaaaatgtgctaattaagtttttaagatggatatttttaaaattattatgctcatatcttatatgtacacacatatataaaatatataaaagttttaagaagtgttttactatttatgttagtttttacagctccaattatagctgtggaagtccccagagcaggtactggcatccatgcctggcaatgcttggaccatcccatccagtgttctctatttattcccccttggtttagatatcacatatgattacaagaaagcacatatgtctctcacaaaccaacttctcaatgcctcagaatatggatttatttgctcagctctaagaataaaaaaattatttataaactatgttttaaaacatattttttcaaaaatggaagaatatgtttctggtgtttctactgtgtatctcatgctcaagagagggaagaagctatatgattggagtctaccaaagggatgcattagtagtaaagatccttgttatttacagccattttgttagtatttaagattaccaagtgcagacattctaaaatggaatccacctgtacctacttcatgcttatagtgctgtgggttcttagtagctaattcttgacagtaaagacaggaatttatagcatgtaacatttttatttcattgttttataattatttcatcattgaacccacttgactctttttttctatgatcttttgtcaagtaaggaaataaaatttaaaacattttaataacttgcttgtaattgcaggatataatgtgttaagatctacttttggcctcctgatttcttattcacgaatgcgttcattctgtgtaactcttagtgttgcagaagcagccacatcatgttcaccattcaagcacaaaatttttaaaatattacacaatatatatacacatacacacatatatattagtataaatacataaaaatatcaaagataccataatgtggtggctgacaggaaaagctttggatcaggtgaatctgaatttaagccctgggtcatttatttttaggagtgaccctaccaagccacataacctctctaagctatattatttcattatctgtataactgagataaaaatattatttttagagttctgaaagtggaaacgaaataagtattaaataagtgagtttttaaaagagacaaaatagctcttccaagaaagttggtttaaaagagaaagtgagaatgttaagaaataccaattcccagtaattttttttgtattatgtgtcacagcttttaataattgtagtttttttcactttaacattttgtaaaaatgctcctttataatttaagtttaattggagttttttttttttttttttgccttagtggtacgtaaactaatgatgtgtcttacaatggataacattctagattcagtgaaatgcaggttttatgatacatatctacatttctttctcttcaggaggcagtaatgtgtagtggccatgtattcagacctcagttgtacatagattatgccaaattcctgaaccattctttggtgtcgtcttttacctgcaaaatgaaaacatatctcatggcatttttagggttacattaaaaaatgtgtgtaaacatcctggcagcgtctcataaagaatttttaagtgcacaatgatagccattattgttattattctcttctttttttttttttttttttttttagttaatctgtatactagtggactcagacattagagccaagtttgccactaattaaatttggaaacttgagcaaaatacttagcttttctgtcgtacttcttgttctgcaaaagaatgttttggctcagataaacttgaaattaattctggttctaaaattttgtaattttattatttaattcaaagtcctaacataatatgaccataaaatgaattttgtttctttcagtttgtggggacattcatggacaattctttgatttgatgaagctctttgaagtcgggggatctcctgccaacactcgctacctcttcttaggggactatgttgacagagggtacttcagtattgaagtaagtctacatcatgtcttctttgctgttcagttatggattaacagtatctcaaaaaaataaaagcagtaaatgttattgccttatggaaacctctaacaatgaaatttaattcacttaattcataggatattacatattatattttcagttgattcccatgtgttttttgtttgtttgtttttgagacggagtctcactctgtcgcccaggctggagtgcagtggcgtgatctctgctagtgagcagaacctctgccttctgggttcaagccattttcctgcctcagcctcctgagtagctgggattacacgcgcccaccaccatgcccagttaatttttgtatttttagtagagatggagtttcaccatgttggccaggctaatctcaaactcctgacctcagatgatccgcccacctcggcctgccaaagtgttgggattacaggcgtgagccaccatgcccggcgtgattcccatattttttaatagagatgccaaaaaatggtaaatagtaagattttgccttttgtacattttatatatttgcaaattttcaaaaattacgttttgctttacaataaataattccattttccattgaaagaaataatcaatgttgatcaaataagcaggaatgtatttgcatgtttatgccttataattgtgagacagtaacttacctttgtaaattgatagcaaactgcatgtgtctctgtctgtggttgtctatgtgtgagtacacttacagctgctgtattttgtcttttttggcacctgtcatctaactagggtaatttgtcaaactcattaattaaaacaaaacagataacctttgaatagaggttcttccacagcctcccatctgcatctgctttaggtaagtaaaactacattcaaaataaaggcagagaccttgttttattcatatctttgttcttcctggtgcctaacacggtgtgttaataaataatttattgaaagaagtggtttgaaattgaataagttttaaagaatcagacctcatgtatagtagctgacatgggctatcaaaagagatcattaaaaaggaaaatgattattcttaattaaagagagaaatcaacattattgtctcacaccaacatcatatattcataataatcatagaaaaacattctatatttcaaaatttttatttcagtgttttatttgctaaagggatatttaaggttgaaaagcatgtcatccttaaacagcttttgtttatacaattatatcagttttatttttcggttatttaattcacctttagtcactgactacacgcagacacagaaaagtttatgtagacatatatgtatttccgccaacataataataccgtctgcatttaaagatcacagatttcttaattattcctggtgatgatgagggaagaaggagtggtgatggtatataaatcccaaaagagaagttaaattcttggtatttcctccatttgataaacaagtatggtcaagcatataaaatgtatatgcaccatgaataggactgtgaggaatttaaagaaatgtaacatacattcttgctctctagaaacctaaatctacgttgcaaaacagaaccataaaaatctgtttagaatcagaagcctggaatatgtgattatccagaggtcagtaatttaaatggattattaaaaccttgtgataaaggagatacaaaatagtaagtgtgattggattagagaaaagtgaaagaatattgagagcacacatgttttgggaagactgaatcaaagaacaagtaagttttagctaggaaggaaattaaagtgagcaaaagtacagaggaagaaattagtgaactctgctaaccttgtttttttgttcttggggccagcctgaccagcttaactgatggaaaagcaattgagtactaattttgtaagacctttatatcacattaggactggtgtctgccaggattaacaacaacaaaacaaaacccctacataatggtggtttggacaagatagatatttttctgtgtgtaaaagcccacagacagcaatccaagactgatgtggcacagcgtggtgccagggcctaggctccatctgctttcttgctctgattttcatggcttcattccacagacaaactagtaacccaagatggctacatcagtttcaaccatcatttctccacataatattcaacaaggaggaaagggagaaagagaagggtatatcttcttgtttaaggatgtttcccagaaatggcccaattccttcaacttgtatcccttgagccacagtttgctgatatggccataggtgatttcgtatgtggccaggattaaggaagactgtggtaggcaataaacagcaatgggaggacaaggatttctgctcttctccttgaattagggttatatagaatgttttctttctttttctttctttctttcttttcttttcttttcttttcttttcttttcttttcttttcttttctctttctttctttctttctttctttctttctttctttctttctttctttctttctttctttctttctttctttctttcttttctctcttttaaatgagacagggtctccctctgtcacccaggctacaatgcagtagcacagtcatagctcactgtggcttcattctctgcagtggcacagtcatagctcactgcagcttcaatctgcctgtctcaagtgatcctcccgccttagcctcccaagtagctgggactacaggcacacaccaccatgcccagttaatttttatttttagtagacacagggtcttacgaagttgcccaggctggtctccatctctttagctccagcaattctcccaccctgacctcccaaagtgctcagattacaaagtgtgcaaacctgtattctggcctgggttatgtagaatctaagtgaatattttaaaaattattttagtaactcttaaattcatcttattcatttaacatttgtagcactcctaataaagtttttcaggatgaatgaaataggcatcctactttccttgaagcttgcattctaagtgaggaaatcccaagactatcatgttggagtgattatttttgtcagtcaaatgatgttgtgctgcgttggaaatttttttttattataacatttgtgacttttcacaacttcctatctttctaaaggtaatcaaaggtcacaacacttgcttattaattttataataaagtacgatactacatcatgtgtggcttgagtaacagctggcatagttggacttttccttctttgtgccaccaactccatctttggataatattctttaatcttattgttctttatttacctttttttgtttgttttttgttttttttcttgaagagtgcaggcttctgaatctctgtcctcaaaccacctgaaattttctaaactttttctaattagagcattttagaattcttttttttttttaagtaaagatgttgctgggtgtggtggctcaacctgtaatctcagcactttgggagtctgaggcaaacagatcacgaggtcaagagatccagaccatcctggccaacatggtgaaactccatctttactaaaaatacaaaagttagctgggcatggtggcatgcgcctgtagtcccagctactccggaggctgaggcaggagaatcgcttgaacccaggaggcggaggttgcagtgagccgagatcatgccactgcactccagcctagcaacagagcaagactccatcttaaagaaaaaaaaaaaaaggaaaaaaaagaaaaaaagacgtcaagaagcagtttactaatttgttcctcagcagatttttttaaagtctacaattaatctagatatttgaactatgaaatttgctatgttttgtttagtatgctccttttgaaattcaagcaaaggatcaaactggatgttggtgacatatgaagtgtaggaattatggggcatttaaaagttctaagatgcatgtattggagtcctcatcttcaaaaacagctctttaattaaacttcaagagtctgagactacaacccagggacttgccacatacatacaaaaatgacaaaatgactcatatgtgaaatgttccattttgattagactgtgacctttgagaggctttggaatggctcattgatatcgtatgtaaaatagcatggacatttatataaaatgtacctactgaaaatactttaaggattttttattgtggattaaggaaactgacattgttagcatgttgtaaatgctgttgtttcaatagtttgaatgacctcatttattcttgacagttttgcaaggaacatgtaaatacgttccttttatgagtgcagtaactgaggctcgggggtcacacgtggtaaatggcagtgctgggattcaaagcctgtgttcttccactaaccccaggcctttgccatagtatattcattacatgtaccacaaagcaccacgaaaaaaaaaaatcagtaatgcagaaactggtacacactattatattcacccatgcatgaacaaacgtacacacagccttctccctatctatataatctgaagatcaaagcattagatataaaatgttctctgtgagtatgatactgttgttttaagaaaaatcctaaaataagagctcagttttccagcgtgtattatcctaacaggcttcaaaaggatctcaattcatctcaataattcagggctccactgcaggtattctcctttggctatcctctgggcaaaggggagcacttcagtttaatttttaccaagtcagctttgaaggataatttcagatttcaaacagtctctgctgggtatatttataagcactaggtaatgtgctctgggcagtacacagagctcattttatgcattacccccaccccagtcttctccttttgccaaaattagaaatcatttcccacaaagttagcccaaataagacaagcaagcttttgagtagtgatgaaagaggtaattttgttttgagtaataatttgtcttacaccaaatactgctcttgccgatgattgcattacagtacctaatctctttgatcaagcatatgtgtatatataggtctgtggctgagtgtgtttctctgagaacacaaggaaaaacttagaattgcaaacagaggcatgcacagctgtttccttctattcacttcctcaaactccctttctagccgttttgcactacactgccttgagctggcttctcaacttagatccagatctcaactccaggcctcaacaagtttaagtgtgaagaggtgttgtgtttattagctgtgaattcgtagaccagaatgaaccacagcaaaccagacaatgttccatgcttctgcctgagaataacaagcaagtggcacaacaagagatgttaggtgacagagtaatgccacagacatgaagaagaaattgcctggctgtctccctgtagccagtcgtctatatagtgcattgctcttccactgctgcctgtctacatgcttgtcagaccaggcaagtgatgtcttagaggagctacatttgatatttcaggagtttggatcttttcccaactgatgcaaatcctttacttagtttgatgatcgagaggcagcacttttgattggaatgtttcacagtacgagtagttactttaaagagctgattaatatgtacctaaagctgtccattttcttttttacttccttgcttcctcttttacatccttctttacttctctatgcaattttcaagactacttatcattaaaagcataaattacaaagtaaattattgcactattattatcagtgaaccaattaacgaagaaaattatattcttagtgctgcttcattggggaagataggagaaaattaaacaggagaaagctatgtctgtggcaaaaattaattttaaaaatagaggatgctccatctttcatattgagtaacctaaactaaccttaaagtgtaaatatttgtttaattaagagtcagaatagaaagacaatagcggtccagttgaagtgattagcgcacctcatttacatctcaccatgcagaaaaggccagtgtaacacagccctttgtttctaccttaaccaattaattcactgaaaatttgattcaagttagccatctgataccacatagacaaaaataaacaattaactaattgtatttcactgctttcattgattgtgatttttttttacaagagacttcccttttttaaaaaactatcaggttatgatttgctgaagatcttcagttcttcagaatgttagagctttagatggtaaaatagttgccggcaagacagtgttgtacttggcagctctctcccaccagatgttgagggagaatgctggcagggctccacctccagtccacccttgccctttcatttaccatgccacttcttccatattggctgcctttgtggttttagtcaatgtttgggaagatattttattcttgttacagggaagaaggaaataaaatgtgaaaagaagacttatttttagggtattttgagccaagaatttagaaattgagttatattctctctctctctctgtctctctctctctgccttctatttctcattctgtctccctgcttctctcccctccctctctccctcccttcctccctcccttccttccttccttcctttctctgcctccctccctcctttctttccttcttcatttacagaaaaggaactaatatttcctcaactcctgtcatatactaggtactttacatccattaaataatcagggatattacatgtatgttgcatcatttaaaaggtgtaaatatataggatagaaatatttagcatcgtgcatttatatatcccgctttgaggtttcagttatgaaagaactatggtaattaagactggacgggataaagccacatgctaatgtcagaaaaaggtctttaacagatagcaaaaaaagaaaatgtgggtcctagaatgtgattcctctagtggtatttgagtggggttacaaagttccagtttagattttaattggagaggtagaactttgccttaaaacaaattgttacaggcaaaactaatctaaagaagtcagaattataatgacatttccaaaagaatattgactaggaggaggctgaaaggagccatctgaatgctgaaatgtaactggatctgggtagtggtttcatgggatttgtgtaaaaattaattaatctgtgatttgagttatggacgtttcactggatatattatacctctcttaaagaaaaaaaaaactttaaaaaagtagcctaagtgccttcagaacatgtattctctcccccagcatataaatgaaatatattcaaaatagcaatttcaacatgcaaatgtatttttaaaggagttttcatatccattcatattccaaactagacatcctaaattaacgaccaatttggaaaaatacatatattactttcagattaaggtatagccttagacattttaaattggggacagtcctcccattgacattaataatagtttatgaatatcttccctgaaatgtgagacaagcttgagtaatacaaactctttttattgaaacatgtaagtacagctataaaacccgatctgtagcagagactcattaagctaccggactactcactgaggtaacaggaaacgttacatacatcaacagatcatgatgctttaaggatcgcttgtacaggccatttggtcaacttttcagacatattaatatcattagtcacatgaactttagctaataactataatcagaaagtggtaattagaaacttaaagtaacatatataatttaatgtcaacctattgtttatttcaatcataattacctagagataatatcttgcttgaacaacaaaataataaacatttgttctgataattagtattttctccaaaacttgggctgtatagtcaaacataattagttctcactcatttcataaattatcatataagctaagagagatgattactctttacaagtagtactacaaataaattgtcagcagcttttccctatagatattatccaggatatctactgtattggaaagccaattattaatgtataaatctcattgattttgatttcagattttagtaaccagaattagacttgtctcaatatttttgtagtttttatatcttcttagcttcactttgggaatacaggttttacgaggataaaagggcatacttgtttttcaaagcctgattttctgttccctatggattcttaacaaatgtcagttgacgataacaaattactgatgttaatacttgaatattccagttgacttaatgctcattccaggaaggctgtgtcaaatgtagatgtatccccaagttggtgaatgcataattgaccatcatttttacagactgcaatgcccaagaaactaagttgagaattttaaggtatatcaaatgtatcctgtagcttttagtacaatatgattaatgattaataagtaaaataaggtcacttctctttgtaaagctaattatttttaaaaatcaggtaacagaaatggaaaaattggaaagataatgtacaacaaaatgaggaggcaaagcattgacaagctcagcctaacttgaactgcgtctgtattttctattacttttccccatctctagctccctgccttcttctctcccaacatcttgtcttttctgtcagtgtctttggtatataaatctgaagtttttgatttatgtatctatttaattaaattgaagttcagggaatctcactacacatagcagtatttcttctcatctttttaaaccagtatatttttatttctagtatattttagttaagtttcttcccttccatttttttttaaactcccactctcctcaggtcacataattctccttctgttgaccatatgtaatccattgttttcttgtggtatatgatcctcagtgcgtgtatgtatgttttaggtgtagatggaccttggctttttaccaaagtaatgtttcctatttgattgtcaatatcttctctactaagttccagccttttgggggacttttggtcatggtaatacattttattcatgtctttatgatatgtgagcaatgaaatgcataagtgttaaggaaaaatatttatttttatattatttttatttttctcagtgtgtgctgtatttgtgggccttgaaaattctctaccccaaaacactgtttttacttcgtggaaatcatgaatgtagacatctaacagagtatttcacatttaaacaagaatgtaagtatacttcaacctccttcctttaacactatatgtgctaaaaagtaattttaatcaataataagatacatacaatatgatctattgcctaaagtcaaagacttaaagtgacactctttcatattatcctatatttctttctaagcatggacatttatgagaattcagaatttctttttaaattagaacttctttataaagtgattgaagaatttgaattaagatttgatgtaatttatcctaagaaacaagtgatttagggatgctactgtttggaacaataattctactcattaatctcacattactcaaaaaacgcaaatggagggcaaattcaaccctatgcctctgttttggacccaataaatgaatactagcttctagtgaatcttataaaactgaagatgatgtcattctttagacatagacactaggagtgtggagtgcttttttcaatttctttttcctccttacaatttttcttattattcactgaatcttacaaaggtataaaaccttacatttttgttttatgtataaatacagttaaatggaagagctgggaatctctctatacatatcaatatttttctctttcatttagtcctatattcaatggagcataaagacttctcctcttaaaacattagatataagtcatgggaaaagcaatgtgcagtaagatagaaacagctttaggaaatgtcttgccatctgcttttctacaaaatcgttaaggaatatcaagcagctttatggctgtttttctattggtcttccagttgttcatgtacatttttttggtgagacgtctgcagataaatagccagaatgtatataaaaattctcttgctatacaaaacgttatgaaaattataaagtatgaattaataaatgacaaaaacaggaaatactagatataaaagattaatatgttactttcagaaaatcttaattatgttttggaattttgtagtatgtgcctttatgttaataatagggtcctagcaagaaaacttctcaaaaaaccaaaactatttcagtgaaatgatcctgcctataaatcataagtattcttttaatcacttctaaaaggtaaaataaagtattcagaacgcgtatatgatgcctgtatggatgcctttgactgccttcccctggctgccctgatgaaccaacagttcctgtgtgtgcatggtggtttgtctccagagattaacactttagatgatatcagaaaagtaagttttgttattttccaagtctaatcattttgtgcgctacagtaataaatagaagacattaattaccctgcctttatcactgactttattcttttgagttcaaataatttaaagtggtcatgaatcgctcctttgtgttaaatttttatctagaaagagagatatgtttatacttggaagaatttttatctctacaacctcagggttggtcttaccatctgacatgtgtctttggaaatataaaatatttgacctctaaaaaaaatatgccttatcatttccatttggcttttttcaaacaatccgttgtatattcatgatgtgttatgctagaaatgttgctttgcccttgggaaaatatcataacataaccattaaactgtgctcattttatggttttttaaaaatctatttgttacaacttgagacttttaagtagcaatctaacaaggacagtgataatattttattaattttactgagtggctgagtgaaaaactggactttttaagaagtatttgtaagaagtttttaagaaatactccagtttagcattggctattaacagttgtttaaaccagcaaaaagatgagttacattgaatgtggaagtggattgtgtctctttcttgagtaaatctagtaacatgggatagttttatgtagtacaatagatagacaatcttttatttctttggtatgtttctaactctgattgcaatgatgtaaaagatagagagtaataaaaaatcgcagtgtatttttcttggtgccaaaatcggaccaaagggagaaagtgatgtaaatgttttcttaggtcattttaaaataatattacttggaattattttaaagtatgataatttcttcacattgatatttataacatatgttattgaaaatttgtgcccaccattaagctttctatctaggaaatctaagccaaattttttctggaggaattataaacagttgaaaactgtatttatcttctttcctctacttttagagacctaagaaaatacgcttgtacttatcccatagaacagaggggtgaaaataattctaaccttttattattattctcaccagtaattttagcaagaataaattggtcacattgttctaaattactgtatttgaactataaagattggaattttgctgagatttcttctaaagatacatactactcagtatatatttaagcctaatgtatgataggtagactttggcttcaaataagtgatgcactaatctcaaggtgtacagaatttatttcttaagttataggttcacttaagaataaccatgggcacagttcaaattctagatcttgcttatcattaggggcattcatacaaagactcccttggtgtcacttgtttgattgattgccatttaattgtttttttccatttcttctgagtttggaaacttgattgctaagtctgagaagtctatatgatgaacatttgcaagttaattctatcagctgccataagttattaaattagtaaacagtgttttcccattgtgttcagtggagaaggaaagcaaatattttatctattcatgtatccatgtatcatattaacctgataaccacttattgaaataggtttggaaaatgaaaagtcaaattacaaataagtatagtagtttctgttagcaaatgatgggcatgaaagacatgcatttatgttttattctcttgccttgatcaaatttcatggccttggatggaagatgagaaacttactaagtgtcctccttcaaagggggattagtgaaaacttccctcaaaatagtgttttaattatttgaacaaaactgatacactgaatagagttctatactgtagagaataaatagaaaggataaggctattgtactattttgtttaagacgcaatcaccagcaaaaaggttgtaaacctctactacaaaatgaataaccattttcatatagctctcatttgtagtgtttctttaatacttttgttaatgaaactcatggttttgaggaaatactttagtaaattatgaatgtatttgcataccataagtctctactaccatgaactcaatattcttttaaagttcattagtttttagagaaaaattattttcaggtaaaataaaacattcaagttcttcctatcattgaggttcaagtgttcaagtataaaaataatgtgtttactttcctattggaaagaaaatgcatgctttttattttaaaattcaagcgaaagcacaataaataaaccttgtttcctgctctgtgtctttgtgtccatttttgcaagacactatttcacacttctatagagcatagagcattggtctttgctctatatttaaagtacagtagagatgtgatgctggttcagtataaaattgtttctttctgggccaagcatggtgcctcacgcctgtaatcccagcactttgggaggccgaggcaagtggatcatgaggtcaggagttcgagaccggcttgaccaacatgttgaaaccccatctctactgaaaatacaaaaattagccaggcatggtggcgcgcgcctgtaatcccagctactcaggagtctgaggcaggagaatttcttgaacctgggaggtggaggttgctgtgagccgagatcgtgccactgcactccagcctgagtgacacagggagactccgtctcaaaaacagaaatgtttctttctgcatgaatataactagctcattctgtaatctgatggattttttttaagtaaataaacttcacatcgtaaattaagtagattttttaaaatatcacctaatatccctaggacttacttcccaggatattttagatattatattcaattttcatacatatcattaagctctgcacatggccagaaaatgatttttaagtttttatcttgccatatatcaagtttttttgtatttgtttatttttactgtcaattatattaacttttagaatgcactgtatactttttccagaataaatgttatattctggtagctttgcagacctttagttggggattcatattaatcagaaactttcccctcctctactgtcctacccttaataagttattgtttttcagaaagaagttctgtatttttagggacaagtattatttttcttgaatgtattgttccaagagcataaattatttaaatctcttaaacaagtttaagtttgcaatgaatattttgtggctaacataatggttgaaatgtagtcttgttttattgaagtttttcattgggtattgaaaacataaaatattgcctcattctctatagatactaataaaaagtagtgtgcaacaaaaccattacttacatcttgtatgtcccagaaaaaaaaaatagacaatttgattagttgtaagcaaaatatgttcacttgtcttcattggatttttaaaaatatcaatatgaagaatatcaattcttaatagattttcaaagctattgcatgcttttattcaagagcctttataatatctgctgattcaccaaagatcctttaattgcagttaaatcaggataaactaaagtgtttaaaattgatcgtgatatgttatttccagtgatgatatttctaatatgccttctaaatgcaccttttaaaattgaaatgtgacttcactaaacatttatagctggaaaattgatttcatatgaaggcttcaggtaaaattataaagcttagaactgtgaactgaagaatgacccgctaaagttgagtttattttactgcttatcattactcatatttgtacccactaagatcaactacaggaggcttgtagtttatcattagaaacctagatagcccataatgaaatagtatccaaaatatcatatagcaagtggctacttttaaagtaaaagccatcttttctcaaaatcatgttcttaaatataaaaaaataacataagcatgaaaactaggagttgttttccatccaaacttctaaatcacagtttaatagaggcagtaataggaattttcccaaagaaagtaattctcaataaatgaaacaggggtagagtcataataactggtcatgaaaaaaacatttggatagataaagtaagtaaggagagaaggataaaatgtagaataggagaaatgagaaactgcgaaatctagagataatagaggcaagaggaaggtaaagggttagatgaagatagatactaaatgatctcatcagaaggaagctggaaagaaaattggagagagatgaaggataggaaaacgagtaggaagaaggacaggaagagagagagaggtagaggacatttcaccctgagctgtagctggggagaagaggatgggttctgcacagtgcttgtttcttgtattgtcagaattctaagtttccaaagattagtattttgctctctgtcttctatttttcttagttagaccgattcaaagaaccacctgcatatggacctatgtgtgatatcctgtggtcagaccccctggaagattttggaaatgagaagactcaggaacatttcactcacaacacagtcagggggtgttcatacttctacaggtaagaatagagaacttgctctctggaacacgtttgcatcataatgctaggatttatcagtccatgtgtttgatttatttataatgtttgtattacttctttaatataaatgaaaggctcactagcatttataaaatgaaaatataaataaatgaataagtgagtaaataaatgtgaaatagatatgtatacatatacaggtgtaccttggggatgttaagggtttgattctagaccaccacaataaagcaaatattgcaataaagcaagtcattatttttttggtttcccagtgcatatagaagttatgtttacactatactgtagtctattaagtgtacaatagcattgtatctaaaaaaaaaaaaacaaatgtacataccttaatcagaaaatacttcattgctaaacaatgctcatgatcatctgagccttcagctagtcataatctttttgctggtggaggatcttgcctcgatgttgatggttactgactaatcagggtggtagtttctttctcaaaagaagacatttatgtggccaaaaaacaatgaaaaaatgctcatcatcactggtcattagagaaatgcaaatcaaaaccacaataagataccatctcatgccagttagaatggcgatcattaaaaagtcaggaaatggatgctggagaggatgtggagaaataggaacgcttttacgctgttggtgggagtgtaaattagttcaaccattgtggaagacagtgtggcgattgctcaaggatctagaaccagaaataccatttgacccagcaatcccattactgggtatatacccaaaggattatatatcattctactataaagacacatgtatatgcatgtttattgcagcactatttacaatagcaaagacttggaaccaacccaaatgctcatcaatgatagactggagaaagaaaatgtggtacatatacaccatggaatactatgcagccataaaaaaggatgtgttcatgttctttgcagggacatggatgaagctggaatccataagaactattatttttgccccaatgcaacaaagtatcacaagaacagaaaaccaaacacctcatgttctcactcataagtgggagttgaacaaagagaacatatgggcacagggaaggggaacatcacacaccagggcctgtcagggggtggggggctaggggaaggatattattagtataaatatctaatgtagatgacgggttgatgggtgcaacaaaccgccagggcacatgtatacctatgtaacaaacctgcacattctgcacatgtactccagaacttaaaaaaaactccagtattaaaaaaaaaaaaactgtaccaaaaaaatccaacaccagccttgttttaattcaattatgttatcacatttaaaagttttaccagtttctgtaactcagatcagaaaaacaactttacattggttaaatcaatcatttaattccttcttacatttgtttatcaggcttcctggataaattaaaataagcagctttacagtatataggaaccatagtatatttatttttaggactttgacaagccaagttgaaaatatttttataataatttttacattttacaaatcgctagagatttacccattacatgacattttataacacttcagaaaggaatctgcaacacgattaggtttctgcatgacctcactgtcttcctatcgtgtcacctcagttttatcctcccagatgtgatcttcctcagtttcactaaagtctcttatcattatacatacagcttatgtgaaaattgcgagagtgaaagagaaaagaggttatgaagaagatgagaatttttaattttagaatacttactcctcctcttctcctccttcctcctcctcctcctcctcttcttcattattattattattattattattattattattattattattagatactgaagaacttaacctgatgttccctgaagttaatgctcaattccagccctggcagctaagctaatggcaaggctggaagaattctgtaaaatacatccagctgtgtatcttctgtctctagagtaagcaaatatccttctataggacgttgatctgatgcctatttagtagtaggacattttgttccatatactaagttttcttatgggggaaaaaaagtttttctatctgttgatgtgattgataaattaaagttcatgaatagaaaatctagtgcactataaagcgtctttcaaagtatagctttctttatatgaatattaacagagaggtttgttctaagcatatttattttaaaaatttatagttcacttctatattttggaaatgtggtttaatgaatccattttggctgaattaaagacgcatggtataatatttctgaaaaggctaaaatttattttcagtaattaatttgggagtaatcttttattaaagatgtttaaatttatagtgaaaagttggcattgttaaagtacgtcaaagttatgtgttcagttttccaaagctagtgttaactttctaattataccctagatgtttaaattacctgcttgatatcacagagttatacttcagtaacataatatcaaacaaaattcaaactcttgattttgatattgagtcctgttgcattaataatagtatagcattctattcgttttcgtgtcagctgttcaaatcatattctaagcagagtcccatactgaacttatataatactgaacttatataatattatggcattagacacagatgtgtatatattatgtgtgtatattataatatagacacagatatgtgtgtatattataatatagacacagatatgtgtgtatattataatatagacacagatatgtgtgtatattataatatagacacagatatgtgtgtatattataatatagacacagatatgtctatatattacggcattagacacagacgtgtgtatatatttgtaaaataaatatatagaatatatttagaataaagtctaccatctttaataatagaggataatcagagaattaaacatattttcacttttgttttcagcattatgattatttcgtctcattaaacatccttttttttttttttttttttttgagacagagtctcactctgtcacccaggctggagtgcagtggtgcgatctcggctcaccacaacctccacctcccgggttcaagcgattctcctgtctcagcctcccgagtagctgggattacaggcatgcgccaccatgcctgcctaattttttatttttagtagagacggggtttctttctccatgttggtcaggctggtctcaaactcctgacctcaggtgatccatccacctcggcctcccaaagtgctgggattacaggcatgagccactgcacccagcctcattaaacattcttaataaataatgatttttagctatggcaagtatagattatgtgaatagctgaatatctaaatctgtggcctatatatagactgactaatgtcaaagcagtctggattatgttttatctaaggaggagaaaaatgtttctcattctcctacagctttttggtccttttgtctttagtgccaccttgaaagtatgaaggcatcctctgggattatggtttataaagtggatctagatgggcacaagcaagccatgaaattggtagagaaccttagtggcaattaccattttgaattattggcaggtattttgatccacagctctcagttttatttaacatttgtatgtgtagtttgtgtgtttactttgctatgccagcctatccactatctaacatgttatctgggccattatttaaataaaataaagttatgcagaaaatatgcatcagtcagaatttaacactgttcctgagttatatcagataggcagtgtgacagagaggaaagaatccataagatctatgattttgccccaatgtaccattatctttagaatcttagaccagagtttgcacactcaaataatacctataatgttcaggcagatagttgagatacttggagcagggcaagtgttagattctggaaattagtgaggatcatgacaaattttcatttcatgtagaccaatgaaaactggcagctggatttggtgtttaggttatcaatctgtatttctgccttggatgaatcatataagctttgtatcctgggtttaccttgcttcaaaatgagtgagttaaattagacaccctaaagctcttttaaactctgaaattttaggggcatcttgacagtgattttgaagtgttttggaagctacaggtagcaactcactcaaatcactactggtcccttaatcacaaatcagcagccttctcttctcacactgcccagcttctgtgcagcagttgacactcttatcagccgcttccatcttgaaatcctctggttccttgtttatatatcctgattctcctctgacttgtcagggcgatcccttctcttcctgatgcctctttttttttgtctttcttctgctttggcatttttttcttcacactttcctctaggaacctcacctacacccacttccctagattcactgtaaactgtaaactctatggccagttcctgaatctatgtctagcccgcttcatctcttttcctgagctcaattcctgtatgtctagttgtctgctggaacttcttttctagggattccattttcaccttaacctaaactcaccatgcctgaaagggcttaattactttcccacttgcttaatccccactgaaaattcctcctgttttttgtttgttttttgtttactgttcattctcccagccatgcagactaacaggtgtctttgctttttcctcgtgtattgaaatcaccaccagtcatcacatctttataaatatcacaagcatctaaaccatgctgcctttcctctttcccactgtgaattcaagacctttatttttagtctattgaaatcacacctgagctctctgcttccaatttcattagtatcgtccctcttccctctacccaatgcatactgttccattcatgggtatcttttttgagaattttttcactcattcagttatttagcacacattagctgagcatttactgtagtatattctctctactaagtttttctcttttttttttttttttttttttttgagatggagtcttgctctgtcgcccaggctggagagcagtggtgcgatctcggctcactgcaagctctgcctcctgggttcacaccattctcctgcctcagcttcccgagtagctagaactacaggcgcccaccaccacaccaggctaattttttatatttttgatagagacagggtttcactgtgttagccaggatggtctccatctcctgacctcgtgatccacccgcctcggcctcccaaagtgctgggattacaggcgtgagccaacatgcctggcctctctctactaagttttatagatgctgagtccctgccttcaagaaaatggcagtccagtagcagagctcacaaagcagaaacagacaagtaaaatacaaagtgaatagtgccgtcattataaatgtgcaggctattacacacacgcgcacacacacaggttggtggggagggggagagagagacagacaatctgagtgagtgtgttgggaatcctaaccccaagggggaatggattaggttcaagggactattcatgatgaaggcattagcagacctgagttttaaaggattagtagaacatatccaaccagagtcattggggaagatttttgcaggcggggaaagcggcatcatgaaaatatgaaggaatgtaacactgggaattctgcagagaaggtcacctgatcttacttcacctctactcccaaattacattagctgcttcattatctgttaaaactgaacattcatattaccaagctattcagcccctattttatatcctttagaaatgtctctataagtgcatcaaacgacatgtgcaaggttaatcataacagccaagaaatgaaaactcggatatccatttagtagaatgaataataaattctaatatatttatacaactaaatacagcaaatgagaatgagcttactaaaactacacataacaacatggttgaagatcccaagcataatgacgagtgaaagaagccgatagtgaccagtagatactgtatgattccactgaaataagagttcaacatcagagaaaactaatctttcatgctataagccaggatactggttacccatagagaggaggtgacagtaagagaaatatgaggagtttctggggtttgataatgttctgtgtcttgatcagagtgcaggttccaagggtgttcactttgtgaaaggtcatcaaattaatttttgcctttttctgtatagatgttttactttactaaaaagtttgccttaaataaaaattgcttgccacttctgaacttaaattctggaaaagttctgtcaggaagagttggccccttaggacttgatccccattggacaaaaatgaaattagatcaagaaccctgggacaaaaaagaaacacagcaagtcctaggaaaaggtaggtctgacagcatccaggtagccccaggacactcctgggctaagtacccattcccaggccccaagaagcagaggaggagttgaacaatcaggcagggtcttccctattactggatctggaagaggagaaggacaccaaagagactgtggcttcctccttgtgtattggcaggggattgcaggctgcctgcctctgctttgccaaagcactgagggaggagggaaagaaaccctttgcatctctcacctgcttgactgcccctattgaagctacttcagcaattgagcataagccccaataagctgacagattgctgctaagcatttaagatatgaaaatgcaaatgaaaaagcggtgttcctctcctaaggcattcactattgctggagcacagaagtagaaatataatttacactacaacatgataagtgatatattagatacatatattgtaggaacacagtggatacagcagttgtgtacaccttaggtgagatagccttgaagagaatgcttcacaggtgataacttgtgaagacttggcagaagaataggcctttccaggaggaaaaactgcacagggaaagtatccataaaggcataaaaacatttaaaaaaaaaacattttaataatgcccactagctatgtcatggctaaagagtcttacatctgggagattaaactcaaggttgaaaatatagttcaatatgatatagaaacaaatacaagagaataaacagaattaatctaatagtaactgtttgctctactgccaagccaatttttctaccatttattacatttttttcttttctaccttccttatctttgttcctattcactcagcttctgatgatccctcttcttttccgagcagaattctaacccctttcctatctaccaatctgcatacgtcattctctttaatatataacaaaagatagatatttttcaaaaagatttctctgattaatttcagatgctttcttgcttgctttataatatctttataaaacttctattttatcttcaatgtgttttataatatagtaattttttaaaaatattttttataatgctttatgttcctaagataataaatacccttaggacagaaacctgccttgaacttataccgcccctccctgtagctaatactgtcttctaacaaatggaacaatcatcactgggcctctgctaaattactggggaataagtgatttttcatctctttggggtgtttaggtgttagcaatatgcttttcctgccgttctctctctctcgctctttctctctctctctctctgtgtgtgtgtgtgtgtgtgtgtatatacgcagtgcttttcagcttgaacattttgtgatttgtgataatttccattaaaaagcataaaagtggaacagagtttctgtttctcttttctaatactattagaaacttctgtatatcctaggtaaatagttcagcaacagtgggaatctagatgatattcaagtattgtctagatctatgaggaaaatgttggtatttctttgaaaagctgagtatatgatggcatatgttttgaaaatgtctgaagtttttcttcaaaatgaattccctccaagtcaataatgcaaatactcctcacttaatgctgttaacctagcaaattggcacttgattaattttatttttttcagatttccaataaaaatcaggtatatattttcatggggaaaaacttagcttaaacacataagggtatcaaacttagtgtgacgaaaatattttaaaattattctttcttaagaatagtgtaagttgttccaaaagggcaaataagaaagggcaactaagtcgtttaccaagggcaaaaaagtgacagacatagtcaggcaacctgtctgacagtggtaacaagacagtatacttctatacagaggcattgcgaaggcacaaggaatttaagtgaaggcctcaaaaaaagaaaaaagatagggaaggaacatttattgagaacctattctgtgccccttagctgggccttttatagctaatatataccaaacaaatctgctgtttttgaaagaccaaccagtatctctgaaagtaaagtggttttttctttgtttttgtttttgttttttttctctgacacacacttacctggaaaggtcgtatattcacttttctttaagcagaacagaagcctttgaagacacatgttggtcaacacctgattctgggtaccagatgggcatgtttccatgcagagactgggccatcctctccagtttctaagatacactcatgttcatcagttagatgttttatttattgaattgactggggacaactaggaagtggaggccccatgattatctcctctttttctccctttctcttacaaaacacactacacatgggcacatgaacagagactgttttcagtttcagatccctttttgccaaagaactgaatcttttttatagtcagtatctctataactgtatgttatctttctttttttttttttgagatggagtttcactcttgtcgcccaggctggagtgcaatggtgcgttctcgactcactgcaacctccacctcctgggttcaagcgattctcctgcctcagcctcccgagtagttgggattacaggcgcccacccctaagcctggctagttttttgtatttttagtaagagacagggtttcaccacattggcaaggctggtctcgaactcctgacctcaggtgatctgcccgcctctgcctcccaaagtgctgggattacaggtgtgacccacgatgcccggccaactgtatgttatcttaatgataattttttcctgttggtcagggaatttgtacaaaatgtgtaacacagaaactatcttttcttttataataaattatttgaataacatacattactagaatgtttccctgcagtgctatttttataattgatgaatgttttcaatggtatatagtttaagttctagtgaatatttgcagtttgaatattggttttctgtaccttgatttgcattgtcaaaaatttatttttataatacacatttgtttcattaaaagttcttagagcagagacataatgactgtaaaaggtttttcaggtttaatttatgatttgaatttcatttataatgaagttatttgagtttgagactcttaaaagacaaacataattgtatattggatgttttatttagtcaagatagataagtcttaagataaagttctgctgatcatatttaaaggacaaattctaaagccttgtgaatatccataattttgtttaggttttgaatgatataatcatcttattgtacccataatgttagataaagcaataacttgatttcccaccgtatgggaggagtcttaaatctgggagattatagaaacaaaaataattaggaggcagaagagagcatatgtattctcttctgcctgcaaactcagttatctctgttgtatacacatacatgcacacatatgcacaaatggtgcaatatttgagaaaattgagacttatattttaaattcattatcttgttatagttatgctccgttcactttgtctttaaatgtagacttttaaaaatttatttttctgagagtggacactttcctaatgttttataatggcttatgttttttcccccagttcatgcacctcaacccctttctgattatgtaaaaagtacagctgtagatgctttttctgccacaaggataaacttggccttagagtcaagaggcttgtttcatgaatgatgtatgtttgattatctttgatccagtcacatagatctggatgttagagataaatgtgctactcctgatgatttcctaacagatgcttcccttttctttttgtctctggcagttacccggctgtatgtgaattcttacagcacaataacttgttatctatactccgagcccacgaagcccaagatgcagggtgagcagttttgagcatttataaaaaccatgcattgtccattttccagaacttcctcactttgcttaggctctgcaggttcccttttaccaggctcactcccaaaaggaattagagcttaaaattatcttctgatggatgacacaggtatgacagagtcctagggaatgaatggctgcagatgtatcgtacagtctcccgtaaagttcttacatctttagcctgaacaagtccattttcagcttgatttcttaagtactgtaagggcacctcctcttattcctctcaattgttgcatttacactgtcatataagtgagtaaattaccagctacttttcagtcttgttgaaaatatgaatgagaattatactaaatatttaacaggtattgcacattttactgttgttttaaagaataccattcctaatcctgaataccattcctgatccctgtaatatccctgattttaaagggaaaggaatagggacatctttaaaaacagggaaaagtttatgttctaactagcaaatgattaaataaagttgattttgtctcacctggtaagtttctaagatgtagaacaattttggaggtttagaaaattatgaaatttcagatgttcactttaatagtatattaaatctacattagggagaaattagactacttttaagatttgaggtctgataccgtttcccagtaggctccactgaaaggcattgcttccctttgaataattaaactcatcccttcatagtctaggttttctgaaaagtagtagcacttctttttataacctgtgtgctgaaattgggaatatagatacctgcattttgaaggaggcccatgtctatgacatccctgaatcaaggaagataccaagttcatttcacaattagctgttttcaagcaatcagtcaacaggtgtgaacggatccagtgttatatactcactgttttgtagctgatgtttgaagtaacctgtttatatacccaaccagtcaggtcttcaaataattgttctcacttgtcaaggctatggtgtcactatgctattttggctgtgttccagtcggctgactgcccatttttggcagatttatcctgattgcactacctacccataaccactggcttacttgaatgtgtgttaagtgcatcagttaatatcaagtatttttgtttaaaatgagaagttgattgattcattggaaaaattgagattatgtcatccagtttctttgtttttgtttgttgtcaagtaggcatagtcaccctctgtctataaagtcaaggtactaggattaagagtgaaactgtctttcacatggattttgtttccataacgaagctcagttccataatcagaatacatacttttagaacatttcaaaaggtttttaagggggcattttcttttatagtatgaccaagttccaaaaagagaggactcacagtgtttttaaaattataaatgttaaggtggctgtttatctatctaaagatactttttgagctgcttttagaacctaactatattaggcacggttcagtctaccagaaataaatgacacagatcaacgaagaaatgataaaatgttgttttgaagaggtatttctaaactgatactcctaaaattgattacacagaagtcatgagatacatttttatccttatgtaaaagagacacagtcacctgtatttttaattgagaactaaagtgttacattataaattatttctgcttagtaactggattgttggtttatttccaaagttcttgtgcatgttctgtttcattactgattgattaaatattaccctgctgagacaataatctttgacctgtagacaccagcagagattggtaataaataaaattctaaaatagaaacagtctcaatttgtaaaatttcatagatttaaggggacattctttttaaagaaaattacttagtctaggcaaaaatgcttgtatatactgcatctaggaattgcattaaatctatgaattaaatctaattattaatctaaaaattcataaatttaaggggacattcttcttaaaatcacttagtctaggcaaaatgctttacagaatattgtggatttatcagataattggcctggttattagtggtaagtctttgtatcttgctctacttatttggtctttttatgtcaaaaatgttgacaacattttgaaaattttgggtgggtacaaagtatctgtgtgcactaatcagccttctgttgaacacatggaaatgaattatgattttccaatgaattccaccctctcttgaggtttgctaacttagaaaatacctgtttggaaattttacatatgaatgtatgttttcatacccacccccctgaaatgtattaatacctgtgtataacaggcttcagagataaatttttatttagtgttatatgattggaggccctttgaatgatggaacttgactcatctaattttctatttctcaatctatgatttgatattatcttttttccatacaagctttgttttgactgtatttgttctttttaggtaccgcatgtacaggaaaagccaaacaacaggcttcccttctctaattacaattttttcagcaccaaattacttagatgtatacaataacaaaggtaagtgtttttaaatacctcttgcagtcttacataatatgtgtaataattcttaagccgttttattttggtttggtcttaagtattttaaccagtctttttttttaaaattttttcagttattgtttcatgcatactttgtgattatcctcaaagatacagattcaaatttggtcagagattgggcttatgcactattaattttttaaatgttttctaggacattttaatttttagcagggttgacagctgctgctctagtagacaaagactttaaaagaaataataattggaaataatccaaaatcatgcttcttaaaaagaatttggatttaaatagaataagtgtgattgtccatggaaaggatcaagaaaaataaaaaataaacccagtagcttgaaattcaaatttgaattgcatttattgagtatctaccatgaatcagttcctatgctaggcaagtacatgtttatttctttaaaaagcaaaaaaaagtaaacttcaaggtaaatattattagctactctacctcctccttctttaatatgcagactgagttcctgtggttaattgccttgtccaaggtcacttaattaggaagtaatgaactaggttcaaatccatacttctggttcagtgtcctgtgccttttttctgaaactccatgcctgaaagaaacatgaaacaagagggcattattacttactacagggaaaagaagaagagcaaggggtgcattattatcttgtttcataaatgtaatctctttatttggaaatattataaagtgttccacatgtgtcacatgcgtgataaaatgtgaaaaagcctttaactctatgtagcattggtctggatattatataggcagcatgtccgagtgtggctttctgagattaagagaaatggatcacgaagtcaggagatcgagaccaaactggctaacacggtgaaactccgtctctactaaaaaaaacacaaaaaattagctggccgtggtggcgagtgcctgtagtcccagctactcgggaggctgaggcaggagaatggcgtgaacccgggaggcggagcttgcagtgagccgagctcgcaccactgtactccagcctgggcgacagagcgagactccatctcaaaaaaaaaaaaaaaaagagaaatggaaacaggaggaaaaaagcgtcaaataacatatctaaggtcaaatatagcccagaaggggtggtaaaaggcagcctagtttctgcaccagtctgaaaactcctggaattaggagccatgccccttcataaatgaggtgtgatgggtgtcttcctggcccaggcctggtgtccaggatgcctaatatgggccttggccacctttattcccaagcacctgttgaatgtccttagtcctttgtttcctttcatgtattccactttcccatagcccagagaatgacatctgctggatggtgtttgctgttgccatacggtcttttacattgccgttttgaccatagtgggtcctcctctatagtgaaggagcatggttatcagtaaggcatagtgcagtttttgttgtaaccatggggaagaaaggaggcagttcctagaaaagaagtgctgccattagtagtctatggcaagaagaatgcaaaataaaataaaacatgttctctgcttgccacgtgcttttaagtatgtgggagtgggagtcagtgattcactgctaaagtgaagattattgtatttgaataaaattgatgtcacctagaattttgaaaagcactgcaataaaattgggtcacaagcacctttaaaacacaatcaatggaaaaatagctgtgaagaacctatgagttaatcatttgattgttagaaacaaatgatcataaaggaccctagaattataagctgatagttacagtatgatttgatttttaaaactactgtagagttgacaaagtaagacatttgggtaatttaactaaaaatataagacccaagatgattaagtgtaaacaaagagagtcaaacacgaaatacatttggtaagggataattttctagaatggtcagagaaggccttaagataaaatatgatctggatgttaaagaatagtgaatgtttgattagaaagagaaataaatagtatcagggccaatgaatatttttaaagcagtaaacatttattgtataaaactcataaaagctaatctctttgactggatgaggattctcaatcttgcacgagagaaggaccctgagatacctgcagggaatgcaggaatttagtaagtcatattgtatatcccagtctcaccatgatcctataatttaccaaaagtacataaagtatgcttttatatattttttataaacatgagtgtattgttctatggcattaagattttttactattaaactgagggaaggaaatgtccctaaaagtcattttcttgccaaagactgattactaaatagcatgtactctgcttagaagtttcccaacagtttctaaaaaagaaaaccaaaacagtaaaaacggaataaaaattgggattttactccacaaaaacaaacctagactctttcaattcttcataatgctaggtaatgcagttttgcctgagaccagtagctatttctcaaataaggtgtctatttcttctttttgtatagttctgatttaacaagtttggaacttaaaaaaaaaaaaaaaaacagataccagtgcatcactgactttgagattttgtagttctttcactgtgttcttgcctttggggtagatcagaatctctcaggaaagggagtagaactgtttcattttgggaaccccttcataaaagaaaatattctccggagagaaaaagataaactgatagggaagagaaagatgtattctttagtttaaacaaaatttcaaaagacttttatgtaaaatttctgaagcactttaaagctattatactaacagtgtatacagtatgtgggagtgggagtcaattattcactgctaaagtgaaaattactgtgtttgaataagattgatgttaactagaatttttaaaagcagtgtaataaaattggattgcaagcaccttcaaaacccaatcattggaaaatagctgtggagaatctgtgagttaaccatttgattgttagaagcaaatgataataaagtactttggaattataacctgttagttacagtatgatttgattcttaaagctcctgcagcttaagacagcagtaatactatctggcaaaatgaaacagtgagaaaaataggtttattcttgccatcttaaaaccaataatagttgtgatcagattcatatttaaatgcccagtatttcttattagtagttcatacttatctgtaattaacaaatagcattcagaaagttatgaggactaaatgttccatctcttggtatagcccacattaattcattcagtctcatcctttccagtctgcactgtcttcctgcctgtctccctgcctctgtgtcttcactctgacagctctgcaagatgccatagcaaaagatgtaggtttgaatctcagctctgccattaagcaactaactcatgtaaatttattggacatgcagtggcattgctatgagatgagaaaaaatgttcgtttgtgaatactgcatgaaatcgctttgaaacaaaatgctgtgcagtattaagacattatcattattgaatattttatgttgttattattttgtcacatgttagtgcaaagcttcacagaagctcgcaggaaaattcccttattcctcagtttcttatttataatttcactatatgcctgaaactaccattatcacctgtctctctgcttatcttggagtaaacctcattgccctgagcaactttggctttctgtttctccactttttcacctgcatacttatttctatccaaaatatttgtctcattcttctgcctaagtggactagacccactccagtctgcgtttccataaagacttctgttggtggtccttctctgaatgtctgcaatgctaatcattttctcttgtatttattgtttacgtttttcttgttagcttttgcatgcattcctgttatttcccaatgaggttataattagtttgacacatgaggctttttggtacacattgtaaagccaagttgcatgccttgtacgtggtaggcagtcaatacatgcattgatttaagcatttttttttttttttggagaattaacagcaagactgtgaccagaagtatcctatcaatattgacccacagatctttatctcactttaaatcactcctataaccagtgctgataccctttctaaattggagttaaacatttgcagagcactttgcacatctggattgttgaattttctcctgtgaatctgtagacctaaaggaaaacctatttcctaattactcaaatacaccaatcaggtgaaaattacagtaatgacacatagcttcaatttttaaaaaaattatttgccccctgtaaaagtgattttaactatacccactcaccaatacaataaacctttattgagaacttactatataccaagctccatgctaggtgttggggatataaatgaaacaagacagacatggtctttaacctagtgtgcttaataatctggtagtatgatagacattaaataaataattccaccaatgattatttatatgtatttggaaaaagcaacaaagaaaagagtggtgtgatatgagagtgaaaattagtctatggggactaattggggaagtgacatttaagcaatcagtgagagtaaaatctctctggattgagaaatagagtggcagatgtgaacattggcttaaacaactcagtttggccaaaaattgcaatgaacctctgggaaaatgtattttataccttgatgtaaacacttgaattcattttctctgtagaggtacacctgtgcttcaaaagaatctaaagtaaacgacagtaggtttccatgtggtacaagttctttgtagttcagatgagttgttggatggacgggtgattagatgagtagttagatacatatgtagagaaatataaacatatataccaggggtatgtaacttagttccagtacacactactgacagtaaaattaaggaaatttgttaaatgaaaattattttggatttgagaggaaagtctaatggcaacgaaactaatttagtaatcaagaccaaacatttaaatgataaccaagaaacaaaccaattcaatattaaagtagttaaggaagagagaggtagaaaattgcttttataagatgcacatggaaagcatctgatgtggttttgctgtgtccccacccagatttcaccttgaattgtaataatccccacctgtcaagggcagggccaggtggagataattgaatcatggaagtggtttcccccatactgttctcatagtagtgagtaagtctcacaagatctgatggttttataaatgggagttcccctgcgcaagctctcttgcctgtcaccatataagacatgcctttgcttctcctttgacttccaccatgattgtgaggcctccctagccatgtggagctgtgagtccattaaacatctttcctttaaaaattacccagtctcaggtatgtctttattagcagcgtgagaacagactactacagcatcatttgctaaaattctgagatgcaaaagtctatcctttttgatagggaaaaatatgatgttttggactcataaattagcaacttgatataattgctgataaaaagcattttactcttgatgttttccatatcctcatatattttccaatcaaaaaggagtcataggcttcaagaagataccatttataaataaaaagagaatttctggcttggcaggaagataccattgtaagagagaatggaattgctgctgtaatgaaccaacataagaattttgttggcagtcatgatgtgaacagaaaggagcagatgtaacatatccgatgccagcttgacttggtctcctgacttctggcgggaaccctcagtgacactgtctacatagtgtggtatggccagacctcagaagctcattccatactataccacaatttttttccactaggaggttgttttatcattcaggaatatttttcacaaacttatagatatctgctacccctgtggttcacaagccaaattcagaatcagctagctcagatctttctgagagggagatgaggggtctccgaaaggaaagtggaatctatacccaggcgtctccaagtagcatatctgtttccaccacagcacatcaaagagctcactcccctacaaagttgaaccatattttacagcaaagatccatttctacgagcctgaggcttgtcttaagcatggacataacttttagtattgacttttaaagcactttttttgtatccttacaaccacaggttaaatatgatcactggttgctttaaaagttggataaaattaatccagagactttgccccgtaacaacagttttcccagcatatgctttttccctgccatcatctcaaacctgaagatcctcttaatgggtcctgagcacttgtttgccccagatcacttactgcagtataaaaaacgtaaacatacagtcagggcagtatatttggtactttctagtaattgtaggccaaggttgttttacttttttatttttgttttttgactaaagtaaaacaataagacatccccccaacccctaattcattccttcatttatttgataaagattcttaaagccatatgggtatgatagaatcatacacactagaagataatttattcttaatgattattaagcctaagagagttcactgagaaatgttatgaaatacaataatttatatgaaggaataaagtagaaattacaaacaaaacctcttagtattcttttattatcagtatgaggtggtacataggccgtgtgcatcccagcactttgagaggctgaggcgggcagatcatgaggtcagaagttcgagaccagcctggccaatatggtgaaaccccgtctgtactaaacatacaaaaattagccaggtgtggtggcccgcacctgtagtcccaactattcgggaggcagaggaggaagaatcgcttgaacccgggaggccgaggttgcagtgagctgagatcacgccattgcactccagcctgggcaatagagtgagactccatctaaaaaaaaaaaaaaaagtatgtaagtgtgtatatacactatacacacacacacacacacacacacacgtatatatatatggtggtagaaaagaaatttatgtaaacatttaaggctgaagagaacccaagggtaggaagttttgattggcttttagaaaaatcaccctctgagatgaatgattaaaattcactgcagagaggtttcaacagaatgtctcctctcattgcattttatatccaagattcaatatgtgtaattaatccaactgtaatattaatttcatttaccattgtcattatcattgtcaccttgagtgatatagctttatatatatatataattttttttttttttttttgagaaggagtctcactctgtcccccaggctagagtgcagtggctcaatctcggctcactgcaagctccgccttctgggttcacaccattctcctgcctcagcctccggagtagctgggactacaggcacccaccaccacgcctggctaattttttgtatttttagtagagacggggtttcactatgttagccatattttttaaaatcttcagttggttatatatttagcaaatataaatatttcccttcagttgtgatagcatactatacttatgctgttcactttgttcctataaatagcatataataataactaacatttttgagcacttattatgtgccagacactgctcagagtttatgtgtataaatgcatttagtctttcaacaaccctatgaattactgtataatcttgatattattgatgaaaatctagggcacaaaggaactgcatatttttcccaaggttgacacaagctgataccagaaagcactgagattgaaactcagctgactgactgcagagcccacatgcccatatattaacctctgtctgtactcttctgccttagctttgttgtgtgaaatgtttgtgaacgatccactaatccacccttcacctcatggttccattatgtttaggtgactctaaccattcttcaataagaaaagaaagcttttgaaatgaagagtcatttgttatcactttaaaattacctgagtgttatgcatccaaatacatgcattattaaaagaatgaagttagaataccttgtacatttttctaaaataaataattcatttctccctttaaaatgtattccctaaagcacttttgcttttgtttattcagctccactgtgaaagtgtcattgctggaggccactttgtaaataggttagttttaatccagtagtcacttgctcacatttaaacatttaattaatggaagggatggtagaatataaactatcccattaaaatttaatattgaaagattccttgtactatatattttaattgaatgaatctacacataatctctgtatctttgtgccaacagatgaccttcttgatttcttaaaaatcactactctctaattgtaaatttagttaagtagttgtgaaacctcaacaaagttaagacacagtgtgtgaggtaattcttgcttttcacaaagctttgcctatagaattacaggatttcagatgtcagagttaggggagaccttaccagggaacaaaggaggagtcaatgctgaatcctccatacagattcattgccaagtgctcttctgccaccagctgaaaagggtcaatcaaaaaatccatcttaaagtattgaattccgttgtctgatagccctgatagttgattcttcagttgaactaaaacctacttctttagaaatctcattctctataaagcattcaacaagagaaaaacagtaacaatctgaggaatgttaaaaacttgaattaatgggttgtcacttgctattcattatctaggaattctagacctgcaagagactcttagactttactcttacagtgtcaaaaagtctgtcataacattatttccatggaaaacaatgttgatatgaagtgtaggaacttaaaactaactcagtgccaaggatatcttggagataacctagaatcattgcaagctatagctcaaggcctgatacaaagtccaagcttgaagttgaaaagggtcttctacgaatgtgtagtgataacaccagtttcaaaatacctcccaccagagtacagttacccttattaggcttttggagctgcactgaatgagagcaaggtgaaggcacagtgtttgctatgcccgtgccatctccaacagcttaaagcttcagctaagactctctctctctgtttttagtctagatttgtgtaagcctcactttagcattattataatacagattagaacataaatgaattcactagctgaaactgttaaggaactgataattgccaatgtttcttccttattaacaaaaaaaaatttgctagaagaaattcaaatactctatgcaaaattgtaatgttagaaatgattcacaatgtttaactggacttgagctacatacaaagatcaattatcagccccaaattccctggatcctagtatgtaggtataacacattaggtgggaattataaaatggcaaactatttaaaatagatagccatgcctgccttgaggaatttgaaacagacttataatacatttctcagggacaaaatatttcatctgattattatgcatattaatcatatgtattatttttttccctggcccattctcagcaattggattatttcatctttatactttaaaagtgagagggcagatattattcctattttataagtttggaaggtaaagactaaataaggagaaatatttgcccaagttcatgcagttgccatgtgacagaactagtatcctttccactgttctttaatttacatgctcttacaattttaaaacagtttagcctttgaggtgacacattgccttttacctgaattgctttatgtttccctcagatttctgtttatattttgttagttatgtttttagtatcctgattagttatatgctttgtgtttctttcctctctttttccctcttctcccattttctattttcattccttaggttttttcttcaaacaacacaattaagcatcaaccatatgccagatatagtacataacactataaaaaaaagggatctgtgcctccctcattccttctattgtcttcttcccacttactttacccaaaattctatatatgaataataacctagttaagaatttgctaaccctatatcaagaatggaaacacatacagaattgaccccggagcaacacagaagttaggggtgccaacccccactgcaatcagaaatccacatataacttttgattcatcaaaaacttaactactaatagcctactgttgctcagagccttcctgataacataaacagtcaattaacacatattttgtatgttatgtgtgttatattctgtattcttatagtatataatacacaaaacctagagaaaaaaatgtcctgaaggaaattataagcaagagaaaatatatttactattcattaagtggatgtggattatcataaaagttttcatcctcgtcttcttcatgttgagcaggctgaggagaaggaagaggaagaggggttggtcttgctgtctcaagggtggcaaaagcagaagaaaatctgcatataagtggacccatgcagttcaaaactgcattgttcagtgctcaacagtacacacacatgcacacatgcacatagtcataagattacctcatattgtttcacagaaatatctattgccatctctgcccttcatgtaggtaagataatatgagtattttatttaggagacttgtaacaaagtttgaaaaggtgttgtaggtactatgaaggatgcatgtacaagttatataaagtatatagaggttgagaatgtatttccatttccacctagtgagtaagaggagtggggcaagggctagaatggacataaagtgattatatatagtaacatatatctgtgtccttgatacacacaaaataattctcatagcttcaagtaagtcatatatacctactatttgtatccactaataacaaaatatttcagattggctgaaatttagtcattatgagccaggcatggtggtgtgtgcctgtagtcccagctacttgggaggctaaagcaggaggatcacttgagcccaggagttcgaaactgcagttagctatgattgtgccattgcattccagcctgagcaacagagcaagaccccatctcttgaaaaataaagacagaaaaatttagtcatttactgaaaatttgcctgtgaaagaccctatattaggtactggatgaaacaatataaacattaactttcccatactgaagaatatcatggtcaaattacctaaaaatttaaggcttgaagtctatcttcataagtgacttgaacacataactttcacttaagcttatgatctaaagagtaaaagttatgaatacagtccttgctcaccaaatactgtcaccatcatgaattagtacatttccctttaagttattaataatattaaaataatcttttgaagacagaattcatccagcaagaactaggacattgaaggggaaaaaaaggaggtggaagttagaagtcagattttaaaatggaaggaattgtagagactgtgttcatgaatgctataatatatactacggaaaagtatgcatatatgtgaatatgcatatatgcatattcacacaatcttaaatgaaaattgtacccccaaaaagtaatctttatgagaaaatacagatttttgaaaactaagtagcatggctcccagaatttaaaaaaacccctgcatgcagcataccagcataatcttcaaatgctgccatagaacattatgagttgcatgggtcctgcttcaggaattctatccaccaaggcattatgcctcctttcgtgatggtaggactttgccaaaagaacacactgatgctagtttttctgctagggcatctgcgggtggaagaattggaaggaaaaaacatcctgggtctattatgcaatttatttgtgcttttgctatttctggatggattatgattctggaatgcccccattcggtttcttctcatctttgtttcttttctctccctctttcccatcttctgaaggtggaagaggatggtcagttagagataaggagatgaaagacagtagcaaaagggtgagaacaggaataaaattcaagtcatttttcattcttttgacctcttctcccctgtcttaaaatcaggactagtggtgtgaagaatgcctgaagtatgttggaatcattacagttacaggtttttcagaaaaagaactttgtattcctctggacacccacttgaaaagtgcttagtccatgtgtggtttggtaaactggttaataccacttgttagcaataattttgatagctggtctttaattagaagctttttattattattattattattattattattatactttaagttttagggtacatgtgcacaacgtgcaggtttgttacatgcgtatacatgtgccatgttgctgtgctgcacccattaactcgtcatttagcattaggtatatcacctaatgctatccctccccgtccccccaccccacaacaggcctttctactcttgtcattcattgctttgtctctagtttccctgggtgatggaaattgtagagagcatgttgcgaaatgttttcatgttcttatgaaatactagttgtttttttttttgtctcatcaaaatttcaaattaaagtaagaaagaccccctgttttacagatttggatatggtcaggcaacttagtacatggcttggtagacagagcagtggattaagatagagattctattctttggacttcactatgtacagggaaccagttgtgttattagaaataatcgaggttcagtccgccttccccattcaccaagtaggagcaggcccttgattactaattttacatcttttacagcatgtctttgaacacagggttctacaggtactataaaaatgagtggattgtctttaagacagtaattttgacatcagaaaaaggactggcagtcagtcttccagattcgtgggattagtattcttttcattataccaaatttccttccagctgttcttcatacctgcaactacaacagaagagcatttatttctgtggtgtctggtgtgctctgaatgatggttaataatgtcaggcctgcatgtatgtcacagtctctctgttacaattgttaagtgacaagaggtcatgtggaattgccagtagaataaaggagctccttggtagtagacttttgttctttttttctctgtttctcagacaaggtctcaggaggtggtcttgagtgattattgaagtacaactatttgtattatttatattgtactggagataaacgtctttcaagtacttcagagaagagcgcactgttagggctccagttgggttttgtaatcccaatgacagtcggaggcaggtggcaggggcggaggatgtgggaggtggaagatgaaacgttaactgtgaatttcgtgactgcagatattttggactgttttagtttttttttctcatgtatttctgtgttatatatttattttacaaaaatatcagaattttgagtaacttactaatgtaaggttattcaaaaagtatttttgcataaatgtgttgctgaagaaaaaagaatacatattgttgtagtttcatttttaattttaggattttttgagctagagaaaaataaattctatttataacctatagaactactgagaatattattttttgcattagtgatgaggcctttcattgttaacagtgaagtttgttaacatcattcagatctggaagagactttataaattatctataaacccacgtagttaggtaactgagacttaaagatattaagtaccttagtctggtgaataattagtgacagattccatcttgtagtctggcctcctggctttccagtccagtgctcttctttaaagagattaaacatggaaggagaaagaatgtgtgtccaaaacttgatagacactgaatgatttatactattaggatgagtgtattatgatgtactagaaggatcagagactttagactcaggccaaaagtgagatttacctctttctaagtgtgactgtgggcagataacctctctgtttgcttattttcaaaatataaatgataagaaccacttttgaggaatattgtgaagatttgtaattatgtttgtaaagggccacacataatgcctggcatatatcagatactcagtaaataaatgaaaataaaatctgaaaacaatatttgctttatcagtaggtactcaagtaaattgtattgagccaaggtcaaatgaacttttatctcaccaactgcaaaacagaacttctgttttatctattggatgagacttacccttgcttgtaaattgcatcctgtttcactcaaacgtgtattttggcaaaagctaaaacctctttaattatgaaatccatattcaaagttaaattattataacagctaggactagaattcaaacatttataatttatgagagacagcagggaatgaaagaaagggaatgaatttggtgtcagaaaaagctgagtttaaataatgagtgagatctgtcagttactggttgcatgatcttgagcaagtttctccatttctcaaccacaattcctttgtaacataagggcagtcacacctgcttctcagatttgttgtgcggattattatataaagcctgtctgtttcctccagggcactgttaattataatatttactttccttcctcctgctataccaccaacctaaggttaataaaaagtgggggaacttagaggagaaattactcttcaaaaagacaatttagagccttaaagattcatctgaagatatgaggatgcatttctgctgtgaacattcagtgttctgaaatagtaaaaaccttttacatggagctagaactctggtagcacttagcaaagatgggaaatacttcacctttttcatactgaagatcaaaagtattgatatgatagtttgccttgatttttttattttgcatgtttttagcatcatgtaaatgtatcctaatggcataaatgataaagcaatgtaaaagggaatgggtttacagaaatatatgcaggaattagtattccacaggaagaagaggataactaccttcatatcagtattgcctacactatctacatttcttgtccccagagtgtctgtgattatatgttccctggaaccatgttggtcagccagaaatagcaattcaaagcaaaggccttaccattcacaagtacaagtttagttaaatgcaggctgctaaaaacatcaacatattgttaggctacaatatgatatatatagtatccacaccacagaaaatgatatattctccccatactctgcactgttcaaaccaacctagatgattatattacttctgggccacattttaacagagacattgccaatctggcatgcattcagaataggttgagcaggctgagctaaagcatcaagaagccatgtcatattaaagagggcgaaaggggataaaaataatttgcttgaaaaagattgtaaggcagataccaagatgtgtctccagctcctgagcatccattctgagtaaaaacaaaaaagtaaagaaatgattactttttctgtattttcaaccccataacataagcaagaaaagatcatatgatatcatataaaatctgttggttactgtcttctaatgtaatacaaattatgccctgaatagataataaaaatgaaatcttgccaaagcctaagaaggtatgcttgagtatcatatttaatatttaaaaggctgtcattcagaagcagaatgacattaaatattaaatatgaaatgcatagcaaaaccatgatcagtgactggtaaaggcaggtttaaatgcaacctgagaatttcctgcaacttcaaattgtctatccatagaataggtgacctcattaaaacaggtgacttttcctttattgaaagtactcacagagacatgaagcatgcagatttgtcttcctgagtcatggatggacatctttttcagaaatcaaggatagagtcagatagaagcacattattttatgtgggattcaatccaaacattttattttattaagtcaagaaagcagtctactatagggtaactatagttaacgataatagattataatttcaaatagctggaaggagaatattgaatgttccaaatacaactaaatgataaatgtttgatatggtatttaatgtatagctaattaccctgatctgattactgtgcattatatgtgtcaaaacatcactatgcaccccataattatgtacaattattatattaatttaaaaaataaagtaaaaattaaagcaatctaacttaaactattttgtacaactgttgggagttctattgaagttttactttttaaaaataaattcattcaaatatttgaggagattattatgtcaaacttagctgtgccacttttattagtgtcatcagatatcaaattttaagaccaaagtattcttggctgaaaggggagcttgaatcagttcctgacagacattggattaactattttgtgtaaatattttccaatttgttacacaattacatattaattattcatatattgtgcagttatatattaccctgagtaaggtttaagtccataagttgtataagcattctgggatgcctaaggtgtgagcctggatgttttggaacttcagtcaaatggttgaattttcttgatgagctaaagccatacatagaagcagaaatatgttctgtgttcctaacatcctcttttggttatttttagctgcagtattgaagtatgagaacaatgttatgaatatcaggcaattcaactgttctcctcatccatactggcttccaaatttcatggatgtttttacttggtcccttccatttgttggggaaaaaggtatgttgtggaatcctgagatgttcttcttaaaatagtttaggaaggaaggaaaggagattaaacactcagaaagagaagaactttggcccagccaataaaattcacaagttgtacaatgaaagatgtgatttggaagtggcagtgtgtcactctgtatcctattaacaggacacaattggtgaatgagggggaagcaaaaaaaaaaacaaaacacaggaatatttaggaaatttttacaatcttattagaataatataacgctttaaaaaataatggaaatacaggtttacctggtttcaagtaatgtctaccctttttccttacccatttgtactataatcccaaaggactatttaattttacaaattatctgccaaattaaaagattaggatagccatgctctccttacatttctgatgttaataaattattgtacgatagtgcttaatggctacaatattttgaagaacaacatgtacaacagcaaagtagttcatcaataatgtaggcattagcgcattataaggtacagaacaggagacaaatttacattttagaaagttatttgttaactttcttcctaccttccttctttcctcctttgttttgctttcatatgttgacttaaaccccaacaaaaattttggggaaatgtctgcaccaattgtttttcattcaggaggcctaacagtgatacacggattgattctcatgtatcttctcatactttccatgagaaggtgaatgggcattgtaagaaaaataaatgttcctataagtatcagagtaatgatgttctatgaggagtatcagagaaaagctaaatatttttctgaaaccctaatggttgttttccctttaaatgccctaaaatgattaaaccagtcaagttatgagttgttggcaaagaagccttccctttgaatatcaaaataatcaaaagtaaatttttaataatctctgataaatattcccaatactactccatattgcaactttcttgcactgatcaaattggagtagtgtcatctgttggcttcgctggaaacagaagcagtgtggatgctgacaactatggggcaccttttgaacatcctttatttgggttgtttctattaattattaaaatttgggacatttattagaaattaacatattaatctattggtacacaaaatccagttttgataattaaactgaaactctggatcagtgttggctctattgaagtttgactctctatcattcatcttcaattctagaaggacatttttttaaatagcatattactttaaaaagtagctctcaaagaagcagtagacaggcttcttttcacatgcatggtagaatccaatctaatttcaaaaaatattaaatgtaaatagcatggtttatagtataaaaataatgcagtactaatttcctctgtacaacacttttatgtaatcctattgtaatctattaagtaaatttctgattaaactgcaactgtttaattttttaagcatttttgaaaatcaaatttaatgatatttctgtcaatacatttttaaaattagtattctgaaaaatacttcaaatatattagtttatcaatcaacagtttgtattaaacacaaaaccacatgcctataatggcgtgaagttctctaggtgattaaaaatataagaaaaatcatcattcttagtccctactgaacagaagtttgtaatctgatctagattaagccttatcattgtgtgactaataaaaattcaaaaaaactattttctctttcattgatttgtagtatattcacatccacatatttgatttgtcattgtctattgacctagagctagtaaatgttaccattagatatcataagcatcagctaatagtttcataaagtctgcatagaatcacaaaggctgtcttttatgatctggatgtttactgaaactgcttctatatacaaactaaataagaaatgttattgctaagtttgctcattaacaatgccagagtaatagttaaggttataacagaaaaccctgacttttctttctttgctttctctctttagtgactgagatgctggtaaatgtcctcaacatctgctcagatgatgaactagggtcagaagaagatggatttgatggtaagaggcttgagcctttgtgctaatgctatttgccagataattacttagagtctcattgctaaatctaagaataaatttctaagatttggattatgtttaaaacgtaacattattgagaataaaagatatgatttcattttctgtttactttttaaaagtataagaaacaaatatcatgagaattttctcattactttaaaaacattgttaaagtagtaaactgttttaataagctttcagtagctcacattgctaagtgaccttttttggctttttgatacaaatttaatcctttattttctaacagatgttaccaattactggacaattattttttcttttaccaggcaatttaaaaatgtcctctaatggggttgctcacatcaattattcaagttttgatgtttatgatgaaaaaggcatttacatattgatatattggtatttatttcaatcccaatatttcttctttctgtagtaataggtaatgaataaactgtgaggagttttttatgttttttaagatattacttggtgtttaattaccctcaaagggtatgctttttctgcaagaggcacagatccatgaagttaaagatgaaggggaaaattaccctgagtcttacaaaagcacctcaaaatgaatggaaactgacaaaaatgtacttagagaagaaaagcataagagcaaactttactgcatttaagaagtacagttgaggccgggtgcagtggttcctagcactttgataggctgaggcagatcacttgagaccaggattttgagaccagcctgggaaacctagggagaattcatctctacaaaaaattagccatgtgtggtggtgcatgattgtggtcctagctactcagaaggctaaagtgggaggaaatcttgagcccaggaggttgagactgcagtgagccatggtcataccacagtactccagcctgggtgacagagcaagatcccatctcaaaaataaaagcagtacagtcagccctccgtatctgagggttctgcatccatggattcaaacaacctcagattgaaaataattcaagaaaaagttgcatctatactgaacacatacagactttttttccttgtcatttttccgtaaataatacagtttaacaactatctacatagcattgacattgtgttcagtattgttaagtagtctggagattaaagtatactcagaggtcctagattcaggacacccagggctacaagatgcattaaaaacctattctttgaagaagttgcaaactggttggagagactgatgcataaactaataatatcaataaaatgacacaaattataaataaagggtgaagagggcaagggaaactagatattatggtgagtttaaatggataaaatgtatacctttaaaaactgcagttcagtaaaatgaaaagagaatgtggtcctttctaaaagttggtttccaaatgacatgatttaatgtttacctgggcttgatacaggtcatgggtataaatgcaaaatacctaatgctgcaggcaaaagtataataaacctgttcatacactcatgtaaatagagtctatatactcaggtaaatttaatgtatgagatttatttttaacatctcatagtttttctcctctataacttctcttgtctttattacttgtcttcatatactatttttgagtcatataccacatcgcaaggagatgtgcaacatagggaaggaaaggggaaaatggatatatttaaaaaacaactttactgggctaaaattaagaatatataagaacttaaatatattggcatattttgaaatatgcaagagatcaatggacattttgtgctttatctaaattctagatgtttcatatgttatagccacagtttgctactgttatcttttaaatgatagcactgttttcagaatggcagaaattttttcctaaaagaatactaaccaaatggaacctaaatcataaacatcaacaaacgtttttcagtatgtacctttcactatattccttttattctttaaaagaaagattaacattaatacaataataatcccctattaataaatgtttgttttttgcaaagtccactggccagtatttatgatatagagaacaaaaatgtaacatactgtagagaataagaatgtgtagacctacatatgtttgtaatttttatgttaatccattcactcagcaaatatatattcagtatctactaagtaccaggtaccatagccaaaatgactgcacatttcactggtacatgttattcctgcacagttaccaacattaccaagactaaccctgtgcttacttcacttctagtaagttccctttactcaccatctcaattacttacatgaaaggatttgttttgtcagttactttattttaaaataattagttctaatcaatgtgctgtgctcaccaccaattgctttttaaactctgttttaattccaattgtaggagtgcatgtttgtcttaaggtccttggaagaatttttttctttctaagcagacccctgaattccccctttaccactctttaagttttaagtcagtcctgcagagaaattttgtcctaccaggtgcagggaggaagatggtcaggaatgcctaacctgctcttaccagctagaaaagatgagctttatctctcacttttgtcaacttccttcagtggtccattcctgtcaagttaaacatcattaagttatttatctttctgaacagtttcttctgctttaatttatttctgcttagctatattaacaataagatttgtgttttcaaaattttaagcaaaatttacacacaggctaattaaagtattcaatgcatattaaaagtcctatgtgtctataacttatcagattgggagctagcagaaagagataagattattgctatataatttttagggatagacaatttaatttccttggtttcctgtctcatggacctcacttaaccagtagtatgtgggtgttttttctaccttttttctccatcttatttaaaatttgttggtgtatttcccttagtcaaactaaagagaaacaatcatctaatcttatgttttatttcttttgtatatgtacatatgagaggaggaggaagaaagagatgaggagaggtgaaaagaaaagatccttctgcctgattgggctttgccagcatatgatagcagtgcaggccttggttccatgagcagcatcagattcaaatttcatagaaaaagagcccagaggaattgaaaaagagaaattaaattcaacaaggagaggcattgtatacattatgcattcacgataggttatgattgagaagaagctggtgctttgggaaaaacatattaggttctacatttaccctttttgaatagttttctcctttctaaacagggtgataataggagaatgctgaatgcctctccattgaatttggaaactgccgggccagcattagtgtggtattgtctgcccacacttttctagatgcaagtttaagatcatgttcagtgtgaacattgaggactttagagatcggagtccgaaatgtgtcaaagttaatgttaatagatgctgtcctcattttgtaactgtgacttctaaatgtgaccttttagttcatatctcataaatttgccatttaagaagaaatacagaaatgaaagttttaagttttaattaaaagtatatcttgctgggtgcagtggctcatgcctataatcccagcactttgggaggccaaggccggcagatcacttgaggtcaggagttggagactagcctggccaacatggcaaaaccttgtctctactaaagatacaaaaaaaataggtgggcatggtggtgcacatccgtattcctagctacttggaaggctgaggcacaagaatcgcttgaacccgggagacagaggttgcagtgagccgtgattgcaccagtgcactccaacctgggtgacacagtgagactgattcaaaaaaaaaaaaaagtatattctacttaagatattatatatttcagtataagcaatcaggagtcctagcatttaatgtaacatgacatcaaaactggatttcctcaaagggttagggttagggtgcttaaagatgctcaaagaataatttgtaaagcttctcagaaatccttggttttctttgggaatactgtttattgacaacgtatattgaagtgagttgttttttttttttttttggtaacattatttccaaccttaggataaaatttccaattgcggcaccctgtccttcctgcctgcagcctgtagcctgtctcccttatggggctggctctctcctgctgcttgccaggctccttatttgttgcctgaaaaggcaaagcagaaatcagaagacatccaaagacttaaataaaagtcttccttaaattgttgcttattttaagtgggctatcccttcatgagtcatttatcaagcccttctcaatatttcattccatttccaatgtcagtgggaaagtcaaaggtaataatagttactctacagtccatgactgtcttttatcttatcagcttgactttttagtgtctgtagtgcctatagcaatttagagatgcgcctatagcaatttagagatgctcctcatttccttcagaatctgtcaactcctgtttactatttaatgatgatgttagtgacagcagctaacacttacgtgttagggatcaagcttagttctttaatttactcattttaccttctggccaacaaaagatttgttattattaactgtcctttatgttaagtttactaggcaatttatgtattatctttcatcctcaaaacagcctattgatataggtactattattatccttattttacatataaagtgatccagactcagtaagttgaaaacctaagttcatccagctagtaaagtgcaacagagcctggattcaactaatgtctgcttggttgtcaggctcttaaacttcccaccacatgtggttacaatgtttgaaatcttgttcattcagtgtgatgatttttttaaaacaaacaaaaaacactaataagcaaatataatatgctttaatttgttctgttaaatatactgtaaaataaaatataaatataacacaaatataatatgctttaatttgttctgttaaatatactgtaaaataaaatataaatataacaatatataagtatactgtaaaataaaaatattctatgaaatgaagaaatagattttgcagtattatttggccatgaaagtcaatgcatatgaaacaatatcattctattattttaacataggctaagaagaaatgtgtttcatcttgtaaaaaatttaggtgtatctgagcagacaaaaagtcttctggctcacacaggcttctggataggaaaccatgtcatgattctctcttcgttagcttctgtcttataaataaaggaatttgataggctgtctggaaaaagattgctgttttaaattggcctctggtcttctatgttgaaaataaaatttaaaacttctgttatcttgtaaagtttggaagcagtttaatgccaatgaatgtcttttgatgatctaatttatatgtaatagggtctttgtttcctgtttccacttcttatttcgaatgttaaaatgatagtctggtttcaatttagggttgttattcactggaacactttagagaaaaaagaaatccaagtaaaggtatctcatttggcagataatgctcattaatgaagaaggctcatttcagaccaaggtttagtaagtgattccaaagtagagctaacagaaatcaaccttcattacaagagtttctttattgttcattattataataaggaagtctggagaaacagtaagcattagcaacctagtgatagttttgtaagttaggaatagttatttatctgggactgtcttttaggtcctaaaatcataggcactgagatcacttttttaaataatacaaattatgtttgagactgtgatatgtgataagtctcactcaccagaaaaaactgtggaagttaaactgaagccctgtagaatgagaaaggaaagaaaaaataataaagtgaatacatttcaagccaaatatagtttcaggctgcactggaaagacttaatattaaattagaatttatgtgtctgcttttatctaaagagcaaaccacatggtagaactcttatcctttgtcaacatttttgccttatcctaatgttaaccataagcaagtgaatatggaatcagagtagctttttgcatgcctctatgaaaccatctatgtcctataccagaaaattatcttccatagtctgccttgaattagataattcttcgtatctaataccacaggttccagagtgtctccctacctatttctgtctagctgttaacagttgtacagaacttaaagtgcaaagttgggaattagtgtgactaatgttgtatcttactggtccttgaggaatacttttctaagggtatgaatatattattttctaccaaaactgtatttatttgccatgatgaatgtttgacctagcaaaaagcgtttggcactagtaattcctttgtagaaatgccttggcaccccaagcataaaggaattacccccaaatcattactttcaaatagtcacagaatctaaatgggtttggttaatttaaaaatctaaatggaattaataaattaagtttaaagatttaaccttagaaagtcccatcactttgtgcatttagcagcacatatactaagagccattagcttggagctttttttgtgctgtgatttttatttctgagcaactcattttagcatcctatatttcagcttcctcatctaaaaaaatgatgttatagcctgtacagtttagggggaatatattaatctttaatataaaaaatagaaaaaaaacccatttagatatacaaaagaaaatatgctctgaggaacacagtggtgataagattcttgttctgtcaacattgaagcctaacctaaagttagtaagtcaaggaataacataataaaaacagtatttgagaaaaggcaaaaactttttcaagcttagataaatgcttggaaaatgaacaaaggatgagtagggatataatttaggaacttaataaagtatcttgaagttgcagtgacaagatctgaacaaaaatattgttaagaaaaacatttaaaaggaaccgttcaaaagacctttccgaggacttatgacgtagaatcaacaggtcttagacagaggggcaaaggaaacaaaagctgagtttgacggttcaaacctaggggcataggagggataataacatttatggaaaaagtcaccacctccaggagaaagatgagttctgttacaggcaggagtttgagtaaaactgacgtgtaattctagaaatgcccaagcaggatttggaaaaggagtcctagaaattgagaaagaaattggggctagtgacagaggcataggattaagtaataactgaatttattaagagtgaaataggcctccaagttgctgacttagaataaaatctcacaaaattaaggactgatttttaaaattagcctgcactgttaaagctggagatgaaagaaggagaaaataggagtgatgacagagcacaagaaccaggtttgtgtagcagttcaggcaacagctacttaaaaatatttgcacccagtgcagaaaaattaatatgagatataagtctggccagaattaggaccataactttggctatcagacatcagattgttgaaagagatgaatagcaaaatttatttgatttttacagtggcacgtaaaattgaaatcattgacaaaaggaaaacactaaaataaaattcagtgtgccctattctaatatcacattgtttttactttacatatttttatttctgtgtattcattaaaagcaaatattgacataatatattttaccatatattcagtgatgaacagaacacatatggtccctgccttcattgatcttggagtcaagtagaataagaattaaaccagttttaaacatgctagtcatgcagaggatataggtgtttaaacatgctagtcacaggatataggtgtttaggggaggcagcaggaattgggataaaatattgaataactaaaggaagaacatgggggacatctttctttttctacttctgaaaagccaaaaaataaacttttatgaattttgatgttttagaaaatgtggccatgtgataagtccatattattttttcaaggaaattatatgcaagggtggacatccgtttaccagttttgacatctcttatatttttataataactgagtttgcctgatgtaattagggtacagggaaagaaagatgtgtaaaaaggtaggttatttaatatttttaaaagactaaattcttctcaggctttttttttattgttttcccagtttattgttggtttttttgtttgttttcagttgcctaatatttttgtgtctaatttaaaagctaaatcgtttgtctttataagtttattatttatttcttataccctttataaagtacagaatataccctttataaaatacagaaaactgcttgtttcattatgctttcatcttaaaaagaagacaccttgttatagctagtatatcattaaaactaaaagatgtctgaaaaacacatgggcatttattagatgtagtttggtatgattcttatcgtatttagggctattgacattttgaagccttgactatcaaataagcttttacctggttagctatcatactttaattagtttcatcaaatctggccttttatctttggtcacaattattaaaatcgttttaatttagcaattaaaatggtgcagtaatataggtatcagaagtactgccttttcttcatattgtactactatgattgcacaaatgtgtttcttaattatctggcataattttcacattgcatggaagctcgtaatttgcagaataaactaaatgttaaaaaaacagccatatccctgttgcagctaattggctggataatgtccaccattggccagcatattatactcacagtaaggtaatattacaaaaaatactccagattttacactgtatttcaacatgcagtattatatgcatgtataatatatattttatacagcttttgaaagaaatgatttttatagcattagtttttattcaactagtggtgacattagccaacttatactaaacattagctattgcatatctaagcataaatggatttataaaatttattcgagaaagcaaaccatgttgcataagggaagtaaacatgtggccctataaaccttaatgcattctttatttgaaaggcattgaaatagagagctctctcagtgaaagcaaagaatctctgtattttagaacactttacttctcgcaaacagggttgagataattggcatgtgaaagaggcattctttgtagaaaggcctgtagtaagtaatgttaactagctgaaaactaataccaaaagaaaataaactttatttttcaaacttttctggcagagcttttctgattctctttgtactaaagcattaatggattcaggttcttaacttgaagattgtacttttattagagtaattgataactgatggaacaactgcaagagagttgtgagtccacagtttctaaaacattctttttagagtaacttatctcttatggcaggtgtaaaggctgtacttaaaagttcaataaatgtccacaaaatttaaattttaaaagtatttctctctgagattttcctattttcattcttctagaaatctgtttaattttttcctctttattcttagctcatgagaagatataaaagctgtcctcccgttttgtctcagaactctgtagaaatagaaatgtagtttctattttatcaaccgcatctttttggagtggtctattttgttctgactgcaaagccagcagcatcctggctgctctcattgtctccaagtgtgtttgccataatctggggtccagcctttagcctggctggcacaaaacataaatgaggccacatctcagggcagcttgatattcaccaagatcacataatacatcatttaatttacagagagaaatctaactgtttgaaaaactggaatgttcatatctgcacaagggtttcttcttaataataccaagcattttacaatacttcccatataccaaagttctgttttacgtgcattagcaggtagcaccctgactggcacatttattttttgaatgttgagaatgaatgagcacattacttatttaactctgccaccacgagtgaagtaggtcagtcagctggtactgtaatgaatccttgttctgaatcacctctagctaaagaccttaggcgaataatgttttgttccttagaattattctctgtcaaatagagactagcagtaccatctccatgtggttgttgcgaggattatatggaaataatgcatttagaacatgcctcactttatagataaggaaagtgagccttaaagagacttaatacttgcccaaggtagcacagctggtaaatgatagtgctgggacttagaccaaggtcttttattctaggcacaagttctttacctctgttctattctggctttcaaatgccaatttagttatatgtcttaagagaagtggagaagccaagtatttgtgatctgaagctttgcagtaggaccagagcacctcacagccatttggcccatggacagtacttcccagaacatttcaaatgtttgcctcagctgctctactttactatgcgtctgttgcaaaccaacacattttcaactagcacatccgttctcctgataagataataatatatttataataatatatttaagtgatgttaaagtctcatgacttggggaccatctactttctgaagttgcctgtgcatgggtcactggccagaacctagtgcttgttttctctacttctccttcttgggcaaaactttactacatctcccacgaagtaacaaaacaccgtgcctgaattgtgaatagcaaaagacctttgaatgacttctttcagataagctcattagatgccagtgcctcagccattctccacggtcagatgaaggagttgtattacttctttccgtctgctttttattatgctgtcaagtggtactcaaattaactttttatctagggtaaaacatatgagacaatcaaatgtaatatttaatatgtttgtttgttttctcccttcactttgttacatgttatcatgcagagataacatgtaaatgtcattctagtatttgataaatgtataaatccatatgggcccagaattaagttccagtctgaatgcattcttccagcacttatcacgtatgcacaattatgtcctcagtaaatcctattaaacagttatatcctcatccatgtcaagagcaatctttgattagacatccaggcattatgactgcttcccttttagataataaattgatattattaaatttagatttattcctttttgtttttattttctgttattactttataaaattgatgtgtttttgtcacgataaaggggttgagccaaatcagattttatggctcttaattgcttccttggtaaatattaaaaaacaaaggcagggggagcaatatcctctgtaaggcatgagctgaatatgtgaccgtttcttgaaaaatcaatggaaagttcctaatctactgtaaagtctttcattttcacccagttagaattctgcttatagtcagcttctgcgactcaaccaaggagtcattaaacagacggaacacaacatcttagagaacaaaagtgcatggaatccaattagagtttggaagtgaaagtgacttataattaaacagaaaataaccaaataatgacagttattgggcatttgagtgtagtctgtccatttttaagacttcctatccaaagaatttggttatgttttatgacaagagaggtggagaaaaatttaggctcttctggccttccttaaaatccattgaacacttaaaatccgttacacccttaaaatccattacacaggagaaacttttttaaaaaaaattacattttaaaggctcttctgttgctttcaaagtgggttgtaagacagaatagccttatgccaaatatcacaccattcattgcaggctcttaatatatactgagattgtagtcaagttaaaaaaacatatggaagaaattcagaatatttgctttagagtgatttggagtgagtggctattatgtcccaattttatcacctatgggaaggataggtaatagagttaggatccatattagaaagatattctaaatattttagtttgtaatcttcaaaaagatgaatttttaccaggatttttttcacttgttgtcttgaatgtgtttctcttttgcccaaaatagtaacttatataggcatacatatggcttttttttttttttttttttttttttggtgagagaaagcaaacaatctctggattcacattgactgcactgaccctaagtagaagaacagtgcaggattcccaggtttatggctagttaaggagttcttccaatagctgtcaactctagaaatagagtaatctaattcttgatagaacagcagtcttcaggctggaatatttgtactgtcgcgattaccataagacatttcaagaggagttaaaaggaatccattttcacatcctcagccaccataagtcttattttcttaaaagtgatcagcctgagaaggcaccttggctggaggccttatcgcagcttctcctttcccgcctcctctttctcaaatgccctttttccattttaacagaaaggcacaggtctccttagacatagtcactatgaacatttccttgagctataaaaacctctggggcacacacaaaaagagacattggaaaacttagtgtctaggaagtctccttaatcaagggagcaatgtaatttccctcccctctttatcattaaagagatgcattccaataaaattttatttctgtgcattttaatatttatgaataattatcatatgttagtgctctctatctcagttaggaactaaagagttgataattgtgaactatctataataataattatattatttattccaaaggaatttttgaacacttaggacccatcacctcaggaaatttctaaaatttagttaaatctctaaatataacatataatgtagtgacaaaaatattttaaagtttagcatacctgtaacctcactggggagactgaggcggtaggatcacttgagcccaggagtcctagtccagcctgggccacatggagagatcctgtctaatttaaaacatgtatatattttaaagtttataatgcactggagtaaaattggggaaatttaaagtggaactcaatttcaaagaaaaaaagaataatataagatttctaaatatcaatgaggattttattcacggacttttctctaagtgaatgatagtgggactcaaattgctgtgatatttatatgccattggtaacagagtaatatagccatttcattttaatctcataatgtttacaacattatttacaactatttaaacatggaatgggaatagtattctttggggatattattttgtagctacatgactaaaaattataaaggctacaattttgaagccattccatcagagtaaacaattatccattgcttatggtgctttttttaaatctaggactcaagcgcctggtggtgtaggacaatgtactgaagcacttgtcacaattcatagccaacagcaaaactgggtggatatctaaagtaacttctgcataacatccctttgctgggatataagagctcaaggtttgttattgttaagttaggtcaggaaagaaaaagacaagataaggtttagggattacttcaactgttggacatgtattttcccaaagaagacagtctttatattcataattttcgtcatctgtaaaaagctataaagaccaattacacaagtttcttagaggtatctgaagtctgttctgtcttatgcattatatcttctatttcaaaggtgctgattttggatggacacaaaacccatttttatctttaatatagcacaacaaaagatactaattatctcaataccttatgcttcatttcatcaagaggttttattcaaattcagtaattgctctgtttggcaaaaaataaaatctgaaggaacattgaaactctgtttaataatattgacccatgataaaaattttactttcaagtagaataggaatgaactttgtcaagttttaacaaatttggaagtggtgagtggtaaaaaaaattttctcagaatttggattaaatgtttcaaaacatttgaagtctaccagcaaaatataattttaaagatatatctttccttttaaaacacacaaaaaattttagtataaatatactttttatatatatttcatttaaatacatatgctgtggatacacttgcattagttatacgtcctgtaaagaaagaagcctaaatgataacaaaaagctcatggccgatataatgatcaattgggaaaggtctgctagtgtttctatcaaataaaatacaactcaataacaataacaatttttaaaagcagctttttcacattctaacgtaaaaatatttcttttcagaagatatttaagtataattttttcaaactggtcgtttttatttcttacagttgtaaaaatgtgttgaaactaataagaatctgttggattagacttttaaaacaaaatcccgccagttcagttttcttctggatttggtggagaagagagatggggagaatgtaactccagtgagaagtcttcattgcctttttcagcaagctcatgcatcctcccctgttacataaaggaagggcagggcaggacatagagacttctctccccaaagctgctatttttctttccccacaaaaccaaatttcttccaagtatagtttcattttttgacattttattacaaaatattttaaacatacaggaaagtttgaagaactgtatagtttatacttagatactcatcacttaactttctatagctaataattgactatatttgctttatcacatgtctgtctctactcattcagcaatctaaccatttctttcttttttggtatctggcaaagtaagttttatttaactctgttgcatacatgctaatatctaaacttcttgtttgcatgtactactatgctaaagcctttacaggttagaccaggcatttcctgcttctttcccaccctaccatcttccgcgtttactcaaacttcattcacatcaaacttcttacccatcatctgaccataatgtggagttttgctgcctttacacatttaaaaaatctctatggagaatgtcattcttctttctttttggcgtttatttatccttcaagatccttgactgtcaccatttcactgaaaagtttttcttgtacctgcaagcagtttgcacctgtcctcccagggaaaatggccccggtttgtagcatttgcagattttcatggtataaatgtttcccctacagctgatttgaagctaccaacattactgaccatggagttaagaaggaatacactcaatatcctcttaccagctgacagaagccagctccagtgtaccactgctactttcaatataatatttgtcacggtctattgttgttgttcatgtgatctctgaaagcagaggcaatgcctcattcatatttctattgctagcacatggcaggctgtatagtaaaggagtcacaagaatatttgatgaaggaatgatttggatggtaatttgtactctacataacactttctgcacactactaattcaggtgtaactgaagaattcacagtagtagctccacagtggtaactgagctggaagtcagagccaacatctgttatgtgtggcagataccccaggtggtaagaatctctcttcagccaagcacttgcccccactatctgtggtgcaaatgcctttttccagttcctttctaaggctgaaatctaccctgtggcgttgcaacagtcacttagaaggccatttgccatagatatcttaaaacttcatgagaagttagcaaggtgctaagttaagggcaagaaggatatgtattaaaagcaaatctttaaagatccccttggtctgtgtactagcctcccccatgttgaggaaaaattgagttttcagggttgcttagattctggaaatagtaacatgataccctaggcataaaagaagatcagaacttaaaaaggtgaaaggagaggccaaaaaaagaagtgattattatttgaaacaaaatgaaattttacttaaaattactattttttctaacatatgaaatactacctttcagttttggacttccaagttgaaataagtgattatatgtttttttaagtggaaagaaatcaccacagttttcatttaaaaggtattttatgtgtcttcattatttaatatactgaattttaatttgagctactgtggtacattttcacaacttaaacagaacagtaccaagaatgtttaatatgacattatctttgcatgttgcaggtagtaaaattctgaaaaacatgtacttattcttgatctttctgtttaattatggactgtgaggatttggaatgaaataagtttttgaaaaagagttttaatgatctctggaaaataccgaaaacctggaatagcaatactaagtatagtataccagaacatttacatctgaacttaattctctcctgctgttgttcagctcctttacactgaattacacatcaatccacatattttatttcagtattataaatctttgtgagattatatatgtgtggttagagctaattttgattttgattatatggaaaagattgaaggtacttttcaggataaaacatttagagaatagtttaatgtctcttcttactgtccatggtcaggttattttactttttgtgtaaatatatttcagttttataagagggataataaaactccttatctgggttattgagaaatttttttttttgacatggagtttcactcttgttgcccaggctggagtgcaatggcacaatctcggctcaccgcaacctctgcctcccaggttcaaccgattctcctgccttagcctcctgagtagctgggaatacaggcatgtgccaccacacccagctaatttttttgtatttttagtagagacggggtttcaccacgttagccaggatggtctcgatctcccaacctcgtgatccgcccacctcagtctcccaaagtgctgggattacaggcgtgagccactgcgcccggccgagaaatttgaaaaggagagtttttttttttttttaattaagaaaagtgctagagtgtgttgtgattcactatttatggggagcacaactacatatacataaagtagaatatcttttatatgctctctaatcattcattttatctgaaaatataaggaatagtatactcactgtgagaatgttcattttacatttaaaatttagtatgtatttgagcatttttctgatcatcagcttataccaagctaagaagcacagctttacataatttatttccctccttttccagcatagtttcttacttttcattgctgtagttatgatttttacaagttttttatcagaaatcttctgtgagattattcttcatatatattttttacttatttgattttatatgttcctcctctcacctcacttaaatacatgaagttttatttttagacgtcttagccactcctatgctgcttttcttgttgtgcttctaaatatagtgaccagttttggagctctcccagtttccattctttgtgttcattgaattgatttcatgatctggccatattgtttattggagagagccagaatattttcccttactcagcacatcatgacccctgagttcacaggtcagttgaggtagggaattttaaacatagagtagtaataggacaatgttagactgaaagcatcattgaatggaataactgaaatatatatatacatgtataggaagaccaccctaaggggactatttgccatcccactttaaaaaaaaaaaaaaaaaaagaaaaagtcttttcatggtctcttgttcattaatcatctaaaatccaagcacagagaattcaattttagatggtctccagagcagaatttgatgtataatcttaattacaaatcatagataattaatattgtttacaaaatcagaatacgattagaggtagggatcctgcacacaccctattttcctccccagtgttctgaccgagagactaattaataattcaaggaacttacagtgaatgagaacccatggttttgcttaattatcagaacagctagatctgagaacagctgtctcccacatggatagacacttattccacccatttgcaggtagaatagctggcaataataagtccttcccattggatatgttgaaaggtgcctgccatggcatagttgccacaagagaggaagaaatggacacaaatgtaggctgttttcagggcagagggaaggtgggaggaaaccagcttgctggttttcacacaccctctggggaacacccatgcacctatgagatgggtttgtgttagcatcacctctgaaagattacccacccaggcaaagaaagtgacccatatgttttcactttcttggagtggagggcaaaaaaaaaaaaaaaaaaaagcaaagaccttttttctagccatttcaaaattgtgtgtgttgtacaagttttctttctcatggaaatgttggcatattaattgatccacacaatcaaatagattagaaatggtgttcataaaagccctctaagggaaacagtagaaatctttttttcaaaacccttctgtgaaagcttgctgttaccacaaattataataaaagaccaaaacacataccagttatcatctatagactaccgtccctgagcaaattacttgactcaaactgttcatttggattaggaacatttctgttattatttgaaaagaatattctgttgtatatctattagaggcagtagaattagacgatctgcttgtgttaatgctttctataaaatcccacataatgaataaaaaggatagcttatccattttaccttggattataaaaatcttgaccaggtgcggtggctcacacttgtaatcccagcactttgggaggctgaggcaggcaggtcatttgaggtcaggagcttgagaccagcctgaccaacctggtgaagcctgtctctactaaaaatacaaaaaaagttagctgggcctggtggcacatgcctgtgccagctacttgggaggctgaggcaggaaaatcacttgaacctgggaggcagaggttgcagtgagccgaaatcgcaccactacactccagcctgggtgacagagcgagactctgtctcaaaaaaaaaaaaaaaaaaaaaaatttgtgaggtattttttctgttttatacttcttccaatgtacctcgggaattaaaagaaaaaataaaatgggctcattgaagtattactttaaaacattattttaaaataatatgtttatttgtaacaataatctatgtaattaatttttttaatttagaaaatgtaacaagtggtaagacttacccagaaaaaccatgcataactttcaaaaatagtactaaaatgcaaaccatggtgccattgtctcttactaaatccaatttagcagttctctactcttttctctagaactcatgaaccaaccagaagatgaaagagtatcaagtactcaaacaatcatcatcaaataattatgaatgatgttgcaaggcagatagggaattaagagacttcttagtttaatcacatcaaaggagaacttttggaaaagcagtttcctaaagtagttttcccagcatggagactgcaaatgaatagaagatggtgataaggtacttaactcttcctcccaatgcgtggtctctgtataaatagaaaagaaggggaaagtcaattggaagaggaggataggaacctacccctctctgctcagtgattttccagttagcttcttactcacctcccctctggatatctcgaaagtttttctttggcactatggggacctctcaaaaatcacatcctagtattggtggccaaaagcttaaattttcaaatttgatttacagataaatcctcttaagggggaaaaaaaaaaaatactgattttgcttactggagtctgttgtatgtgtaaatgtgtaaaatcaattacaattagataaaaaattactgaccactgaactctgtttgaaaatacaggtgcaacagctgcagcccggaaagaggtgataaggaacaagatccgagcaataggcaaaatggccagagtgttctcagtgctcaggtgggtgcattcgtactctgtttttgtttcaaattgtattatgtgtcacctaataaatactttaatactttcatctggtaatttaaatattttactagagaatatttgtctttttttccttttagattaaaaattgaggaaaattaaatgagaaattgtcagtttctcactattttagttaaattgcaatctactaaattatttctgttaagaaagtctcgaattgcatcacattttattcctctatttgctataggactttaaaacattgatttcacggtaggttgaatatcttaggaaacaggaaaagctattgtaattttttttgttttgtttttcgttctggctcgtggtgaaagatgtatttatcagacacatttcactagatttctaggaaatgaacatcagccataaagctgttcatgtgaatctatgttattctaattattgagagaaaaattactgtttcaatttccatatagtagtatattttgtagattatgaatcatattattattattaagcattaatttagaaaacaaatattttcttgaaggaaactccagttatttctaaataatacaatgtaacatttctcttcaaaagattactttaaaatatgatatatttatatgtaaggagtctacagtcaattcaaaatgatacatattagcgagtaaataggaacaccttgggaaatattacatctacaattggataatttaataatcaaattttttgccaaatttttgccccaactctttctcatagagtatcgacactggctcttttgatttctcctcttgctatttctatcctcttcctggtacagtcactaaagagtaactgaatgacttaatgccaaaagaggtagccatgagaaggatgaaaagcattatcatgctctctcagagacaccacatcaaaggcagtgagaactctgtggtagccagcacattcacgaccagccatgttcaagcggaaaatagggcatcattgctcccttccgttattgaatgaggctacctttgctctattgctgtacgtttccaactacattttcagggcttattcattcatgccataagtaaatatagtgaaacttaaagcattgattatgtaccatggagaaaagaaataaggcaatgtagagatggagcaagtgggagataaagaacttcttttagtgtgtggtcaacaaaaaactttctgagtaatggtatttgggcaagcataggtgaccttcatgaagaaatgaggtaagggagttcaaggcaaagacaatagcaagtgcaaagatacttaagtaaagacaaaactggcagttttgaggaccacaaggaggcctgtatggctagaaaaatgttctgtggggacaaaggcgtatatgaaggtcataagcttaattggaattctgagtaaacacttgtttatttattgtgcctcagatttaccaataatgcttttatttcttattctgtctgaagtctctgagggaaagtaaaaacagctctagaatttccatgactatcccgtgataaatggactatttgaacccagtgatgagtgacttgacttaaaattgcacatgttaatagaaaataaaagcaagctctatattattgtttttctataataaaagcatccataacacatatgcagaatatagagagatcctatccagaaaaaagtaagttaagcttagtaaataatgattgagcattaactgtataccatgcactgaattaggcaatctagataccaaattggaatgccagccagatagacaataaactaacaaaagaaaataaagtggccgggcgtggtggctcacgcctgtaatcccagcactttgggaggccgaggtaggcagatcacaaggtcagaagttcgagaccagcctgagcaacatggagaaaccctgtctctactaaaaatacgaaaattagccgggcatggtgacacgtgcctgtaatcccagctactcaggaggctgaggcaggagaatctctcaaacccaggaggcggaggttgcagtaagccgagatcgcgccactgcactccagcctgggtgacagagcaagactccatctcaaaaaaaaaaaaagaaaaaaaaagtgtgtgctaaataactacatgaatagataccctgctgtggcattagacaggaaggaaccttgtgtttcctgactggagtgttcataaagaggttaaaattggaggagtgctgtgaaggataggctggattccagggcagggagagatgtggtgaaggcattcctggaagtggaaaaattatcaggagcacagccacacaatcctaagagcactatcaatggcatccttttatggggcacttgctaagtgccaggttcatgccccatgttatgcacatttgacaatcatcgacacaggaagcttgcaaggttgtggtgacttcactttgctgtgaggaaattgaatctgagagaggctaagcagagtgtccaaactccctcagttggggagcaacactaatgagagtcttactcaaaactgtgctatgtagtctagtataaattcttagcaatactagtagtctagtaatgaattctaaatgtattaaaggactgactagcaaaagacatgaaggtgagtgaggaatctagtttaaaaggagactgaaaatatactgaagtccatatccttgagtgttttgaatagcatgttaaaacatttaatttttgtgtgtgtaggcaatcaggagttgtagaattattttcgtgagattagaggcatgctctaacccatgtttcactatacatgttaattgcaacgtgaagattggctagcaaggtgacgtatggataatgaaaaaagtgaataaatataaaataaaatgtaaattaaaaaaaaaaaccatttaggaagcttttgaagtaatcccagcaaaaggctggaccaggctatggggagagaagtgcaaaggaaaggacaaatacaaggaatttgggaaaacaggacgtgattaatgaatgtggaatgtggtacaaatttgtcaggtatacttgcccaacatgtttcttacgttttggaaatgtgcaaccttataagggaaccagaaaactgtctttcagcagtccttgcagataaaatacaagtctgttgcctagggtttgccagtcagataaatgcatgtaagcaaggctttgtttcaaattgagcatcatgaggaagcagcaaggcaggacaacaattgtcctgtcaggtgtggaatctcatgggccagcagtggaagagcttccacctcagcattttgggagctaactacacagcattagtatgagctctggcattggctgtgaacatcagtggcaagcctttcatggagcccaccccacagtatgaacaagtactgttacccttcccagctacagagcatcgaagcccagttctctggatctgtgagctctctaatacctttaatatatctctttcctgttaaaattagccagaatagatttccggtgttggctgtgagaacccttacctatatgagaggctacaagagagaggaagtattccagaatattctacaggggttccagtctatgccattgataggatgccattgtctaaagaagaggaagtacttttcaatttaaatacctaacaggtatttatcgggaagagtaggatgcactgaatttggcagagcatttatgtagaggcacttagaaattctgccctggaggttcagagagaggcgagggttagaaatgtggacataaggctgggtgcggtggctcacgcctgtaatcccaacactttgggaggccaaggcgggtggatcatgaggtcaggagatcgagaccatcctggctaacatggtgaaaccccatctctactgaaaatacaaaaaaattagctgggcgtggtggcaggtgcctgtagtcccagctactcaggaggctgaggcaggagactgccataaaccccggaggcggggcttgcagtgagccgagattgcgccactgcactccagcctgggcagcagagcaagactccatctcaaaaaaaaaaaagaaagaaagaaaaagaaatgtagacgagagtaaacaacacagagacaagagtacagcaatgtaagctgatggtcttgctaaaggatagcgtgaaaagtgagaggagaaaaataaagaattcttcagaacattgctttccaatagaaataaaatgtgagccacatctgtcattttaaattttctagacaccacagtaaaaggggtagaaacagaaactaaagaaattattataatacagtctgtttaacacaagtctccaaaattttatcactttgacatttgatcaatataacacttattaaagggacattttctattcttatatttgtactacatctttgaaatcccatgtgtattttacacttacagcacatcttaattcgactagtcatgtctcaggtggttaacagccacatgtaactggggcctacatattagaaagcacggatctggagatagaagaaaaagatcagcctaggaactgaaaagatgtcagagaaggagaaggagaagcaggagaaaaaagcattacaacacctagggcaaagagtctttcaggacggagggcatggtcatcagaggaaattactgcagagatatcagtttgaatgagaattcagcagagatagttggaattgaaaaatgaagaagctgctagaaacctttgagggcatggcttccgtgtgaggcaggaatggcagtcacaattaagggaagtaaggaatgtggttgaacaagaaagaaaaaaagagcaaggaaggaaggaaaatgaccatcttctatgctggggcttttgtaacagtgtatcatttaatcttcatggaaatcccataattacagttgtgattttatagataaggaaactgaagcccaagaaagttaaatgatgtcccaacatcagtcttatgactgagatgttagcctgagtgtgacccccacaaagatgtgatttcccaaaaagatcttcctactgttggtacaaaattaaaattttgaagattaaaaagaatacttcagattaccagaagagttttgtaggtaaaaagctaataatttacttggctttctcagagcattatgggttgtaattgttttttttgatgagtcccatgtttttgggggggttttgtttttttgttttgttttgttttaagacggtctcgctcttgcgctctggctggagtgcagtggcacgatctctgctcactgcaacctccacctcctgggttcgagcaattctcatgtctcagcctcccaagtagctgggattacaggagcatgccatcacacccggctaatttttatatattttttagtagagacgaggtttcaccatgttggccaggctggtctcaaactcctggtctcaagtgatctgcccacctctgcctcccaaagtgctggaattacaggtatgagccacggtgcccagcctgaatcccatatttaatacaggatttgacaccaagattttgtatgtaggaattataatcactcatgaggcaaaagccatattttgaatatgaatgtaaaagaaaattgtgttcgttctttagaggtactcccaattttcccaactcatattatcattcaatgtatttcttcatgggacctctagtggtttgacagaccacagaagcttaaaaagtttgaaatacatgcatgaaaataaacaataattaattatctcaaacctattatttttaagtaaactttgcagtagaggatacagaaatctaaaatatggattaacatttccattctccattcaacttttactgttttatttttggcaaatatttttgaaatgtgagctatgtaccaggtactgttctagtctgggtgctgtggatgcagcagtgattaaagcagacaataacccctgctctcatgaggcttgtctagctgggggagggggtgggggcatggcaggaggggaatggagtggacaggagaccagaaataagcaagtaaacacactgtatcgtttttcaagggtgataagtgccttagataaaaataaaataggcaaagggagaaagagtagagaaagggattattattattttaaatggcattcctaaggaagttcttgcttagaaggcgatattggagcaaagattagaaggcagagtgggagtgagccacacagatgccagggcaggaggatgacaaagaaagtgcagcgcccctcagtggagtgtgctgggtatgtctaaggaaagtggacattggtaggaaatgttgaccaagagatgggtgcgaacaggagagtgtggggtagctgtttattttaaggcctttgtgaaacctccctttcacccatcaggagaggagaagccattagagagttctgaatacacaagtgacaggatttggcataggtatgaaaagcctcaccctggctgccatactgagaacagctgtgggaggagggggcaagagtgtgactcggatggagcagagagaccattcggaaggctcctgcaatccaggtaggtgatgctggtggtgagcaaaagaaggaagtcacagaaggctgtattttgtattattttatttatatgaaatgtccaagagaaacaaatctacagaaagtgactagaagtgatacagggctgaaggaaatagggagtgactgcttaatgggtatgaagtttcttttgggggtaatgagaatgttctaaaattgattatggtgatggttgtacaactctgtgaatatattcaagaccattgattgaatcctaacactttaggttaattctgtgccaagtttatatctcaaaaaagctgttatcaaaagagatgcagtagtagccttgtgagaatggttaaactagaaatattttgagagtagagccctcaatttttgctgatataatggatatagaattaggatgaaaagagttaaagagtgatcccttactcttaagtaactaaaagatggaactgctaatttctgagttgaagacagattgtggaagcagcaggttatggggagaagttcaggaattctgtttgagtcacgtgagacaccttcgtaaaaatttggagtagataattctacatactaaactctctccctgtgtgtgtgtgtgtgtgtgtgtgtgtgtgtgtgtgtttgtgtgtgtgtgtgtgtctctatgtatgtatatatacacgcaaatatatgtatgtttgtgtatatgtgtatatatacaatttgtattttaaagacttttttctggttatgtaggattgcaatattgctatgtggaaagagtgagtggttatttagtcatggttatttaattatgaggatttaacaattcaaaatgattaatagtgtcaagtaattaataaatataattaaaataatgatgtacttaaaactgattgattgtaaaacaattgtcatgctgagtaagaaaataattttatattagcaaatcagtggggaaagtgactgaaaaaaaaaatctgggaaattttaccagtaggtttattggctgcttgccattattttatgtgtttttcatgtaacatctaaattactaaatgccttaatttctcaaagtccactgaatgtaattcctgattccctaatccacaaatcagattttttttcaatctccatatgctctgtttttttattccgtcaaatcaaatcacttccccttatttttgctgagccttggctgaaaaacttaacatcagcattctctatggctcacttttaacatacagaatgcacaacaaacactttgtattgagatgcctgattacaaaatcaaaatggttttctttatctatctagcttcgatactcaaaagaaacagaacctccctaattggataatgtaaactttatggtagcaatcgtttatggaacattactggtatataaataaattaaaataaagtatgttaaaaaaaattttaaaaaaagatccggagagccaagatagagggaaatgtgggtgcttatatgcattttttttcctttcagtcatttctttctttttcacaaaagaaattaaaagttaatgtcgcccctcattgtgccttccagagaagagagtgagagtgtgctgacgctgaaaggcttgaccccaactggcatgctccccagcggagtactttctggagggaagcaaaccctgcaaagcggtaagcaggctgatgggtatgactgtgtgctggggcatcgcagtcagctgtgtcattagagccctgatttattcattcatttaagctctgtcttggtcttcggttcttcttctcagctggcagaagggctgaaaccccaatcagtttgatcagtcatgtccaacataatagctccctcattctctggaatgtggtctttactccacctttcccccattccctcattcacatgttaatctacatattcagcctagctacaggacaactcatttaggttgcctacatgcacaataggtttgactactttgagccactccgttgtcaaaaacaactttttaatcacatttttaataagtattctggttatgtttcatttatgagataacacatacacacataaccactaaaatatacctgtatgtctagattttcaggagatgatttcattatcctcttgaatggaaattggaagccatttgtgtcttttctctgatttatcaattgaaaacaagagactgaatagaaccacattttatttttgaaaaaagagtaacatttcctttataatacagattttgtgttaaaatgtgtagctttctagaccttagacctgtgccgtccagcagagctctttgtgatggtggaaatttctgtatctatacagaagccgcatatgactgttgagcatatagggaatataaccaagaaactaaacgttttcttttatctaatttatattaaatttaattaaaataagccaggaggctagtggctaccatgttagcagcacagtcctatatattctttcacttttgttacatttgttatcaattttaactactattattattacatacaatacaattttaacaataggagattgctattagatgaggctttaacagaaaaaaattaaaatgaaaatatgctataacatttttcaaaacattctcggcctcttgcttattttcctgtatctttctttgaatcttttttgtattttcttttctgtccctgcccttcaacctagaagactcactattctcatttatattattcaataaacttctacatgaagagtaatgatcaacttcatgaatatagtattgctgaatgatcacatcatggctgcatcacattaattgtctttattttcagatgaatatattccgaatcagtgtcttttgagtttttacaaaaagacaaaaatttttaaatgaaggtaggaagatacatagtattgagaagtaaacgtcccctttaaatttacagctaggaattattttaacaactttaaaaaaaaaacacacacaaaagtttttctaccaaattaaatatcttactaaaacattagcataaatggatcatttacatgtccaaaatgtaccatctacctaactgactgaaatctagtttctgataagcacattttaaggcacagcaagtgtattatcagaaactgtgggctttagaacacatttaatagtgttcatttaacattcgctttagaacatttaatagtgggcagtacatagttctaatatgtcagtgctggtgtgattctggatgttttgctttacttttaaacttacgttacttaagtttttccagttctttgtttcatttccagattttcacttgtgtttttacttaggttatttggttttattttattttaaatccattggtttgtgtttttctatggttcaacctacacacaaacacacatacacataaaagacatatgggttggaacctttctatatgggtttgaaaacttactatatattttaaaccacatacattgatacgactccaaaatgtattgcctgatgcccttcaatttgtctaaaagggtagactacttacaactttgctatgtactctctctctccatggtgataaccattctccatttttatcataaggaatctcgaatccaccgtaagtaagttatagtgcacattttgcagttgctgtagttttaaaatcttgaattataagaaaaatgcaaattaaagtcaaggggtagaattttaatattaaacattttggagttacagagaagttttgcattttaagatttcattagggaagtataaactaatcttaataacatagaaagactcatatacttatatagtggaagtttagaccctaaccttattacaaaaattgctgataaagcagtgggcttttcaagttctgcctctgaaatatgctgtttctgtatattcagtatttaggctgcctattctttaaaatgctgatagaattattgccactactggcacgttaccacttgatttgtaacattttaagaattttacttccaaaaaggatattccactaaggaaaagaaaacataattgggcttgctggaaaacgaagtccagattatatcattcgtttccttttttccttttccttcaccctcttcctacccaccgacccccagatctagtaatgcctgatgtgtttatctttaaagagtcacatccattatctccttagacaccctgacttttatttttcctttaaatttgaatctccctgtttttccatcacatcaggaaatagtgctgtttaatattaaatagtgtgaatgatcccactgatattgtggcactgcttcaaattctgccattttgtctggcattttaaaactaaatcaccaagcatagcagaggttatatagtattctgtgtgagtcagaagcacagttgagatttacataatctcttataattcagtccatgtaaaagaaattttcctaagtgttttcctaaagggttgtttgttatttatttagtgggcaaaaaccaaaacatttaattcagataggcgtacccagctcataaattaaatttataatttctgtggcattttttttctttttttttttttttttttttttttagcatttctgttttgttgtctgtgccagaatctagcacttacaggaacattagttctcttagctcctttgatggtcactgatttgttcttagagttaaaaaatcctctgctcatttttctcattcattttgcaccccctttcttctcttcagctactgttgaggctattgaggctgatgaaggtaaattggccagtcccctttctgttgtacctgcaacagataagggctctgctgggtgtattcatttttttgctgtagcttgtacagagtgtgtgggtgttgagctaacagttgtggctcagtattaaccaaaatgttcttgctttaaaggggaaaatgtccttctatggtttgtttgtttgtttctttcccttaaagctatgtttgacttttgtatatgatgaatactataatcacagaaaacaaaaggattatatattttgaatgatgtggggtgggggttatggcagctgttttgaccagtagcttataaaacaataatctttgagctgaaccatgtccctccctcaaatcactttcaggcagcactgaagagaataaaaatagccatcttaattctagtcttcagaagtttgtagccaaaggaaaaaaatgttcatttaaatagtgctttgttgtagttcaacattaatttgtatctctaaaaaatattccaacatgagacagctgtatataagatgaacagttctggtaatcttaaatcaaattgtaacctactggtatttgtatgagaattaacaccagcaaaatattataaaaagttcaaaagcatctagtggctgtggaagtggccgataacaagaatagcgagtatcaagtagcactcaattgatgaatgtgtactgagtgtctgctttgtgccaggcactgtactaggagctgcaggggacatcaagaagtgtccatctccagctgtgttctagcactgctcaaggacagtagagtcgaacctttagtatttgctttttacttgactgttgtttaaatatatagttataagagaactgcatatcaaaatagtttttaatatttattatacataccatatcctttggaaatttcaaaaataataatttgaagttcccctttaaaacaaaattcttcagttgtattttgttcttgcaaggtaacttttttgtttttctcaaaattatgtgcatatggtcctttggtgtgatacaaaaagtgccactttagactcttccaatttgtacatgatttggatatggtaggggaaacaatagcactgtaagagaaaatacaactgcttcctaaatagcagtgaataaactgctatttatgtgggaattctctattcctcttggcaaattctaatctgcagtgtgcattcttgttgatagtttggctgttttctgtggtttctgtgactctgtgttgtgttaagtatactaccaatgtaaattgctaatacccattgtctgaccagcaactacagcagagcacattcttccataccaggatgacaaaaatgattagaaatggagccccattccagaagtatccattgttctagctacatttttaacactcccaccctattggcttttaaaacctagaaatttcacttttaccatttaaattaattaaatcatttcataaatgataatgatgacaaacttttatacctgttaattatgatgaaattatattcacagtagtctaaaaaagacagtagagtaccacttcatgctattcttttgtatttcaaaataattgagttagttttcagggtgggtgctcattagacagctctattattttgcaatttattactaaattagagaagaattaacaagctttgctttgggccttggtctttccccattttcgcatcttattcctctcacagttgactaatcaccattatgctaacctttaaaatgcagaggggggaaaaactatttctcatcttttaatgagtattgaaacaactgtgtatatcttttaggaatctcatccatactaataaaaggcactgcacatttgtgtaggagtggctggtaaagtttcagcttgaaactgctttcctttttttttttttcccccccaaataaggttgggaggataaaggtaccatgaaattatccttaatcagccatggtgatgcagcccaattgagcattggtgattggccctgaaatatctggcttgcacttcacagggagtaaagcaaactgatgtcattggttccccatttatgtgttttatttgcagctcaccagttggtgtactcactgaagaaatcattaagttttttgtacaaatgccttacctatcgctgtagcacaccaaagattactttttaaaaaaatcaaatatcattcccactttgagaattccatgttttaattgaataggaccaaaaccagttcaatgcatttttgctaaatattgtgaaaggcatttttttccttgttattatttaaccatcacttacatctacattgatctactgagtttttctttcatttaggcagtaatggataccagatgaacatcagtttgacctgttcactgctgaagggcagacgatacatttctacctagtgaccttatcttgatttttttttttagtttctcttaccttgtcactcactccacatgcttccaaagttaagtggagacaggagtttataatttctttttttttcatgtcatcattgagttgcttgtcaagaagttctttctgggattctgagatggcatggaaatgccccggttaattccttttctagctccttttagctcctgctttaagccctttgctaggtttttaggtatagcaaacatactgattccactgaatttgccattacctagtacaatggaggaatacaaagagggacatgctgcagcctgtctaggttaaggtgtttgatgcttatgatgtggccagttgatgctggttctagaggcttgtccctgaaagcagctttcctctttatgtgtccactttggatttctttgagctaaactttcatgaagacaggagaaatgcttacatcttaataacttcaagaggacattttggttggcaagagacattggctgttttcaaacctttggttacttccgagtatggtaaggagtctgttgtgtggtgtgcaggtcccgtcactttgttcttcactgaaggattccctctcactgagaaatctctaacatcacctgctgcaacagctgtgccctttgttttcctttggataatcctggttttctttttttaatgattttctgtttagctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtgaccacttcctgttcactttttttttttttttttttttttttttttgagctgcggggcatgatggggattgctgcatatcagcagttggatgttcttgcctctgacagtagcttatttgctctgggggccaggaattggattcagtttacactatcattaaaaaagagggagagagataataaactatattttggtggggatggtgattaaacacctcttttgggtatgccttttaaaaatgcttatagagaaaaaaaattttaaaaagaaagctaatgctagtatatactgcaatgttaggggaatgaacatgttttcctactgcattggggacttctagataggttaatgaaaggccttttattctgttactggacatgaaaactttgtctaatttcttactctattgtacgtttacagtcgcagcactaaaaatggatgacatcaaacatttttaacaaaatgatgtacaaactaaggactatttattgataatgttttgctactcttgtcagacaatggctataaactgaattaggcagtcttaaaaaaaaaaaaaaacagaaaaagaaaaaaaagaacgttgcaaatttgttaaaatgccaaaaaggacagtttaattttgtacagattatgcttacctcaggtttctttagtgtgcttgaatgcccttctttccatataacacttatcttcttcttaattcggcaatggaatatcttttaagttttaaaaaaactggaataattatatctatcttttttgccgtttatatttaggggtttttgttgataaaatcaagtcttggttgtggcttgctgaattaaatatttatgagtggtgcatttttaagtatagtgaacaagacaccatattaagtacagtgataaagcatctatattctgtaaaaaaaaaaaaaatctgcctatgcatgttttttaagaaaaaaaaaatggctgtatcggcctgtatgggactgtaatgcgcttagtggtctgacatatactggaaatgtatgtatactggcgtactttatattctctaaaatgcttaatgcctttgaaattttgtaatcaaaaaaaagctttgaaaaaatctaaaggggagagtattctttaaagtttttaacataagcttgtcaatgcacatgtagatggttagcatgtttagcaaaccttgtgaaattataataagtttgtagttacatgtgaaactctaaatgcatggcaactgttaatgtcataacagtttagttattttgttctgttctgtcatgtgccacaaaatatgtacttttttcacttttttccctttgtatatcagttacgggttacaactggttcattctgaaaacaacaacaacaaaagtccattcatattttttaacaattgtataagtgcccaagtaattcactacagcctaaagccttgcctttgtaatttgacttctgacatgttggcaatcaaagcatgcacttgtaacaatgaaaaagaaaaagcattttatattactactcaataaaatgtgcatgaacttacagaattctcatccttccactgagtccgctgaagggatttatgtgcacaaccaccatgtgtcttctaggtgctggcccaccaccacacatcacaggctgatttccacaggcttcttcctaggggcctcgtgatctgaggggtggtgcctacttccactgtaagaaagaatcttggtggatttgtgtctcaaatcagataagagaagcctgtttaaagagcagatgccatcttctggcttcctcaaggagccagttaaaaaaccagagcattcctttttattgaaaaataaaattaatttgttatcaggttgtttcagttgtattggatgccctatctatctgctaaagcaaaaagtactaggctactaagtgcattttcatcacagaaaagagttgcatttgtattaacaagaaatttgtatacccacgcttcagctactatctaatcatcacccgaagatttaagatacaccaaatttcagtttgtttgtaacattgttcatctttagtgcactttgttttatataataaagtatgcctgttatattaaataataagaatatggcaattagcgatatagcatacccaaacaaagatgttctcgatacagtctggcaaagactatcccaaggttattttaatgaattcagacattttttcctgtggatatttctccatcctaaaaaaagtggcaaccaaggaaaatatttagatgcaacttactagagtgatgatgtgaaagaaatggtgattctggtatcatggtgtttattttctttcttataactgcagagaaaatatcctgactaaaaaaaattcatttttttggattcctttcttttacaaattgtgctgaggcaactatggcatagaaataaacatttgacattaaaataag

SEQ ID NO: 36163 - DNA, 59196 bp, Homo sapiens
gggaaagagggtccgccatgttccccggcggcgccgccgcttggctctggtagccgccgcccccgcccccaaccccgcccggcccagagcctagccgagccccgggcccagcatggccgccccggagccggcccgggctgcaccgcccccacccccgcccccgccgccccctcccggggctgaccgcgtcgtcaaaggtgagaggtggacgaaaccctgggggcctggcctgaagagctagctgtgtgtgagggcgggcgggagaccgtcccctcgggagtgggcccggaagggcgggcgagtgactggctgcctcccttggggagtggcccctgggcgggcccctgctgggcagggctgagtcggtggcagtggttccgcggtctcccggttgctttcaggccggggcggaggttttgcttccgtggcttcctagcccaaggggtgaggctgttagctgcagtgagcccgttttctcttcactcggcctgtcaaagcggcgcaggggccgcgattagcttcctgccccgcgacagctgcacttctggcttgccggggcgaaccgaggggctcggagaccttcagccacgcgaggcccgccagtgagcagtcagaaatcacctcggctttggcccacgcctgctccccggtgacagtcgtccgccctatccgcgtctagctggcgacaaccgcaggggttcacttttggccgtcaggtgccacccggagcagaaattaggggaaccttgtgggattggatcacggtgaagggtcggggcaggaattggaaggccagcctttatagtgcagaaagggagaaaaagcagcataaacgaaaaaaaaaattcttgtggatagcaagtatttacttagaaaaccatcaacactttggtcaaaaggagttacccctcccttacaaacacacacccacacattcatcctagacgaaaaagttaaatgtttctcagccagggcagaatttatggatgtttacccacaacaggtcagcagattaatttaaaatagagaaattgagggctaattgagagttgcttaagattccaagcttcctgggagagcctaccaacctcaaacactgctgtggaggtgaaaaacaattgaaatgattctctttaccatgtagcttgattgataaattgaaatcgtagaatgaacttttccttatttgtattgtatttatttttaaaatataggtacttttgttttcattcagcttctcaaatacactggcacagtatttaaacaccgttagcctactttttgaaatctgactcatatgtttccattaaaatatttaaaaacaaggaaaccttttttcttttttttttttaattaaaaattttcaacctgagccttcttcggttcttaaaagaataatactaatttggcctggcgtggtggctcacatctgtaatcccagcactttcggatgctgaggcaggcggatcgcttgaactcaggagttggagaccagcctgggcaacatggcgaaaccttttctctaccaaaaatacaaaaaataaaaattagccgggcatggtggcgcgcccctgtagtcccagcggatcgggaggctgaggcacgagaatcactggagcccgagaggcagaagttgcagtgagccgagatttgcgccagtgtgctccaacctggacgacagagccagaccctgtctccaaaaacaaaaacaaaaacaaaaacaaaacactgatttgcacctaggcttaagttagtagtatatccagttgggccaggcattggaatgagctgaataacgagtttatggaatccttaatacagagaaatcttaaaaaaaaaatagtaatgcagacattcattctatcaagaaatcctggagttttgtgggggtgggaacgggacattggctacctcttcattttctgactgtatttctgtgttgtgtgttcatttccctgggcacttttcaccagactgttagatggggtaaccaatcacattcctgaacaatgagtttatgctatccttacgtttgtgaatcttcttattccttgtcatatatatggtaatgttttttctgtactgctttaatgcagtgaaaataagattccaaacataaggcagattccttaggggtgagttgtgagtccaaggcagtcatatttgcaggttattggtgtggaataaaagccatttgatttagataaataggaaaggagcttgttaatatagaaaattatagttaaataaagcttatggttatcatatttctggtgcttcattgtgccctcttcatagagacaactttcatttctttatggaatttgttaaccagttggaattcctgtatggattatatgttttaaaatggtgtgtaacagactaatttgcactgctcatggagtctcctgcatttactgggaaattcacctttcttacagatccagaaattcacttttaaatttcatcttcaggattcttccttgtcttttattcagtaattatactataatgtgatacctgatattagagaatactggttgcctgatgataaatgatgtgagttcagcttaagtttaacttgttaaaatccaaatttcttttaagtccacaatgtggtggtagttttgtatcgatacattttcatagtagtgatattatggagactgtctgttggcattgaatgcaagtagtctttttctccctggaattttttttttttttttgagacggagtttcactcttgttgcccaagtggagtgcagtggcgcgatctctactcactgcaacctctgcctcctgggttcaagcgattctcctgcctcagcctcccgagtagctgggattataggtgcgcgccaccatgcccggttaattttttgtattttttagcagagacggggtttcaccatgttggccaggctggtctcaaactcctgacctcatgatcctcccaccgtggcctcccaaagtgttgggattacaggcgtgagccaccgcgcccggcctgcctccctggaacttcttagtgtcaaaattttatactccatgcttgtagtcataaggcctacattttatggtcatgtaggtttttaagggtgtataggtctttctgtgtttaagatcagatacctgaaattcactttttgtgaagtttgggagcttggaatactgtaggtgattcatgagtaaatgtgatgagcttgtcactaaaattattagtggtaattccatgtcattgattatgggtcattaggtttttggttgattaaattcagttctgagcctactccagctgctggctcaagtcaaattcttcccctgtttgaaagttgatctaacccacctgattaagcaagatggtatatacccttttaattatattctattaagcattctttagctatgtaggaaataagaaagtggaaaaaaattaggaaaaatatctaaccgtatctgcatgtgtgctttcttaccacatcagcaaagctggtataggtaattgaagcacaaaatcctgaatttatatatattgctttccctcctccccacaaagtttacttgacctgaattgcccagatacctccttttttccccagatacttaaaaaatgtacgttttgctttgtataccaggttctagatttgtaaagctggattgtctcttgagattatcaagactgttagtattaataaaaaattcacctttttacttagagagcattgtcagtattgggcatatgttcattttagcacctacaatgtgagtcattttcttaacattattttatttcatgggttatagtaacctcaaattatcagactttcagattgaaccaaaatgctgaatttatgtgttttaattttttttaagctaaagtatttctgattgacaacgttagaattcatttggattctgttgccagttgccctgcttataaatctgaagtcatttggctaaagtgttttctagtagctttcctttaggaggattactttttgtttatttatttatttatttatttatttatttttgagatggagtttcgctcttcttgcctagactggagtgcaatggcgcaatctcggctcactgcaacctccacctcccgggttcaaacgattctcctgcctcaacctcccaagtagctgggattacaggcatgtgccaccacgcccggctaattttgtatttttagtagagacgacatttctccatgttggtcaggctggtctcgatctcctgacctcaggtgatccacccaccctggcctcccaaaatgctgggattataggcatgagccaccgtgcctagccagattacttattttcagataacccatatagccttggtgtgacatagctacttcagtgtttcttgctagttctatttcattatattttaaagcagcttgaattttaatttttgtttacaaagtctattttgtggacttatctgtgtaaaaagaactagaaattatttttcttttactttccactctcattactgttaaccatactaaaataaatcttcaggccaggcgcagcagtggttcatgcctgtaatcccagcactttgggaggccgaggcggggggatcacttgaggtcaggagtttgagactagcctggccaacatggtgaaaccccatctctactaaaaatacaaaaatttggctgggcacagtggctcacgcctgtaatcccagcactttgggaggctgaggcaggtggatcacgagatcaggagttcgagaccagcctgaccaacatggtgaaaccccgtctctactaaaaatacaaaaattagcctggtgtggtggtacacgcctgtaatcccagctactcgggaggctgaggcaggagaatcgcttgaacctgcgaggcggagattgcagtgagccgagttcatgccactgcactccagcctgggcgacagagcaagactgtcaaaaaaaaaaaaaaaaaaaaaaaaaaaaaacaataaaaacaaacaaacaaaaattagcagggtgtggtggcacgcacctgtaatcctaactacttgggaggctgaggcaggagaatcacttgaacctgagaagtggaggctgcagtgagccgagattgtgccactgcaccctgcctgggtgacagagcgatattccgtctcaaataaataaaaataaataaataaaataaatcttcagtaccatgtgtcctagtgaaagcaaaggaacagaaagagagagagaaaaagagtgtgaggggatggggtgagagggagagggagagggaacactatggtaacaagttaccttaaaaggaaaatgccaagttggaaatacagcttagtagtgaggcaaaagcttcaggttccagagctattgaatgaattggcaagagttgtaaggaaaagtttggtaaaaggaccttgatttattaaacaaagcgtgccaatcatatgacctcatttcaccataaaaaatgttttttatacacagagatgaaataagctgaagctaattgggcatcgtctgtgtatggtatgtaaaatttattttggaacatcacagtcgtgaaatagcaaatatttattaaatgtctgctgtatcacaaaactgtaggagaacaacaaaagtacaaaatataaaatacagacttggttcatgaataaatattcatgaaaaattaacaatatatgacataaggacaggtatagttaataattgccaggtaagttgctgagcccgcaagttgtcagttcaaaggaggtagtgatgactctggactggaatggtctaggaagggcttgtgtagaagcaaaggggccttgaaggatggttaggattaaaatagaggattgggaccatttatttgtgcagtgtttattgagtaccagctttgtaccaggcattgtgctaggcattgatgatacagaagtgaataggatattaagtaagatagattctcttgtagtgccggcattctagtgggggagacactattataaataaataatgtaatgaatttggtacaaagcgctactggagctgtaaagaagggattggctatcttactttgagggaaagcgtcactgagaggataatgtttcgaggtagtccttgaaggatgagtagaatttcaccagaaagtggggctagagtaggtgtaacagaagcagaaaggcatggagtttgaaaaaagcatgaaatgtatggcaaaagtatgtgaagtgcttggcaaggagtgacaggaatgaagttagaaaagatcttttgtattacaagttgaggagctaaaacttaagctgttaagcagtatagcagtatatagtacctggatgattaaaagcacaagctctggagtcagactgcctgggtttgaatcctagctctactacttaataaccttcttgccatggacaagatacttaacatctccaagccttaattttcttatctgtaaagtagagctaataaaatcttattatagggtttttggagaattaatagagaccgtgcatataaagtaggtaccacagttcctggcctggcacatggtaagtactcaaccaatggtaaccatcaccattattattattattattattattgaaggttttaaagtagaatagtgacccagtatcttgttttttgatggctaattctggccatattgtgtgcaacaaattattggagggcaagaagcttaaagcaggttgtctaattagaagattaatggagtagtccaagtgagggatgaccaaggcatgaaaaactagatacgacacaaattcctactaatattagaaggtaagtatattggatgagtgattgagtatggaagtgaaataggtgagcaacagttttttaggaaacaataatcagaataattttgctttagggctagattaaattgggcaattgtagttagatgcaaagattggaatgatatgtaaaagactgagaatggttaaattgagaagaaccttgaaaataagatccaaagttttctttttctttattctttagtcattaagaaactaccccaagtttttgagtaggttaatttactactttgttcagtcaaagaggaagaagagatttttctagtaaatgataagaacttgaactagtattgcaacagtggagatttaagaaaattgaatttgaagaatcaataggacttagagttcagaaagagaacaatgacattaagtgtgagtgatagagaatggtgataccttaacaggtgtaagccaggaaggggagccaattttgagggaaaggtatatttaaaaaccaccacaaattaaaagagacccaatggataccttgaaattttgaagacaatgctgttggatttattgaatctttccttaaagcatgtggccaatccatacttctactcctggcaagcaaatggttatatcattcttcatgatgaggcttttttttttttttttttttaaccctcaagacaggatcttgctctgtcacccaggctgtagtgcagcgccatgatcatagctcactgcaggttcaaacttctgggctcaagcgatcccccaactcagcctcccaagtagctgggactacaggcacacaccaccatgcctggctaattttgtttattttttatggagacagaggtctcactatgttgcccagattggtctcaaattcctgggctccagtgactgtcctgccttggcctcccaaagtgctgcagttacaggtgtgagccaccacgcccagccatgatcagccttttgatgtctccttttgtcaaaagaaaattgtccttgtgttggtataaagacatatgctacaggagcagcattctgaagacttcaatttcaactatggctctacttcttactagtgaaacccctggagaagcaacttaatgtctctgaacctgttatctatcatttgtgaaatgggagataaaacttgcctgaccctaaccccagcactttgggaggtggaggcgggcggatcacttgaggtcatatgttcgagaccagcctggccaacatggtgaaaccccgtctctattaaaaatatactaattagccgggtgtgatggtgggcgcctgtaatcccagctactcgagaggctgaggtagggagaatcgcttgaacctgggaggcaggggttgccatgagctgagatctcaccattgcactccaactggggcaacagagcgagactctgtggaaaaaaaaaaaacaaaaacttgcctgaccaaactcaaaggatgtccctgggaatcatgtaggattatgtatgtgaaagtacttggtcaactatgaataaaacactataaatatattgtcattgctacataaattagtgtcgttaaacaagtattttggaaactataatcattaattctgtaaacatttcttaatacctatgtttttcctgtttgttttttttttttttttttttggttttggtttttttttgagatggagtctcactctgttgccctggctggagtacagtggcatgatctcggctcactgcaacctctgcctcccaggttcaagcaactctcctgcctcagcctcccaagtagctgggattataggcatctgccaccacgccccgctaatttttgtatttttagtagagacgggatttcgccatgttggccaggctgttctcaaactcctgacctcaagcgatatacccaccttgacctcccaaagtactgggattacaggcatgagccactgcacctggccagttcttaagttttagataggttttgataatggtggaacttagaatggataagacttgtgggccagaaacttgagcctatgatgactagttttcttttgagagaaagtctcactctcgcccaggcgggagtacagtggcccaatcccggcttactacaacctctgcttccaaggttcaagcaattctcgtgcctcagcctccccagtagttaggattataggagcccgacaccatgcccagctaatttttgtatttttagtacagatgggtttcaccatgttggccaggctggtctgaaactcctgacctcaggtaatccacccgccttggcctcccaaaatgctaggattacagatttaagccacggcacccagcctatgattagtttaatagatagcagggacaagggtaaactagccagaaggcatgaatctcaaaggaggaggcattttttttcccttagtggagagatgatgttggaagtgctaatgcggagctaagagaatgctgaagcctccactgagattagtggaatgcggaaaaatgagcaccatccactttgaaaaaagaatttgataagtgttgtccttcaggagacccaagatgtaattaaactagagagatgaagacagtattctgtgtagagctaaagaagagagaggccaagcgcggtggctcacgcctgtaatcccagcactttgggaggctgaggtgggtggatcacctgaggtcaggagttcaagaccagcctgaccaacatggagaaacccagtctctactaaaaatacaaaattagccaggcgtggtggtgcatgcctgtaatcccagctacttgggaggctgaggcaggagaatcacttgaacctgggaggcagacgttgcggtgagctgagattgcaccatcgcacgccagcctgggcaacaagagcaaaactccgtctcagaagaaaaaaaaaaaaaaaaaaaaaaccagtctggccaacatagtgaaaccccatctctactaaaactacaaaaaattggctgggcgtggtggctcacgcctgtaatcccagcactttggaaggccgaggcaggcggatcacgaggttaagggttcgagtccagcctggccaacatggtgaaaccccgtctctactaaaaatacaaagattagccgggcatggtggtgcacgcctgtaatcccagctgctcaggaggctgaggcaggagaatcgcttgaacctgggaggcagaggttgcagtgagctcatgttgcgccactgcattctagcctgggcaacagagcaagactgcatctgaaaaaaaaaaatacacacacacacacacacacacacacacacacacacacacacaattagccaggtgtggtggtgtgtgcctgtagtctcagctacttgggaggctgaggcaggagaattgcttgaacctgggaggtgggggtttcagtgagctgagatcctgccactgcattccagccccggcgacgatgcgagactctgccaagaaaacaacaaaaaaagagattgtgtgtagggtttgtgggatagattaaaacaaaatcttataataggaattctgaaggcctcaatgaaaaggatggagggagaacagcaagaaggaaattgtatgagggaaagaaatacagagaaaaatttagaagtatagatgtagagactgtattttggatagttgccaaggatggcaatgatgggaagcatgatgagattaactgaccttaggcatctgaatgatactttggagtcaagttattcacttggcacagactgtacccccgttgaagtcagaggcctcatagggctaagagggcagtccttgcttagaattggggaacaggatcagttaattctcaggtttccttgcccagtggtagaaacagtaagaagatctctgtaccaccaccccctttttcccaattcctgatcagtctgtgttcttggtttctttttccaacttcctaaattaaaatgtttttcagtccttgtttttttagccaccatacattaaatgtgagtgaaaataccttgcgaatattattggttactatatagagatgcccttcatgtcaaaatttggataaaaggaagattttcaacagaacagtttggtcaaaatgaatgttaccaaatcaagatttttaggttttgaggagattttgtagctctcttttttgtttgattggtttatttttttgagatggagttttgttgtcacccaggctggagtgcagtggtgtgatctcggctcactgcaacctctgccccccaggttcaagcaattctcctgcctcagcctcctgagtagctgggattacaggtgtgcaccaccatgcccgggctaattttggggtttttagtagagacaaggtttcaccatgttggccaggctggtcttgacctcctgacctcaggtgatccacctgcctcgacctcccaaagtgttgggattacaggcgtgagccaccacgcccagccgattttgtagctctttaggttgttccaacaaatattattagccatttcagttgttgactatttatattgcatttatatacatttgttttctggtttttccctgtcgcaaatatagaaaagtaaggaaacatagtctgaaaattaggagaaaaaagtatatatggaggcaaaaaaaaaaactctggaaaagtagaaataggccttgcgcagtggctccacgcctgtaatcccagcactttgggaggccgaggcgggcagaacacgaggtcaggagatcgagaccatcctggcgaacactgtgaaaccccatctctactaaaaatacaaaaacattagctgggcgtggtggcaggtgcctgtagtcccagctactcgggaggctgaggcaggagaatggcatgaaccccggggggcggagcttgcagtgagcagagattgcgccactgcactccagcctgggcaacagagcgagactccgtctcaaaaaaaaaaagtagaaatagttggctgaagatgaattagaaataaaaaaagcaaaacctttaaaaagcctgaaaactatatggaaatgctttaaaatgctttaggagttgcaaaacaaagtagtagttgagaattaatttttttttttgagatagagtctctattgcccaggctagagttcagtggcacgatctcagctcactacaacctccaccccaccaggttcaagcgattcttgtgcctcagcctccaaagtagctgggactacaggcgcgacaccacacctggctaatttttgtgtttttagtagcgatggggtttcactatgttggccaggatggtcttgaactcctgaccacaagtgatctgcctgccttggcctcccaaagtgctgggactgcagacatgaaccaccgcacctggccagagaattagtttttgatgaaaaaaaaattttaactctctattgagcaacttattttaggccaaattctatttggacagttatcttttgccccgtcaggtctcctgctgaagctccgttctccacttgcaaaacaacactatacgtgccttttttctcttatttgctgataaattaaaatttattttatttttattttttatctttagacggagtcttgctctgtctcccaggctggaatgcactggcatgatctcggcccactgcaaccttcacctcttcggttcaagcgattctcctgcctcagcctcctgagtagctgggacaacaggcatgcggccaccatgcctggctaattttttgtgtttttagtagagacggggtttcaccatgttggccgggctggtcttgaattcctgacctcaagtgatccacctgcctcagcctcccaaagtgttgggattataggggtgagcctctgcgcccagccaaaacatattcatttgaaactgcctatttttattttcagtgttatggtaacattgattccctatagctttcatctacctctactcatgagtaggtgacgtttttctaccactcaacctgtacacattttaaaaaagctgtcccagctggttttgaaatgtagaagtgtgccttgagttgaaaaataagtaggaaagtacaggtctttagataactaactgtggcatggagtcagtttatactttctttttcaggtgaatacattatagttcttcagtgtgacttgaagtagagcattcacagtgtgcgtgaaaacatgcagtaccacttgtgtctggctgagggggaagtagggagtggtctcataggtggatttttaggaagttctatgttttgaacagaattcagcaattagtggaattatgttgttggttgttaggaagtatatatcatctaggccaggcacagtggctgacgcttgtaatcccaacacttagggaggccaaggcaggcggatcacctgaggttaggagtttgagaccagcctggccaacatggtgaaaccctatctctactaaaaatacaaagattagccgggtgtggtggcgggtgcctgtaatccgagctacttgggaggctgaggcaggaggatcgcttgaacccaggaggtggatgttgtagtgagccgagatctcgccactgcattccagcctgggagacaagaatgagactctgtctcaaaataaataaataaataggaaatattcatcatgtagaacacagctttttttttagagactgagtctcttttttttttttttttttttttttgagacggagtctcgctctgtcgcccaggctggagtgcagtggcgcgatctcggctcactgcaagctccgccttccgggttcacgccattctcctgcctcagcctcccgagtagctaggactacaggtgtgcaccaccacacccagctaatttttgtatttttagtagagacggggtttcaccgtgttgaccagggtggtcttaaaatcttgacctcatgatctgcccgtcttggccttccaaagtgctgggattacaggcgtgagccactgcatccagccagtacgtagcattttaaatagtgtttcttttcccaagtagagtgctaaaaaaaaaaaaaattctctgacctgatgaaaaaactgattctatcttgatctcagaaatttgtgtttattagtaagagatatttaaccttctcatttttgtaatgtcccaaaagtaacacttgatttatttagtaatcaattcattaaaaatgtttattttttaaacaattactctaccatgagggcaaatttggttatagcatatataatggtttgtttaatctttgattggtaaaaacattctttgaggcttttattttattagaatcttgacatgctatatttgggggtaaaatatactttaatgccttattctagatgagtaaaaagtaatggtaatacatgtttcttgtgaagggaaaataaacaaggtccagttttattttactagatagcaaataaaaaaaaaaagagggattagtgatttcagtcttttagaaatggttggcatctctctgccttagttcttacctcacttgtaaaggattgagttcttccttaatgttttctcctggtatgagaatgtggttatattctttcttaggtaattgataggaatctaacctagtttttttttttgtttttttttagttactttaagttgaaatgtaaaggagcagttggttctgtacatttccaagcttctctgtaataattgatcattacaatgatgaccctaaagcatcaggaaaatactgtatactatatgctcagagatatatatatgtatatatatatatatatttgatggagtctcactgtcgaccaggctggagtgcagtggtgtagtctaggctcactgcaacttctgcctccccgggtttaagtgattctcctgcgtcaccctcttgagtagctgggactacaggtgtgcaccaccacacccagctaatttttgtgtttttagtagagatggggtttcaccatgttggccaggctggtcttgaactcctgacttcaagtgatccactggccttggcctcccaagtctgggatttcaggtgtgagtcactgcacccggcctatttttctaaaaaaaaaaaaaaaaagaaaaaaaaatctggaaagagggagctgccttacatttcagtctatatttattagactcctaatgtacatttctctctcactttctttattttgaaaaacaaagtactattcagtaaagagcctgaaactgcttcagtccaagctgattttgaatgcataaagatttacttgttggattcagtaaaaaaggaataagaaaaacttactatatagtaatttttcctaggtatatgacctcaaaattgtgcttagatgccattgaaatagatgttcatgttttccattccactcaacaaatatcacttaaaaacagtacagttggtgatttcttacagaaatcataaatatgtactgcggagtgaaaaaaccaactacttaactatgatgaaatgggaacttttggttaaatttgtagggataggccaggtgcagtggctcatgcgtgtaatcccagaactttgggaagccaaggcgggcagatcacctgaggtcaggagttcgacaccagcctggccaacatggtgaaacccggtctctactaaaaatacaaaaataagctgggcatgatggcggatgcctgtaatcccagctactcgggaggctgaggcaggagaatcccttgaacccgggaggcgaaggttgcagtgagccgagttcacgccactgcattccagcctgggcgacagaacaagactccatctcaaaaaaaaaaaaaaaaaaaaaattacagggataaatttgcagtggtaacattttacacatatgcaaaaagtgctgtatctcaaacagtttaggtggaaatgagtatgatttgctttcagaatgtgtgttaggtgactcagaaagtgacttcaatgataaggaatgcactggtttcgaatatatgcataaagattttgaatgaaggtgttttgtgaaacgttaagtaaggtaggagaaaaatcagtattttgaaattatgatttattattttaagcctcctaaattaatttgcatttcagaagtaaacatctggtgtttggtctatatctctaaaagtgtatagtcaagttggtcagaaaacattgtttttatgttcttattagaaaggaacatggtaaatcaccttgtatttgggttttctttctagttaggcttatttggtattaaagtgttgtggggttttttttgagatggtgtctcgctgtgttgcccaggctggtctccaatttctggcctcaagtgatcctcctgccccagcctacgaagtagtcgtgattacagacatgcttcactactcccagcattaaattatatttattgtacttcatttaaggtaaagaatatctaatactataatacaatattttgagagttctgcctaaaaatgttttggcttaaacaaaaaagttttggttatcctgaaagaacttaattttgtgagacaactcatttctctaataattctcaacaaagaacatgttagtataaatagctttaaaagtggtataatttgcttactatttagaaaaacacttctacccaataaatgaagaagaaagaaaaatccctgctttacagtttttagtcttatctagatccaattattagtttttaagttaatgtatttttggtgacttatcttttattaattaaaaacatttgcagctgtccctttccccccaacacatcgcttgacatctgaagaagtatttgatttggatgggatacccagggttgatgttctgaagaaccacttggtgaaagaaggtcgagtagatgaagaaattgcgcttagaattatcaatgagggtgctgccatccttcggagagagaaaaccatgatagaagtagaagctccaatcacaggtaagcttattcatgttttgggtattatttttattatgtcattatttagttgcctggatttacaacttactgttttcaatgatactgtatgctaaatcaatattacttggacattatcttgaatttcaaattattttccatacttaaaaatgattgcctgttttcagtgaatagacatgattctaaataatctgagtgtagaagttagtctaatatgcttttgtgaaggtttcatcaattgtgttgaccatacttcaatttgatcaatacttactttgctttcaattgttagggtcaaataccttgatgtcatatcagataccaaaagtgaccatttagagagcaacagaaagtattgagttagaatggatattttaactgccaccattgtaattttgtcatcttgaaacttaaaacacatccttggagtcctagagacgatctttataaatgtagatttcagtttgtcactgaccacaaatttcgttatttctgttacatctttttctagatcttgagcacatgaacacttggttacacatcatcctaatcatgactgttcatagactacttccttctcagacatttcttgatagcatttgtactatgtcttatgtaaaatacgttttaacttaagtaaaatttgttgttttagagatttttttcccttatctaataatcttcttgtttcagtgtgtggtgacatccatggccaattttttgatctgatgaaactttttgaagtaggaggatcacctgctaatacacgatacctttttcttggcgattatgtggacagaggttattttagtatagaggtaataatcataaactgtcatttgatttgctgttaagtgttaacacagatgctttcacttaatcctagttttcacaagtacctgtgttaggtttttttaataactctgcatattctgaagtttttatgaaaagctactatttattcctgttctgtctttcaaacaattcaaataaatttctttgtataactctgtttatataattataattgccatttttttcccagtggaatttatgagctgactgaggggtctttattgccctgttaactagtggccttaaaaatttagtgctatttatctctcttgcccctaaaggcattaaaccatgtgaaaaaagattacttgaattctgtctgattaaataaagtatattgtgatttttttattgcttgagccctagtgcttctgtttctccttgtgtagctattaagactcaagtatatcctatggaatctttgtgtatttggaaagtattaatttgtttttaaaaacttgaggcattaaaatgaccttttgattatcacttaacagtagatggttccttttcttcctttttctcttttctttttctttttttttgagacagggtcttactctgtggcccatgctggagtacagtggcaccagcatggctcaatgtagccttgacctcttgagcttaagggatccttctgtcccagtctctcaaatagctgggaccacaggtacacaccaccatgcctagactaatttttaatttttttgtagcaatggagtttcctatgttgcccaggctggtcttgaactcctgggctcaagtgatcctcctgccttggactcccaaagtgttgagattacagatgtgagccacattgccctgccatctttttaaattatataaacaaaatgcagcaaatgtagaacaatatgtattttccaatatatacattttttctttttttaatgaaaaggggatcatattataatattgtctgtaacttgctttttcatacatgcctacaccaaatatccttccaagtcagtaaatataaactcgtagcatcattttaatatctacattgttttccatctaataaacaaaccataattaattaattccttgtgttagacactgaagatgttcccagtttttttctttacaaatgatgctttaatgagtcatattattcatacatctttacatacttgcctgattatttttgtaggacaaattcctagaggtagaattgtggggtcaaatttctaccaatagatacctgtgttgcacatttaatatgttctaagcatgttctaggcactgaagacatatcgattaatcctcacaataatattaatgaggtaagtactgttgttttattcattttatagatgaggaacctgaggcttagagaggttaagtaacttgcccaaggtattattagtaaacagcatagccaggcaatgtgactcccagcatatgcttttaaccaccttccctagtagatactgaaaccttacctggtgaatttatgttggttactgttgtttatatctccttctccagtgtttccaatatacctttttttctgaggtgtgctaggattctcagagtggaaggaagttctagactctgtctgtcctgcttcccttaggaattttgctattttgagttcttcttcctcctgctgatagttgattattagcctcgtcaacttttcccaaattgtcacagggcttcaggcaaatcagaaaatggcccattttaacaaaaaaatttcaggcatttgaccaaaacaataaaataaacagttttatgaagcttatttggtaactaagttggtgtgcatgtccttgtgtaagattgttttgcagctgactctttttttttttttttttaattgagatggactctcactctgtcgcccaggctggagtgtagtggcgtgatctcggctcactgcaacctctgcctcccaggttcaagagattctcctgcctcagcctcccaagtagttgggattacaggtgcccaccaccactcccggctagtttttgtatttttaatagagatggagtttcgccatgttggtcaagctgatctcgaactcctggcctcaggtgatctgcctgcctcggcctcccgaagtgctgggattacaggcgtgagccactgcgcctggatgtagctgactcctttaatacattttgttgttataaaaggaaaataacaaagaatcaaaataagcatcgagaacagattatttccctgattttattacttttttcccttttgaataaaatgaaggatatgaatagttacatgtttagatataccttaatttattaacaataaagttttgttgggtgtggtggctcacacctgtaatcgcagcacaggttggccaagtcaggcagattgcttgaacctgggagttcgagaccagccagggaaacatggtgaaaccctgtctccacaaaaaaaaaaaaaaaaacttagctgggcctggtggcatgtgcctgtagtcccagctgctcaagagactgaggtaggaggatttcttgagcccagaaggtcgaggctgcagtgagcagtaattgtgccattgcactccaacctgggtgacagtgagaccttgtctctaaaaataaaaaagtttgttttttctttttgcatatgattatataaaccatgcttatttccatatcaaatatttcttccttttttaagcaaataagtaaaatgtgagtctctttcttatgttaaatctatttagagaatagcatctgctataatgtttaataatatttttatttgaaaaattacatttgcattgaattagttcagataataagcacttaccatatgtaaggcaatattcataatcaatgaaacaaacataaaacatggaccttcccttcatgggcagcatggcataatgcttaagatcagaggatcagaatcctatctccatcacttagaagttttgtggttttggacaagttacttgagatctttgcttcagtttctcatttgtaaaataaagatgatattacatacttcatagtgttgtttgaggaataaattaggggaattatatagtgcttcacatattgtaagtacttaataaatgttagctgctgttattttgacagtattatttactaatacgcatctgtagaccagtgtgctaattgtttttatattgggcagtctgtaaatccaaagtaattaaatagattgtttgactcattcattcaacaaatatttattgctcttctcctatttgctaggtactcttctgggagtggagaatcaaaagtgaataagatgacaaaatctgtgattttgtggtgcttatattttagtaagggacaaagaaagataatagaggatggtaagggtagtagaggaaaaggagcaaagatcaagcagcttcattaaacaaaagtacaagataaattcactagaaaaattttcttttgcagtgtgtcttatatttatgggttctgaagattctatacccaagcacattatttcttctgagaggcaaccatgaatgcagacaccttactgaatattttacctttaagcaggaatgtgagtactgccagaagaaatgttttcacttcctcagtattcttttggacttaagtgggtagtaagagttttgaagactttacagtgcaacatgtaaggacagatttcatgtccacacataaagctttgaggaaagttgtcgagcactctctggtgtttaatggtattaagaagtttttggtggggcatggtggttcacgcctgtaatcccagcactttgggaggcccaggcagggggattgcctgagctcaggagttggagaccagcctggccaacatggtgaaaccccatctccaccaaaaatacaaaaaaaaaaaattagctgggtgtggcggcacactcttgtagtcccagctgctcaggaggctgaggtgggaggatcgcttgagcctgggaatcggaggtcatagtgagctgagatcatgccactgcacggacaattgcctgggcaatagagtcagaccctgtctcaaaaaaaaaaattttttttcatttcagaatttcttattatgtttaacttttacaaacatacttagagttttatatataagttttaatgttacaattaatttttctaagccaggcacggtagctcacgcttgtaatcccagcactttgggaggccgaggcgggtggatcacctgaggtcaggagttcaagaccagcctggccaacacggcaaaaccccatctcctaaaaatacaaaaattagccaggcgtggtgacatgtgcctgtaatcccaggtactcaggaggctgaggcaggagaatcacttgaacctgggaggcggaggttgcagtgagccgagatcgcgccattgtactccagcctgggcaacaagagcgaaactctgtctcaggaaaaaaaaatgtatatattttttctaacaggaaaaaataaaaaccaaaagaaaaaaatgttattttgcattggagatttttgtccttcaatcttgaggcattcctgtgaggaatcctaacaaattgtttatcctgttaccattgcagatcatttcaatcatgctattaatgattgaaattcttcttaaaatttttttgtttttttaaatatcattgttttaagactagtcaggtacagttggtgaaattcttaacctgcaatgtttatcccttttctctctcaaattattatagcaatggtaatctaatacctgtaagtaaccatatgttacagaacaagattaggcctttttcacacctcaaacctttgtgcttttttattatttttgttatttttattttttttttgagacagtctcgctctgtcgccctggctggagtgcagtggtacaatctcggctcacagcaacctcctcccgggttcaagtattctcctgccttagcctcccaagtagctgaaattacaggcatgcgccaccacgtcctgctaatttttgtatttttggtagaggcggtgtttcaccatgttggccaggctggtctcttaactcctgacctcaagtaatccacctgcctcgtcctcccaaagtgctgggattacaggtgtgaaccaccgcatctggcctgcctttgtgctttttaagttaatatttatgactgtattaagtagagttaaattctaaaagcagaaataatttcaacgttttgagactcaaaacatgatccaataaaggtcatactaagtagagacttgcagcaacaggagaaaaatacagtgatgggtagtggcagaagtggcatactcttataacttcaaggatcaggcagttaacctaaatgagtaagataagacctggaaagtgcatgcttgacctaaaagcagtcaaattagaatttttattaaaccacagtgctagaaaacagagtcgttagcagactgccagtgtagaatctctggttgctggatatatatatagtttttttaatatttgaatattacagtattaaaacaggaaataggaactaagttctttttctttgcctagataaataacaaaccacctaccaaaatctcatcaaaaccaaaataggaatttaaagttgtaaaggagcaaatgaaagtgcatgatatctctctaaaagtaaatgatagtttgatttggtagagttttgtctttcttgtgtttctatattggcttcctgcttcactgcccattttaaagtattcattgtaggcaagaggaacccctcagcttttctgacatgagcatgctattatcttttatttttcagaaaaaatggatgaaccttgaattttgttgtgatgatgtagtcatcttgcctgtaataagaataaagtagtcattgactcttagaataaaataaagcaagtattaaaatgattttaacctcaagtacagttctaattttgccttatttggccgataaaggtgaagggttgagctgtttttaagagatttctttcttttttttttttttttgagacagagtcttgctctgtcgcccaggctggagtgcaagtggcacgatctcggcccactgcagcctccacctcctgggttcaagtgattcttgttcctcacccattgagtctctgggattacaggtgcacaccagcatgcctggctaatttttgtatttttagtagagacagtgttctgccatgttggccagactggtctcaaactcctggcctcaagcgatctgcctgctttggcctgtcaaagtgctgggattacaggcgtgagccaccgtgcctggcctgtttttagagatttgactgacttatttttaacaatacgtgatgacttttctgtcatccaaaataattttagagagcaaatattttgcttcataagacataacatcatcgagaataattttagagagagcaaatattttgtcttcataagacagataactttgcatatttttgttgattcttataggggaagatgctttccttaaaaaaattgtgtgcagtaagatttattctctgtggtatttacttctgtgacttttgacactgcatagagttgcccactaccactatcatgatacagaaaagttttatcatgccataagttctctcttgctacctttttatagtcaccccttcactcactctgaagccctggccaccactttgctgtttactgtctataattttcttgccatctgtctgtctgtctgtctgggctattactacagttgaaactgtaactatctcaatttcattataaatagctataagatataaaggaggggagagaacaagaaataaaaatctaatatatatgtttttaaaatggtcacaccaccaccagtaatgtaattttcaattagttttttgtttttctaggtaaaattaagtattcggaaagagtctatgaagcttgtatggaagcttttgatagtttgcctcttgctgcacttttaaaccaacagtttctttgtgttcatggtggactttcaccagaaatacacacactggatgatattaggagagtaagtatatattttacttccgagattgatttctatttatagtacattgttgagtagagcagaagtttcaaacttcacttcactgccaagattaggtaatagtaaaaattagtatactgatatcttaaggaaataacttctgtttattcacaataatatagtatgaactgtattcaaagttggtatcgttttcctatgcacattttatccttactttttgatgagttacttctgttctttcttttctttctttcacagttagatagattcaaagagccacctgcatttggaccaatgtgtgacttgttatggtccgatccttctgaagattttggaaatgaaaaatcacaggaacattttagtcacaatacagttcgaggatgttcttatttttataagtaaggaaaaatatccaagattaatcacattttagttgttaacatagcatatgcttcatacagaaaagccattattttacttaatttactctttttcccccacagctatccagcagtgtgtgaatttttgcaaaacaataatttgttatcgattattagagctcatgaagctcaagatgcagggtaagaattctgtttccctgacccaaattaacacctaaaatataaatcaaacttagtaaccatgattgatgctttacgatgcatattaagctatttgttttgcagctatagaatgtacagaaaaagtcaaactacagggttcccttcattaataacaattttttcggcacctaattacttagatgtctacaataataaaggtaagatattgttgataaaaaaaattgttaaacaacttagtattttaattgactttttttaatataataaaaaaggggtgttgtttgaaactattagtatccagatttctttataaataactgtaagatggaggggagagaacaataaataaaaatccaaaatgtgaaactaagtaatatgtaaccccattccacaacttgtctcttggaaaagccattttgtaaaacgtgctctgagttaagtgcatcaagcaaaaccaaacatgattttctcaaactcccctttcttaaatcttttcccttattgaggatgttttcttatttgtataaagctgctgctgctttgatgattttatttgcactgtctacttgtttagtttatcatgtttcttgttttatgttcactgatctaggttctctttccctttcttatttccttcttttacctccacagtcttatcactgccccatgaagatttgtatttgagcttttttttaattaattcagtttcatctcatttgagggatacattcttctctttatttttactgcttttttcctttgccttccgttccagagattttcatttccccaccttccctgaaaatttgacctgtctatagtaattggatttcattttattttgaatacagtttattgacagaaagtgccaaagggtcttaatctagttaagtgtgtgccaaggacattgaagatgagattgggtatgtttatgtagtttacatctttggaagatgatattaagaggccagcttctcttctgtcttgacatgtctggaattcagttgactatgccatagcttcaggatcagactggagtggatgtgccaagaggaaagaacagaaggttaaagactttaaaaaggacatttagagagagaatgaggtcattgctaaataagggtcatggtgtaagttcaaaagaggaacagaggaagtttttttggatgatgagaggtgatggttaaaagattaaaacacttgcctgagaccaaacagtagcatgctggataacttgggtacagaatatgctacaagaacttacactatagatatcttatgaaatatgacttcatttttgagaagaaacatatctaagttttgattccattctttctctctctagacagggtctcgctctgttgcccaggctggaatgcagtggtgcagtctcggccgactgctacatctgcatcctgggttcaagcaattctcttgcctcagccctccctaatagctgggatcataggcacccgccacctcgcccagctaatttttatatttttatagaatgaggtttcaccatgttcaccaggcttgtcttgaactcctgacttcaagtgatctgcctgcctcagcctcccaaagtgctgcgattataggcctgagccactgcgcccctgccctgattccattctcaaaaacagaaccaagtgttaaatttaactttctaccagtgctctaattcctcaactgtgacttcctcttgttaatattaagggagctagtgttcagtgtccagttgagtactgccttactgattgtcctttgttggtttgactcaggaggttaagggatggattttttttagcacttagaaaagaggctcaaaccattgactgtcttatcaaaaatcagatgtctctttgtagtcctgagtctgtacataaatagtgttaatggtttgagtgtttacgttgtatgggtatgtttgtaatttttcattctatccataaggcaattttctagatttttctctcttttatcccttacaaaagatctgaaagcttggtatcagctcataatttttgagactaatttaaaatactcttttttcccactttgaactgattgtcaaaacatataatttaaaatacttttatttcagatgggaatttcatatgggaaacaaacatatacttattaagttagtaaacagtaacatgtagcaggattacttttgattctctattagccacaatcacaaatgttggaatttaacatctgcatttcagtgcttttcattaaaatgaaaaaaaagtaaccataaaattatatctacaagacattttatacttttatgtattttcatgtgaaatgcattgtctgatcttaaacttctgtggtaggcagggtagacatattagtcctgttttataaatgagaaacacattagttgaataatttaccaagcattgcacagctagtatgtgctatagtttagatgagaatccagcccttctaacccagtgttctatacagtaatataaccagtaactgaaatctatgtaggtcatttaagattttaattatatcaacatattgaaacattagatacctgcatttgagatgaaaatgttatctctggattgtttggttataatattctcttttggtgttttagtaggattttttttctaaacaaagtaaaatatttctttgtagtaattttgtctgattttccatattaaatgaaacaaatacattcatacatttataagtaaaatgttccaaatgggtgggatttttttgtttgctttattaccattcagctatccttttcaggttgcctgaagctagaaagatcttaaattctcaatttgtttgaactttaaaaacctagaaaattgctcattgccattctgtgtttcctctaaaaactgagttttcacaattttggatttagtaaaaatgtatgttcatcattggattataaagtaaaacaaacattctggaaagaatctggaaatttcattagtaatgtgaagacctgactatagttatagttctacataacagtgttaaaaacaaaacctatgttattattaaaaattagttccttcctccctctaccagccctgattccactcacccccgatctcccttcctcttaatatttttctgcttttatgtattttatatttttaaggctaatgacaaatagttacttatctattaagttattgatgttcaacttatcttgcagctgctgtattaaagtatgaaaataatgtgatgaatattcgacagtttaactgttctccacatccttactggttgcctaattttatggatgtcttcacgtggtctttaccgtttgttggagaaaaaggtataatttttatttttaaaaaaaatttgttttattactgttacatttactccagtttactatcataggcacatacttgctaaaggaaaccaaagtctagtttcactgtggttacagctctccttgtgtcagtgggtgtggacataagagtctcaaagatattttagttagctgtttacagcccccatgtgaggctgtctgggggactgggagaagatttataaatagcccaatgtcttcagctgttggattttctttttttttttttctttagcttaaatcttttatgaaggggtggagagattgctttgcttgaaatgggcccttctgcatatcttaacaccatttttgggcattccaccgaaattcttggggaaatttagtagccttcattttagcaatattagtcattttaatagctgttctatactttaagagaaatcataaagagaaattcagattgtaacccaatattccttctcttatataaaaaatatgtataaaattttagtagtgatgcctttctaatttagaggaacacttgttagtacataataggctttttgagagaaaataaatgctatttaagaaattctgtttctgtgtttcatttgtagttctatagaattcttaggattttgttacctatcatgttcttttccattttaagttaatttttttcataagaaaatgcctcagtttccatatgtggaaaatgacattatgagagtacagacatgattataaaacattttgttcagtatccccctctattttttctcacctcttccatattacaaaatgttcctttctgtatgagatacgtcacttctgccaaggcaatttgtagttctgaaattcagaattaatacttaaactgtgtatgttaaacaggttttctgcagattgcatttggtgttcttcatttactcagtaggtccaatgttaatacggagatagaattaccctttagcatttgagaagggggccagttaagggcttaggtgcaagggatgcattacacttacaaccttctatctttggtgtatgagaaatagttcaatcatagcatcatcagatgaattaaataattcatcctgctcactctcctgccttcaggctagactgcaactcaactgttttaatgtaatatgggaaggatggaggggccaggaagataaggtaggaggaaaatggacatttcatagattctaatttgattctctgatagtcccacataaggaaatatttcgttatatctaatctaaatatttatgctatgagtatttaaacaaggaaagaaatagagataataggtttttctcaactaatgcacctgtcaaaaaccagggcatcatagggttttagagctcataagtggatataacagtcatttagcccaactccttttgagagatgagataatttaagatgaattctgtggatcccttacaagtgaagatggagaacagtaggcttttatcagtattcctgtatttgaggtctggtactaagtgatctttagtttttccattgccactctaaatcatcttttataaacaaagaaatattcaaactttttgaccatttttgttgtttttctttagatcttctctaaattattcacatctctctaaaaatgtaaagctcagattttaacattacatgcaaatagaattctagccagtgttgagcacagtaagaaaatcttctcaaactctttgcatattttgctattttaatacatgatggctgtttagatagcctgactacttcttgatggtaatgagcattttcttttggtgtgaaaagcagcaagtgacatttgttttacttcgaagaagccagctggactctgggtctagttcctgagaagcaggaactaacctaagccagaggcttcctgaaaggctgatttaatcccaaaattaggcgaaagcagtgtttccttacccttttgggagctaaaacccccactatttttttttatagagacagagtctcgctctgtcacacagactagagtgcagtggtgccatcatagcccacagcagccttgaactcctgggcttatgtaatcctcctgccttgggcttgtaaagcactgagattataggtgtgagccactgcacctagccaagaaccccttttctgtttcactaaaaatattcctacattggcctgtagtcccagctgctagggaggctaaggcaggaggatcacttgagcccaggagtttgagaatacactgtacaacaatcaaacatctgaatagccactgcaccccagcctagacaatatagcaaaaccctgtctctaaagaagtaaaataacttacattgggaaattttcaacatacaccaaggtagagtgaataatatgaatttcctatataccaattattcatcttcaacaattatcaaatcatagccaatcttgtatcatttatgtccccatccagtactccccacctcatacctcaattattttgaaacaaatctcaactcttttctatctataaatactttagaatatatttctaaaagataaagagtcacattttaaaagtacaaataaaaacatttattaattttttttttttttttgaggcacagtctcattcagttgcccaggctggaatgcagtctcattctattgcccaggcacaatctcagctcactgcaacgtccatcccccgggtttaagtgattctcatgcctcagcctcctgagtagtgggattacaggcatgctgtaccacacctggctaatttttgtatatttagtagagacggggtttcaccatgttggccaggctggtctcaaactcctggcctcaagggctctgtttgcctcaacttcctaaagtgctgggattacaggtgtgagccactgccaaaaacgtttattaatttcttaatatagaatccctttgagaatctgataaaagttatggacttttgcttcagaaaaattcatgtataaatgtatgtactcacaacattttcaggatggtcatagttctgaaatgaatttgcaaccttcacacttattggccctcctttaagaacctctgttctagaggatctaatattatatgatcttccatagaaggtcatacatgtaagatttatttattgactagattttttttaagtgttttattcaaggtaccaaggaaatacagatacaagtaagatgggtctttgcagattaatgtgggacctgtgatatatataaataatgataataagatgtaatatggtaagtgctccaagacaagcgtagttttataggaattgagatggctgggcgtggtggcttggggccaggcgtggtggctcatgcctgtaatcccagcactttgggaggctgaggtgggtggatcatcaggttaggagttcaagacccacctggccacgatggtgaaaccctgtctccactaaaaatacaaaaattagctgggtgtggtggcgggcgcctgtaatcccagctactcgggaggctcaggcagagaattgcttgaacccaggaggtggaggttgcagtgagctgagattgcaccactgcactccagcctgggcaacagagcgagactctgtctcaaaaaaagaggagaggccgggcgcagtggcttacgcctgtaatctcagcactttgggaggccgaggcaggcagatcgcgaggtcaggagatcgagaccatcctggctaacgcagtgaaaccctgtctctactaaaaatacaaaaaattacaggtggcgggcacctgtaatcccagctactcaggaggctgaggcaggagaatggcgtgaacccaggaggcagagcttgcagtgagccaagatcgagccactgcactccagcctgggtgacagagtgagactccgtctcaaaagagaaaggaggttatttctgtcagagggattaaagtagcttttgaacaggggcttgaagaatggtggaattgtgctggtggatatgagcaacagaattctagataagagaacttcctgagcctgagtctgaaagcaagaaatcataggtctctttgagggtttaatttgattagtgagtaggatctatgaaggacagtagtagaaaaagaatgaaaagttaggttagggctagatcatgaggatattgatcaccacacagagaagttggaactttgataaatggtgagcaagccattgagatggaatttgactgtggtcgtcatttagaaaaattactgtggtgaagtagactggaaggaagacttgacgttgagagacctgttatgaagttacaccagaagtcaggtagagacataatgaaggcctggtagcattaggaacggagagtggggagaaccaaaagaatggtagaagtagaatcagtgagacttaacaagattacatatttaagggtagggaatggttggagatgacttggatattttgagtctggtgaagatagtgccattaacacactccaatgagaaaactcttgttacaacaaccctttactcaggttactgctgttcttcatgttcattggaatctctaggcctttcagtatgtcattttcttcctttttttttttttttttttttttttttttgagacagagtcttgctctgtcacccaggctggagtgcagtggtgtgatctcagctcactgcaatctccatttcccaggttcaagcagttctcatgcttctgcctcccaagtctctgggattacaggtgcatgtcaccacacctagctaatttttgtgtttgtcgcagagacagggtttcgccatgttggccaggctgctcttgaacccctgacctcaagtgatccgcccacctcaacctcccaaagtgctgggattacaggtgtgagccactgtacccagcctaactaagtcattttcttactagtcaaatccctttttacctctcttccttattaacataccctcaaactcctttcttttctgtttttctacttcatttgtcctataaatcttaggtctagtcaaatccagccatccattttctccattcctacagccacagtacagagtgctgctggagatttttacggacttgtgaattggcaccaccccttgatttataacattagctgagctcccagtaggaccctcataccgtttatatccctagtctgcttttttctcccattttgcttaggatagagtccaaattttccttttttaaaaaattgtataaagaaaagagggccaggcacagtggcacatgcctgtaatcccagcactttgggaggctaaggtgaaaggattgcttgagcctaggagttcaaggctgcaggctgcagttagctgatcactccactctactgcactccaacctgggtgatagaatgggactctatctgaaaaaaaaaaaaaaaaaaaaaaaaaagaaggagtttaattggctcgtggttctgcaggctgtacaagcatagcacctgcatctcctcggcttttggggaggcctcagggaacttctcatggtggaaggtaaagtgggagcaggcacttcacgtggtgagagcaggagcaagagagcgagggggaagatgccagatacttaaaaaacagccaaatttcacaagaatttactcactatcgtgaggacagcaccaaagggatggtgctaaactattcatgagaaatccacccccatgatccagtcacctttcaccaggctccacctccaacactggggattacaattcaacatgagatttataggtgacaacatccaaactatatcattctgcccatggtccctataatatcatgtccttctgatatatcaaaatataatcatctcctgccaatggttccccaaagtcttaactcattctagaatttaaccgaaaagtgccaactccaaagtctcatctgagactcaagcctagttccttctacctatgaacctgtaaaatcaaagacaaattatttccaagacctaatgaggatataggcattggataaaataaacattcctgctccaaaagggagaaatctgctaaaagaaaaggggttcagacactatgcaagtctgaaacccagcaggcagtcattaaattttttttttttctttttgagacagaatcttgctctgttgcgcccaggctggaatgcagtggtgtgttctttgctcactgcaccctccgcctcctgggttaaagtgattaccctgcctcagacccccaaatagctgggactacaggcatgccccaccatgcctggctaatttttgtatttttagtagagacagggtttcactatgttggccaggttggttttgaacacctgagctcaagtgatccatgcacctcgacctcccaaagtgctgggattaaggtgtgagccatcacgccagtcattaaatcttaaagctccaaaataatcattgactccatgtcctacatcctgggcacactgtttcgatgagtgggcagttctgtccctgtggtttttccacactgaggttgcaagctgccggtggctctgccattctggagggcagcagccctttctcacagccccactaggcagtgcctcagtggggagtctgtgtggggcctccagccctgcattttcccttggcactgccctagtagtgtctctctgtgagggctctgcccctgggcacctaggctttctcatacaccttctgaaatctaagtggaaaccaccaagcttcattcactcttacacttgcctaggggtttaacaccaggtggtggctggtgctggagcagtccctggctgtggggagcagtgtcctgaggctgttctggtcaatgggctcctccctgacccccaaaactattctttcctcctaggcctctaggcctatgatgggatgggctgcttccttttttccattgtcttggctattagcacttggttcctttcatatttttttcttaaacattttcttctatccatttccctcactagtgaaaacacattagtagttggagtgttctctacttactgttttcttcctttatacagtacccttatcttgaattcttcccttgttgaagaggtgacccttccattcaagccagtctaacttgtctctagattctattacctttctgctttttcaggaaacttgctttatcgtttatgtcctctatatcttcacattctcagtactagttcttttataaattattcaaatctatctgatctttaaataaataacatttctctcatctgatgtcattttctaactactgtgctgtgactttttttttttttttttttttttgctattactttcttgcctttctttcagaagccaagtttctggatgaaaatgtatactttaaagctacgatttaatatccgttaaatggctccatgtagctttcgagataaaccttaacctgtcaacacaaagtccttggaccttccctactttctcttcagcctcatttcctgcctttctctttcacgttatcttcgttctagccataacacagcaaagccagttttctgaacgtgttatgctctttaagttttataccctcatacttttctttattttttataactgctttattgacatgtaattcacataccataaagttgacctatttaaattgtacaattccatgttttttatatactacagagttgtgcaatcattaccacagttttggaacattttcatcatcccctccaaagaaaccctgtgcccattagcagtcactcttcattttcccctaaccccccttgctaaccctaggtaaccaccaatctgctgtccccatagattcacctattctggacagttcatataaatggaatcacacagtgtgtgctcttttgtgactggattctttccatggtctcaaggtttatctgtggtgtagcatgaagcagtacaacattcctttttatgatggaatagtagtctattgtatggatatagcacattttgtttgttttattcatcagctgatagacatttatttctactcttggacttactaataatgctgcgaagaatatgcatgtgcaagttttatgttttcattttctttttgagacagaatcttgctctgtcgcccaggctggagcgcagtggcgcgatcttggctcactgcaagctccgtctcctgggttcacgccattctcctgcctcagcctcctgagtagctgggactacaggtgcccgccaccatgcccagctaatttttatatttttagtagagacagggtttcactgtgtagccaggatgatctcaatctcctgacctcctgatccacccgcctcggcctcccaaagtgctgggattacaggcgtgagccaccatgcccggcctatgttttcattttcttgagtatagacctgggagtgaaattgctgggtcatattgtaactctatgattaaccttttaaggatctgccaaactgttttccaaaacagctgtaccattttattgttgttgttgtttttgagacagagttttgctcttgttgcccatgctagggtgcaatggtgcgatctcggctcaccgcaacctctgcctcctgggttcaagtgattctcctgcctcagcctcctgagtagctgggattacaggcacgcaccaccacgcccggctaattttgtattttttagtagtgacggggtttctccatgttggtcaggctggtctcaaactcttgacctcaggtgattgtcccacttcatcctcccaaagtgctgggattacaggcatgagccactgcgcccggccttagctgtaccattttacagtttcatcagcagtgtatatattctttggatgaaaaaatatatatattttaataaatatacattttaatatataaacatatactttacatatgtaaaatatattttaatatagaaaatacatgtatattttaatatagagacagggtttcgccatgttgcccaggctggtaactcctgagctcaagcagtctacccgctttggcctcccagggtgctagggtgacaggcatgagctaccacacccagccgaggatgaatatattttcaaatcctttgcttattttataattgggttatttgtcttaaaattttctttattaaaaaatttttttgccaggtgcggtggctcacacctgtaatcccagcattttgggaggccggggcgggtggattacctgaggtcaggaattcaagaccagcctggccaacatggtgaaaccctgtctctactaaaaatacaaaaattagctgagtgtggtggtgcgtgcctgtaatcccagctactcaggaggctgaagcaggagaattgcttgaacctgggagacagaggttgcaatgagccaagatcacaccactgcactccagcctggacaacagagtgagactccgtctctaaaaaataaaacaaaacatttttttgttgtctatataaatttatgaagtataagtgtaattttgttacatagatatattgcatagtggtgaagtcaaggcttttagtgtatctatcaccagactagcatacattgtacttattaagtaatttcatcttccacacctctcccacctctctacccttccaagtctcctttgtctatcattccacactctacctccatgtacatatattatttagcttccacttatgagaacatgcagtatttttctgtctcagttgtttcatgggagataattattgagttgtgttttttagatattctatatgcaagtcccttacgtatatgatttacaaataattttctcccattccactttcactttctttctttctttctttttttttttttttgagacagggtcttgctgtgtcacccagactggagtgcagtggtaccatcttggctcactgcaacctccacctcccagattcaagcgattctcctgcttcaccctcccaagtagctgggattacaggcatgtgccaccatgcccggctaatttttgtatttttagtagagacagggtttcaccatgttggtaaggctgatctcaaacttctggtctcaagtgatccacctgctcagcctcctgaaatgctgggattacaggcatgacccccggcctagctgactttcactttcttgataatgtcctttaggctttcactccatcatctaggctagaatgttggagtgcaatcgtaactcactgcaatctcaaactcctggactcaggcagtcttaccgcatggccttccaagtaggtaggactacaggcatgtcctaccatgactagcttttttttttttttttttttttttttttttcttttttagagatgggatctttgtgttgcctaggctggtctcacacaaattactaggctcaagtgatcctccttcttcattctcccaggtagctgggattacaggcacatgcttccatgcctgattttttttgtcctttgaagcacaaaagttttctaattttttaaaaaaatacattttattgtgtatatttaaggtatacatcgtaacagctttattgaaatatatatactatgcaattcatctatttaaagcatacaattcagttggttttagtatatttctagagttgtgtaaccatcagaaagactaatctttctgtctctatagatttgcctttgctagacattttatataaataaggtcatatggtatatggtattttgtgactggcttctttcaaaaagttttttaattttggtgaagtcatatttatctgttttttcctttgttgcttgtgtttttgttgttatacctaagaaatcattgcctaatccaagctcataaagatttgcccgtttttttctgagagttttagttcttacattaggtgtttgatccattttgaattaatttttgcatgtgatgtgcagtagggggagtgcagtttattctttcgcatgtgaccatttgcagctttattcttttgtagttgaccattgttgaaatgactgttctttagccactgaattgttttggcacccttgtcaaaaatcaattgaccttaaatatcaggttttctttctggactctctgttctgttgtgataaatgactactacatcacttttttaacttctgtttagaatgccttatctgccctctccacttggcaaactcctagttcatgattcctctcaaatgttatctagcaaaagccttgccttccccagcaggtcttccccagcaggtcttttgcatatctttgaacacttacagcatgttttccatcaaccttttgcagttgatatttaatgtctccttcagtagttagtaagcttgttgaaggtagagactgtgcctttcatatctgaatcctagagctttaatgtagtacttgacatgtggggtgcttttagtatatttattagcaggaaaaagtggtttgtagaagtattgaattttgttttggatatgttcatttctaggtgccttcaggacatctaggtgctaatattcaatagacatttttatttattaattgaaatttgcttttatctttcttattttgtgtacttatttgttagatatttattgagtacctgtcatgtgccagggcacagtgccaggctctgaagttataatagtgaattaaacaacatcctacactcatgaagttttcattctagtaggggaaacatacagtatacaaatggtttaagacagttgacaggctgggcgcggtggctcacgcctgtaatcccagcactttgggaggccaaggtgggcggatcacgaggtcaggagatcgagaccatcctggctaacacggtgaaaccccatctctactaaaaaaatacaaaaaattagccgggcgaggtggcgggcacctgtagtcccagctactcaaaaggctgaggcaggagaatggcgtgaacccgggaggcggagcctgcagtgagccgagatcgcgccactgcactccaacctgggcgacagcgagactccatctcaaaaaaaaagacagttgacaataaaactagccaaggacatctagagcctgaaggagaggtcaacactggagatacagactttggagtcatcttcaacgaggtgataattgaaactgtaaatatgataatagacagaaattccaagtgattgaacatataggaggaataataatgcagagagaatcttgaggatatccaaagttttggggaaaaatgatccaaatgtgggaaaaccagaagagcagaatcttgggaaccaagggaaaagagaaggaaaaaaatatacagaatagtcaaagaggattaagcctatgaaagagccaagggttcagattgttagatagtcattagtaatctttagaagtaaatttcaagagagttgctgagccagtttttaaaagattaaggccaggcgcagtggcctacgcctgtaatcccagcactttgggaggccaaggcgggtggatcatgaggttaggagttcgagaccagcctgaccaacatggtgaaaccccatctctactaaaagaaaaaaaaaaaatacaaaaattagctgggcatgacgatgggtgtctgtaatcccagctccttgggaggctgaggcaggagaatctcttgaacctgggaggcagaggttgcagtgagccgagatcacgccactgcactgcagcctgggcaacagagcaagactccatctccaaaaaaaaaaaaagattaaatcctgagactttttggaaccactaaaactctgccatgattttttttcttattatgctatatccatgaatgaagatttgaaatgtatacattcagttgttattcatctctgttcttatctctatggggcttcatttttttttttttttgagaggcctgaaaatttgttccataaagaatctctttctctcagagttgttatccactgaatttctttcattttgaaagcctttgcatttttaaattccatcgatcttggtataagaatgtgtttgctttcttgggctaaacattatttgaccatttgtaaaaatagttgctatgtgtatgtatagacagttatatatggtcagctaacatgtaacttttttttcccaaatagtgacagaaatgttggtaaatgttctgagtatttgctctgatgatgaactaatgactgaaggtgaagaccagtttgatggtatgattattcatcttactatttttttttttactgtgaaatggtatttctttactgcctagcctcagtacacactattttgcaaaaaatagtcattgctttcagagactatgctatttgataagtaacaagttactttttttggatattaagatttgaaaataatttcagtgatttcatttttttattgtaatatggggaagaagatgaactttgggaaaggagaaatttggaagaaagaagataaggaaaggaaaattgaagtgttaaaaggatgtagttcttggcaaatatggacactggttagagaaaagaggataaaaatactatttgttttattagaacaatattcttagtgcatcagaagcatacctgaactcccaattttgcttttcctgccttttagacactaaaatagactgcttctaaattagtgtgattgtgttctaaaagaccacttgctaatttagtttcagattctgaaagcatttttttccacagaaacaaagttatacatggttgttgttacgtaagccaacaagcctatgtacctaatgcatgtttatagtaaaaagtaatactatagaaacaattcattttattttgttttgaaatttttatttaaaactttattatttaaatgtttaattaaaacctgagtacataaaaaggtaaacaatatataaactgaaaacgattcccttccatattcccctcatatctttgttgtagtatactttttatagttgtaatcaatatttcaatgtttccgtgtattaaacatggtctgtatattggtaagatttaatagctacgtatttctaagtccattgataaactataatgtttggctagatgtggtggctcacgcctgtaatcccaccactttgggaggccaaggcaggaggatcccttgagcccaggagttggagaccagcctgggcaatatggaaagatttccttgtctgtattaaaaaaatatatatatacacacacacacacacgaaaatttaattttcataatctcattgtttggcaactgggttctaaattatccttatgaatagcagtaaaataaacatatttgtataatagcttttattttcctccttggaataaatttattggagagaattatagagttacagaattaactctgtaattcttttagcttcatcgttttagctgtgaactaccagattgctttgcagaaggattggaccactatgaagtgcctccagcaaggaatccataaacatatttctccacaggactacctcattggattttggtcatttttacttattttcttcatggctatatagtagtaaattatagttgcttaagtttacatttctttgatttctaatgatgctaagaagaaaattactgtttttccaactgtgtaaactatccatttcatttgatcacttttcgagtaaaatctgaatgaagcctatttagaaatttctttacttacaaacaggtttgattcttaaacatttgaaagcccatttgttgaaagtacaaggtaactgtacaagcgctaccattgccatctgttagtggtaggcagagatgtgcttttattcttacacatttgttaataactgacatagtatatttattatcagttattttttagtttggatagtaaactttagtgaataataattactcttccttattttaattctctttcctttttttttttttgagacagagtcttgctctgtcacccaggctagagtgcagtggcgtgatctcagctcactgcaagctccacctccctggttcaagcaattctcctgcctcagcctcccaagtagctgggattacaggtgcccaccatcacgcccagctaatttttgtatttttagtagagatggggtttcaccatcttggccaaacttgtctcgaactcctgacctcagatgatcggcccgcctctgcctcccaaagtgttaggattacaggcgtgagccaccatgcccagccattgaatagtttcaaatagatattttgtttccctgttctgctgtcactgttttaagaatagacctgggctcagattctagttccttctaatggctctgtggcatcagacgacttacttaacctttctgagtctcagtttctctcatgttcaaagaagtgacagtaatacctacttcataatgttgtaggtattgagataatgaataattgaagtaattattgccacatagcctacttttttttagaaagttttctatttttcaaaatctgtgaaatatttagtgagagttttaattgatattatgttaattctatatctgaatctagggaggttttttaaatttttttttttaagagatgaggcttccagccgggtgtggtggctcacgcctgtaatcccagcactttgggaggctgaggcgggtggatcatgaggtcaggagatcaagaccatcctggcttaacatggtgaaaccctgtctctaccaaaaatacaaaaaattagccggtcgttgtggtgggtgcttgtagtcctagctacttgggaggctggggcaggagaatacagtgaacccaggaggcggaggttacagtgagtcgagatcgcaccactgcactccagcctgggcgacagatggagactccgtctcaaaaaaaaaaaaaaaaaaaaagagatgagtgaggtttccctatgttaccaaggctggtcttgaactcctggcctcaagcagtcctcccacctcagcctctcaaaaagcgctgggattacaggcatgagctaccaggcctggccaagtcttttgtttttccttccttccttccttcttcctttctctttctttcttttttaaaaaatagtatttagttttccaaactaagaccaagaactcttgctctatataattatttactatttcctccatttaaggttatatagtttttctttgaaaaaattttgtcattatcaagttaaattaatacatctgtattttatgttcttattactattacaactggtgtctcttattttctatctgtgtaaaagaatatactatatatttgtgggtttatcttatatctaacaaacttgaatcagcagaattattttctatgataattttaagtttgttttctattacttttaaaaatatgtcatttataggggattgatattgttatttattttctgtatttttacctttcttttattctttaaaagttattatgagtattgcaatagtatgttaaataggcatgatggtagataatgctttagtcctcttcttataataataagaaaaaaaggttccttgttaagtctaattatagtacttggttttaggtacctatgatttatatgaataaagatactgagtcatattttgagatggaaccagaaataaatataaaattttattatattctaatgagaagattttatatatcatcagtatttttcctattagtatgataatttatccacttgttattatcattcttgcattccagggatgaattgaatttgatcattaaagaggcagtgtagtttaatgaaaaggatcagtggtttaggtgtcttgtcactaccgttcactagctgtgtaatcttagaaaaggcacctaatttctcaggttttcttattcagaaactgagggaatagagaggatgaaaattctttcccactcttaaataattttaaaaattgttaagcaccatttatgacaatgtttctatgggaaaatacactgagttccagctttgaatattagaaatagatctccctttactgctaacagggcaggtacaattactcttcattgttttcactcttccagtaccacgtattaggagtagggactctaagaaagttttaggaatatgagtctgggagtttgcatggagaaatgggaatggtttgaaagagaaaagaatgttgaggaaatggaggacagaggaggagattcggatagatactaaggtttaaagtggggtagggaaagagctactggaaataggtttatttcccttccttatttgtactccctgatttcttccctctaactccctccatcttttctcctttcctttcactgtaatggcgtgccttctgttctctccttcctcttttcctacacaacggtgaaccattctatggaactggtctggggagatatctgactttagaaagaaaacttgatgggatggctgtggaatcagagtaagggtttagtttttctttggggaaagagagcgggattggagatttctgagtgtcaggaaggaagaagtaatttttgtatatttaaagctaagatggccgggcgcggtggctcaggcctgtaatcccagcactttgggaggctaaggcgggtggatcacctgaggtcaggagttcgagaccaacctggccaacatggcaaaaccccctctttacttaaaaaacacaaaaattagccaggcatggtggtgcgcacctgtagtcccagctattttgaaggcagaggcaggagaattgcttcaactcgggaggcagaggttgcagtgagccgagatcaccccattgcactccagcctggttgacagagcgagactcggtctcaaaaaaaaaaaagctaagattaggtaaaggcataagactgttgttaagtggtaaatctttggtgctctgtattgtttaatgtatgtgtggggtcatttttaagacaaaaatttgcattaacactaatgtataaacccacatagcatccgttttagaagtgttaatcataaaagagaatttttgaaaactgatttctgtgatatttaggttgcatgcagttttttccaggtgtttatcttttgtcttcagtttggtaaagggaagtacataatccatatgtgttgcagtttcactaaaataaatacatttcctataaaggaataatatatctcagcattagaatggaagatatggaaagctcaaatgaaaccaccccagctgcctactcttagaactgttacttgatttgaaacaatctgttgctatttttgcaaaaagatgtcccccaaatttcccagattggactggggacagaaagcacatactgttgctcctgagtatatgcaaaagttctgcaattcagatttaggaaatcatgtgctcttgttagggaatatgggaggtttagcttttccttcgttgggagggggtgaggttttctactgaggcagtttataaagttacctacatttctctgaatgtactacagattttgcagatgttggtgtccttgaagaaccacacaagtttgtatttcatttgtgtcattaccttttacttaacatacttccacaggtgacacatttccttaggggtatgactataaatgtgcaatatttgttagcagtcttttttcagtcttatgtgttttcacatgtttttttctgtccctaattatgtctgcttccatcagatatgatagttattctgtccataatttcttccatgcacatgtcttttaagaaatctttactttagagttctacctagttgcatccctctttattcaccagattctacagtactacatttttcaaatttccaaatatgagggccttcatttttctctctttctacattcattcttcagtaccactgccaagttaaatctctatctttttatttgtcccaaccaccttttctccatcattcacttccttttttctggactctccatctgaagaacggctcatatatggcaataaaaaaggtacagaccagacagagtaacattgttttgaaatatgacttcataagttatcttcatgtccatgtaagttagcacattcattgagtaatgtctatgcagagtcctcttgggccttgtgcaaatttagcttaagttttatctgtgttagtgtttggtatttttagaagtcatattccaagatatctgtctttctgtgcatggaaatattttccctccttttcattcctgttttaaaatttcattcttttgcttatttgtaatgttttgtacttttccctgcatgattagggttgtttgattgtctattatttcccaaagaaatgttactgtgaccatttactttaatatgatgcatgatgtgtttgtagactgatttaaaatcctgatttgtacagtgtttttatattcctgtgaatttttcatttgatatcagtatagtttacatgtcatttggttttatagatatagaaattaaatctgaaaatatgaatgtacttattacagccatcctccccaacaccctactgcttatccccagtctagctactttaaaattctgtcaattttaaaacaaaatgtttataatcatttattagaagagaatcagacttaccttctatccttgaacaagtcacttaataacctcagtttctttgtctataaaatgaggagattgcactttatagtatctccattgtctcttcaaattctaatattctatgattcttatatttttagtttttgggggtttttttgtggtttttttttttggtattttaaaaatacctgtttagagtgctgtggtacccaggtacccacacagttttggacttgtaaaagctgtagcttcagtgctcataatatttaccctttagaagatcataaacatgtcatggagcctatttttttcccctaaaatatgtcttttgtttctgtctttcaagttggatttctttttctcttttcttgcagtcagatccagtcattatcttagtttttaattatatgtaattgtggactgcttgaattttaaatgagatgttctctcccagaagacttacagttgttcagacctctgtatacctaaggccccttttgaattagtgtctttagcctttccttaaccttctcctcaaccatggtgcttccatgtgtgttttcattgtgttgaagcacggctctaaggaaccacacttttgggtccagagtgattctagttgctatatatgaaataacaggactgagattgatgttgttctttctggaggccaagggaaggaagataaaacctttgagtcattcttcagccaaggatttagttattttggtttattctcttctacatcagttgtagacagcacagctaaccctttagagatgaagcagtagtgatcctttagccatgtttttcttgttgcttatgtcatactcacctagagatgtaaaagattgtatatatttgcatgaccttaggagcacctggtacattaggcacctggtgcattgttgaaatgctggtatggcccttagttcaggattacctgcacagtagctccttcatgccattcattttagaccaactcaaagcaaagaagcttattctgtcatagtctgatgggatattgtcagcctgcatgtcaaatactttgtgatagttaaataagactacaggactgttagaaattcttgtctgttagtctgcatgccataggctgtcatgaaaattaaacagagactataggattattatcagtttttgccctctggtttgtaatgcaagttgggctcaagtttgtttgtttttttttccccattgctgttttactgattagccagtagagtgaaatattaaagtttgtggattactttttatttctatatttatcagaccccagtattagaccaatgctgagctaaacattgagagagcaagacattttttagcatgagttcatctagtcccctccatgtaagctggtggcaggggtcttggtactggtttagatgagtgtggaacaggctaatagaatattgtaagcatgcatgccctaaacttgagcctttctctctatttattccattgaaagtaggttcagctgcagcccggaaagaaatcataagaaacaaaattcgagcaattggcaagatggcaagagtcttctctgttctcaggtaatgatatattttcttgattatttgttttgcagaaattacgtttattgtaccttgttacaagcattgtcccgcatctaaaagcaaaatggggccgggtatggtggcacactcctgtaatctcagcattttgggatgccaaggcgggcggatcacctgaggtcaggagtttgaaaccagcctggccaacatagtgaatccccatctctactaaatatacaaaaattagccgggcgtggtggcatgcacctgtaatcccagctactcgggaagctgaggcacaagaattgcttgaacccaggaggcagaagttgcggtgagccgagactgcgccactccagactgggcgactgagcaaggctctgtctaaaaaaaaaaaaaaagaaagaaaaaaagcaacaagcaacagggtatcattcttcctataaagaagttacttaggcctggccaggcgtggtggctcacgcctgtaatcccagcactttgggaggccaaggcaggtggatcacgaggtcaagagattgagaccatcctggccaacatggtgaaaccctgtctctactaaaaatagaaaaattaactggatgtggtggtgcatgcctgtagtcccagctactcgggaggctgaggcaggagaatcacttgaactcgggaggtggaggttgcagtgatctgagatgacgccactgcactccagcctgggtgacagagtgagactctgtctcagaaaaaaaaaaaaaaagggtacttaggcccttaggctgggtgcagtggctcacgcctgtaatcccaacactttgggaggccaaagcgggcggagttcaagaccaggctaggaaacatggcgaaaccccatctccacaaaaaagaatacaaaaattagccgggcctggtggcatgcacctgtggtcccagctactcgggaggctgagatgggaggatcacctgagccccaggaagttgtgagtagtgagccgtgattgtgccgctgcactccagcctgggtgacggagtgagaccttgtctcaaaaagaaaaagaagtttatatatttgtatactgaagatgggaacacaagtccctttgaagctaagatttttgactctggtgattgttattgctcatctttggtatctcttttccgtttgtgataacactaaattcacaccttgaaaattagagcaggataagaaggaggggatactttttagagtattcttgatgaacttgttcatccatataggaagtcccttgtgctggagccataaattgccttccctggggttaattcaggaagaccaggttaaagggtacaaatgaataggtcagtctttaaaaatttgtttgcacaactgactacatcagacatttgaacttcagagcatatgaaataccatattttctcaatagtatgatgccccttgatgaatcttaccacatatttaataaagcttttcaggaaaaacaatatatgcctcaatggtaaggcacaccctcatacctgaaacacttaaaatatagaaaaattaatgtcttgaaattgaggaaaatatggtaatagcaatgaatgtcatgaattttatatatggcctatatctagaccctatgtcttcttttaaattaagtacttgttggaagtatctgatatttgttatatctctctgctatagggaggagagtgaaagtgtgctgacactcaagggcctgactcccacagggatgttgcctagtggagtgttagctggaggacggcagaccctgcaaagtggtaatgatgttatgcaacttgctgtgcctcagatggactggggcacacctcactcttttgctaacaattcacataatgcatgcagggaattccttctgttttttagttcctgtctcagcagctgacctagacagggtactgtattagctagtgtctcattaatacctgatcagggcagaaaactgatagaatgggtattcctttcaattgaaaataatggtcagttcctcagcttttcatgaaatgatatgggagcagctcatatcataatgtctgaaatatttatttattcatctgtctaattcacccttttcttttaaaagccccagtttcagaatgtgaatcagggatattcctgttactaaaatggaaatgtaattccaagtttcttttttaattttttaaatttatgtcattgtattggactatgcttatatttaaaactacttaatttagagttaactacctgcttaggccccagaacattacttatgcccttcagttaccaaaagatttgtgcaaggttttgtaccctggtaaatgatgccaaagtttgttttctgtggtgtttgtcaaatgttctatgtataattaactgtctgtaacatgctgtttccttcctctgcagatgtagctgctttcctaaatctgtctgtctttctttaggttagctgtatgtctgtaaaagtatgttcaattaaattactccatcagacacttgtctgtcttgcaatgtagaagcagctttgtagcaccttgttttgaggtttgctgcatttgttgctgcactttgtgcattctgaacatgaatgtaacattagatattaagtcattgttataaggggttgaatttaaatcctgtaagtcaaaattgaaagggtgttattaagtgtgcctttattttgcatgaaaataaaaagaattatacgtaaagcattcctgtaatctggctcattgaatattttatacttaaaaaactttttttggcgtaaatatttgtgtaaatactgggttaactttttaaaagcccattacagattaaatagaagagagtgatgtgagtattagtgaccatacacagtaattcagtctagatttcttttcctgtggttggaaagcaaaaatacatgatgtggaaaagcctgaatttcttgtagtcacttttgacagccctctaagggtcattgtctattaaaatagcaacagatctgatgttttccttagtcataattaggtttctttttggtgttgtaattagtgacttttttagagggaaaaaaataggcaattttaacgttttgaatgaatttacatttgacttcacaatttcatttcacttggttccataataagtgctctttttttttcttttctctcttctcttctctttctttttctttctttctttctttctttctttctttctttctttctttctgtctttctttctttctttctctctctctctctctctttctctctctctctctgtctttctttttttgtgtgcatgtgtacatgtgtgtgtgtgagagagacagacagggtctggtttcttgctgtgtcacccaggctggagtgcagtgcagcctcaacctcctgggctcaagcagtcctccatttcagccacccaagtagctaagaccataggcacatgccaccacagccagctaattttttttattttttttattttttatttttttatatttttgtattgcccaggctggtctcaaactcctgggctcaagcaatcttctgacctcagcctcccaaagtgctgggattataggcatgagccactatgcctggccaatgattgcttttcaataaaaaaaatttttttcctgtaaacaatttttacttgtagcctatacatgttctattttaaatgtcattgtattgttcactaccaccactggtatatctgaaaagtacactgtgttttgaaattataaattttcattctgaatgaggtttctttttttgattttctttaaaaaaaaaaaacaacctgctttgatttgctttacattccttgccctccatttttcttattatattgtaaacattagaaaaatgaactaaaaagaatttcatgaatgtacattaaaacaagatcttaaacatttgataaaactagtaaaaatgttaatagaaaaggatgaactttaatagcttcaaaaatattatactcttctttgttcagaaaagaaaaataaaaccaaaagggtatcatacttaaataaatctacagtatagtcatctctcagttatccttggatataacattacttttatattgtatccgcagcaaaccttgctttcagatttcacgattagcccctgctaattacatgctttgttgacttctgtttattcttaatttgtacacggcttgaagctcattccttcaactttgaaaccaccctcaactgcaggggaggtttgaaagacagcagctttgctggagggactctctattctcagcatggactaagttactggaaggaattgagtttaaggggtctaatttgggaccccttaaactagatagcttctagttttgctagctcttgatagtgtggtttgggcatttggtcaaaattattttcctagcataagataaatccactttgaaacaaataacaaaggtcatacaaaagctgcatgtttgtgattattttttaaaaagttatcctacattttaaattttagtagataatgttccctgatgttagtgtgtataactgagagttaggtattgcaaaaggaaaaaattttaattctaagacctcgtgcctatttgtcagaaaataaaaattgtcgtttcaagaactttaaaagttaatttacatgatgtttcttgagtgtttttacaaactgcacaactctattggaggtggattttctgttcatctttattttatgtatgttttctttctgggaaatttgattgggagctagcactgtaatgctaccctcaccaggatctatatgggaaatatatgtggccaattctatgttagtaataccaaattcctcttggtcatttatcttgcatagtactgaggaacacagtttgagatagcactatgctcaaacttattaaggccatgacaagatgccctatataactgaaaacaaatagaggagaaatagtgcctttcagatagagtgttgcaattagcaatctgggctcaagtgatcttcctgcttcagcttcccgagtagctgggattacatatgcacaccaccatgcccggctaattttttaaactttttttggggggagatgaggtctctctatgtgttgcccaggctgggctcaaacgctcaagggatccttccacctcagccatccgagagtgctggggttataggcatgatcttccatgtcctgcccgatttgtaatgtagtttaacagttaaggaaaattaactcttcctttattcagtgttcgtcctaattcttttgggtccccaattcactttactgtctggttaagatcaacattttctaacttagttcactttaataccttagattcatcagtttcttttacattaataattgctttggataaaattatttctaaatcatgttaattgctaaaagatcacttcaggaataattattctaattggccttattgcagaagaagcaaaataggagagaccagggcattacttttacaaatattctgagtaataaggggaatggacaatattgtaaaccagtattgttgtgtgctatcttgagtcctggtcctcagtgtgagctctttatacagttcaaacccagaaatgagcgaaaaaaagaatctttgactataaaatgtttgactaattatggtgaaattctctaaatggaccagtgacacactataccaataatgtatttcttatttataatatgacctatgtgtctatatcatgaaataattagaatttatgcctgtaagacctcacttctcttccttaatgtctctttaattggtagatgagtttgaaaagatgctcagtagtctttttctgaggcaaatttgagttcatgataaactctgtcagtataaatggaattttttaaggctatagatgttagtatctgtaggtatttggaacatcagtactagaatagaaaggaagttactggtagacaggagaagtcctttcaggtcccccacaaagaacagagccacagaactgttctacttatagtaattcatcaagtttactgcccttaaatttcactgtagtcatatcagctcttgcagcttatgttttgccttataaattacaagtaacaggtaaagcattgctgaccccttctagtttatgtcttagggaaccaactggtaatgagtattgttctcactgacatgaaagaaaagacttttctgtttgcttttctgctacaattctattataattttaccctagagcattttcctgtgattgtgatggatgtgatataataaacataatggaaaattctaaggccatcaaattactgattcaagatgggtaattaatactggagtgcatttgcatgggtgctgaggtgtctgtgtttacagtaggtttatgtgttctgtgctctgagtgatgttgtcatagtgctgtgtgtaaactgtgctgtgtcaggaattgggggtttggatggggctctctaatttgggtactatttatgttaaattttaaatgatgatgtagtatgggatactgtgatattttaagtgatcattgccttttctgctgtacaatatgacccttctcatctctctcattcattttgcatgcctctgctcacttctgtacagccacagttgaggctattgaggctgaaaaaggtatgatcagagtccttgtgctgggcagagatctgtggtgtgtgggtgggcatcagagaatgtcctgtgggtgtgttttactcctagcttttacagcccaagatgaatcagactcactgattcatcaagtttagaagccttgcagccctctttttttaatttttcatttttaaatcagaagggctgatgtctatggtgacagtctttttcttctttccggtgtaatatgcaatcagaaagtaatgtttctgatttctttagagtatagcatgttatgctatacagtatagctttataaagttgcctgttttaatggaaattgccaaactgacctgcaaatagagatctgttccatattttgcatgattctatgctactcagattttttttccctaagtgaatcctcctctaggtataggtgtgagtttgtttttacaaactagtgtgcctgactgagaatacaggaactgtcactataatgattttcttttttcttttttggccgcagtttgggctatagtttatggataagattatgttcatatatatatgtgttggcttggtatttcacattcctcagtgtttgtagccccagccatttgtttggttcatgtgccagactaagacctaaggattgcagatattaagcaaccagattataaccagtggtttgaaaatatttcctatgaacactttaataatggaggatgcatcattctagatgaagtgaatgagaaaccatacaattggtggagaattgccatttattttgatttgagtttccaaagactgtgcagtatggccaatgaattaaggagaacatcttctaaattacgagattataaatacttttttgctatcagccatacacagatctaactcttggaggcacttccacctttttaatgttatattggtggcgatgggctgaccttgacctccaagatagttctgatctactgtattttaacctttctttaactctttctcctcccaagctcttggtacagatttgtatattgaggattaaccttgtttagcctcctcacttgcccctactctcattgctgccttactgtgatagtcactggtgatcttagggactgatgtaggagataattggtatagtagaagtcagactgagaccctgagaccattgcctggaggttgattttgggggcaggagagggttaacattttttttgtatttttattttttggaaggctttgctaacacttgtcacctataaagctatgatgtttatatttaggtttaaacatttcacattttaaggaaagactgaaatgaggataggattcagttaaagtaagatttatgtgttgctacttacagctactaatttctttcttcttaaaaatcattaattatgtttttgaaatctcagaaatgtttttcaattactgacttatcaaatttgcattttattaagcaatacgaggattctctccaccacatagaatctgcagttttgaagaggcaaagggtttggataggatcaatgagagaatgccacctcggaaagatgctgtacagcaagatggtttcaattctctgaacaccgcacatgccactgagaaccacgggacgggcaaccatactgcccagtgacccactacttcccagggactctcacatctcgggccccaaatggacagatcacccgaggagctggaggggtcggccaagctgactgtaaatttcacagtctctctgaagaaaccattgtgcttctgagaccctagcccccttcctggatggaggcttgagggccctgggacatgtgctatctgataagattgggtcatcgctgccaaggtggagagcagtgagcaaggggcttggggcaatttccagtggagggcatccacacctccattttatgcttgtggttcacacatttaagtttacaaatcagatttcttttccccttcagtagaattagattttgtttttcaatcatgatttcaaatgcaatcctaagagctaatgtggacttttctttttccatgaaatgtctttaaaggatgaattagcatggtcttaaaatacatttctgaggttactagctgtattttgaattgtgagcaaaatgccgagaaacccagttggcatttatacaaaatgttgacctcaggtctatagttcttaaatgtggctaattctgtaacatagtcttggtattttttaattatgaatgcatatcctatttccaggcaggctctcttacttgaacacaaatccaaaaactaatttagagtcttttttgcccagatcttttaagacttacaccccagagatttaagaagaaaacctctaaatttcaaaattatgaagaattacagaattactcatttaaggtactttaaaagaagtttgtacattgtcaaagtaaattttaattcaaatcatgtctgtaaaacttgacgtattttgtgtatgcatgttttcattttgcaaatatttaatatatagacctatgatgtacaggtacgacatgtataggttacctagatgttatgagaaattttagtttattgtgagtactcaagttgcttagagagccaccagggtgatttgctgctggctttctatcatttttatgttttaatgcaaaggaaattttaaaatgttctggaagtgtttttgattaagcaatgcagcctagaagcaatggttctgttcaatcattcagatgttagtggaagcataaaagtcaagactgcatgttgaaacctttcttttgatagttactgaactgcttggttaaactaaatggaaccatgtgctaatttttcacaattattgacctgtattgattgccactgtagtttggtatttccctttactttggtggcctgcttccctcatgccctggaatacaactcagagctccaggcagcggaaccatctattgttttgtttgccagaaagtgcaccctgtatggtctcctgtctaagttggaaatattatgcatgtgcaggactattcgagtattttataaacagtagcacacaataaattccatgcatgggccgctgctcct

SEQ ID NO: 36164 - DNA, 6603 bp, Homo sapiens
gccggtcggcgatgtccggctggagctgtcgcctccgccgccgctgctgccggtgccggttgtgagcgggtctccagtcggctcctctgggcgtctcatggcctctagcagctccctggtgcccgaccggctgcgcctgccgctctgcttcctgggtgtctttgtctgctatttttactatgggatcctgcaggaaaagatgtgagcgaccccgggggcgggccgacagtctctccccagcctgtgacagggatcccgggccttctgcctctggacccgggctttcctcttgtcctcctgcccggctgtcgccctcttagcaccctactacttttgcagctatggctgagcctacccagaattccagaactccaggattattttctggattcttcggacttggttattttcttttcttagctgtttttccccgcttggttctaagggcctgcgttttacaggctgagacttctattcctcaaacaggacccgagtcggcccccttttggtactcccagatgcttgcaaacaacctattcgtcctcggccttggtgccatagccgaaataccgtctcctcctgcctggggtacctgatttcactatctcgttctgcatgtttcctctccgtctttttcgggtattcttttcttaggctttggaatcagtaggctgggatgtctagtttctagatccagtaaaatcagccccttttgcaaatgagcctagtggtccttaacaaactctgcctacatccagagaggcaagataattttaaagttttcagtggctcgggatatattagatgacagtgagtgaaatacactaatttctccctcttttctcatgcatttcatttctagaacaagaggaaagtatggggaaggagccaagcaggagacgttcacctttgccttaactttggtcttcattcaatgtgtgatcaatgctgtgtttgccaagatctgtgagtacccagatagtaatttgttgggtaccccaccaccccaagttccctcagtatgctgggcattaagcattgattcaaccttaaaggctaactcatgatctccaccccattttgtacttacacagcctctctgtgaagtctgtaaaactaatgactttgaagtggagtaaaatattatttccccaatttttatcagcttctgagttagaaatgttcagagaatgggtcttctatattccaaatccccattgaaaatacttaaaacatttttttctttccctttgagtttcttttgtgtgtcagcttcaagcatgctttgagcattctctctttgttccctggggactagcagcagagctgactggtcccttgaactgaatgaggcccccacctccaccctgcatgtggtcttttgttgggcttaggtagaattggaaagatgaataattttcagagatttcccagtgtaacaggacagaaatagcttgtgtcttgtttgacagacaagttcctttcatgtggcttcagctttgcttagtggtccatcctagccccaccaggtttctcttgtttttttttttttttcttttcttttctttttttttttttttttttgtcttctcccagtgatccagttttttgacactgccagggtggatcgtacccggagctggctctatgctgcctgttctatctcctatctgggtgccatggtctccagcaattcagcactacagtttgtcaactacccaactcaggtgaaacctcagggtgggatgatggttggctcagatatcatttgaaaaggactaagagttcttccctcaggtctgtgagttaaaaaaaaaaaaaaaaaaaagataacggtcctgtaagacattgggagtgtatagaaccatagaacttacgtttagtggtggtgggttgggccatgatagggctgctttctgaggctgaggtctctggtgcaggccctgtgcttactcatcttaatcagtgcggtacctagcatagtacctgacacatcacagatgctcagaaattatttgctggatttaatttcaggtccttggtaaatcctgcaagccaatcccaggtaagcaaagaagatggtcttcctcttctgtcgtcactcttcctatagtaagctctctctctgctacaactgtgtccctctcggcttcatcatcccatcatggctgtctccagggactttcccccagctctccctgctgcccatcctgtcatctgtgtcacttcttgtgatgttcataggctggtaatccttaataggagctaaaggctgacctagcctgcttcacttggtcagccatttctgtgttgcatgtgtttatattgtcattagacaacttaattcccattttgatcatcagtttctttatctcaacttcttttccttctccactgttccctacccttgtcctgtcccttcctggacttttcacctttgttctctacctcctccctgtcttatacttaaccctgttgctcaatccttatctaggtgccagcctggcaccctccttttgtcctctctaagccttccttctcagtcattcttttctccctgagtcttttcttggttcctgggagggagggcattggggtcatcaataccttatggatgcctgaattttccactctgttttttccctgtagtcatgctccttggggtgaccctcttgaagaagaagtacccgttggccaagtacctgtgtgtgctgttaattgtggctggagtggcccttttcatgtacaaacccaagaaagttgttgggatagaagaacacacagtcggctatggagagctactcttggtatgagatcctgttggggaaggcacccttttccagcaaacttaaccaaaggatagtctcacctaggcaggtagaaggccagttctgtgtcaagggaggttgtggtgctccttgtccccatatctgctctttgctgcaggcccctgactctattaatgccatagtgggaaacctgaaatatttaactacaactcagctctcattctggagaagagataactctgagggttgtggctgaatcctggtgtgaggtcacagagacctgagagcaaagagggaaggaataatgtctctcactgtggctttccaagaaacctggaagccagagtttaaaataatatgatagtagctggtatgtatgcattaggcactgttccgagtgttttacatgttaattgactaatttttacaacaataatctcatatgtagtattatctccattttacagatgaagaaactaggcacagagaagttaactcgcttgcccatggtcacttggctatttgaagtggtagagtcaggattccaatccaggcagcctaagcacaggatccggtctctggagcactatactccaagctaggaagctaacctgctgggactacctttcccctcccagtatgttgggaagtgagcttcctgctctactctgattacaaaatcactacgtagctcagttagcctgtcagtccagtgcgtgggccggggggcgggggtggggggtagtgagcatggtctctccccaccttccacctgtgaccaaatggcaacgttttgttctgaggactttaaaggcagtggctttccaaggagcctgagagtgagaatcctgtgtcctgggtttggaaagggccctgttggccacttcactgcaggctgcaccctttctttcccagctattatcgctgaccctggatggactgactggtgtttcccaggaccacatgcgggctcattaccaaacaggctccaaccacatgatgctgaacatcaacctttggtcgacattgctgctgggaatgggtgagagccagttctgctgttcttcccatgtatcaccagagggcaggctgccctcatccttttgatccctctagctgttagttgcccagaccaagggcctgaattagttccaagatgcccttttgttcaagcccttgagaaaccttcctggaaaaacctgcaccagcaggatttgtttgctacttgttactggcacaatgaaggagagtcgtgtgtcagttgtcatgggaagacactcagtagtaaaacacagggaggtacctgggaactttccctttcatgagggaaatgagacacacgtagtgctcacaggaaacagagttagctgtacactgaagacagttcaaatgtgaatgatttgctttgaaatcagtgcttcctaacttttcaaatttgggcacatgtagaaagtattttttatacagcacactggggttaatggtggaggctgctgatggctgaaggtgactaatgcgaggggcttccttgagctaaggatgtgtgggtcagcatctctacagcatctgaggatttctgcttgtaatcactttggtagaagtaactcattaactttcaagcctttctcacaaaattctctttagtttctctaatcagagaaaaatatgagaagaatcaatgatgagacgatgcaaacccacaccatacactttcccgcgtcccacctcccttgcagttctttaacaggccatgtgcaggagtgtctgtgtgtgtgtgtgtgtgtgtgtgtgtgcgcacattttgtgtgcacaaaatgcgccgtacatttgttgacatgtcttctcaggaatcctgttcactggggagctctgggagttcttgagctttgctgaaaggtaccctgccatcatctataacatcctgctctttgggctgaccagtgccctgggtcaggtgagtgcttgaaaggggatggcttggcttccctactctggcagctggttccctaagaaagactggcctggctggaagaagagggtggcaagattagccctgaggtctgtttatagactttagaccaatggcagatacccagaagcccaccggacctcacctttatctttctctagagcttcatctttatgacggttgtgtattttggtcccctgacctgctccatcatcactacaactcgaaagttcttcacaattttggcctctgtgatcctcttcgccaatcccatcagccccatgcagtgggtgggcactgtgcttgtgttcctgggtaagtggccacacagagacacagtgacagctgaattttttctcctaaaatttacttgtatatttatgaaatttgtttaaatattttagagaaaacttttctcttttttttgagacggagtttcgctcttgttgcccaggctggagtgagtgcagtggtacgatctcagctcaccaatcgggtgagcctcctcctcctcctgggttcaagcaattctcctgcctcagcatccggagtagctaggattacaggcatgcaccaccatgcccggatgattttgtatttttagtagagatggggtttctccgtgttggtcaggctggtctcgaactcccaacctcaggtgattccccccgcctcagcctcccagagtgctgggattacaggcatgagccaccgcgctcagcccagagaaaacttttttaaaagagaaaagaggctgagtgtggtggctcacgcctgtaattctaacactttgggaggctgaggcaggagtatcgcttgagtttaggagttcgagaccagcctgggcaacatgatgagacccttgtctctgcaaaaaaatacaaaaattagctgagcatggtggcagacgcctgtggtcccagctactcggggctgaggtgggaggatcgtttgagcccaggaggtggaggctgaggtgagctgtgatcacaccactgcactcccacctgggtgacagagtgaaaatctgtatccaaagaaaataaaaggagaaaaggaagctttatttctaatccagccttcctagggtctccctctgttgctcaggctggagtgtagtggcatgatcatagtccactgcaaccttgatctcctggactcaagtgatccacccaccacagcctcccgagtagttgcgattataggcatgtaccacaatacctgaccaatttttttttttttttttgtagcgatggggtcttgctgtgttgcctaggctggccttaaactcctgggctcaaatgatcctcctgcctcagtctcccaaaatgctgggattgcaggtgtgagtcaccacattcagccatagcctagaagttttgactcttaaatttcttttagtcttgctgtattatatatgtatctatatctatctgtatctctatatagatatatttatatagatacagatatctgtaataactagtatcctggtgccattctcttgtctctgaggaagttacataaaaccagtgttctgacatgtattttatttaaagcccccattttggagatacaaggccgactaccccaccccaccacaatcattggtaagtttcatttccccccataaggctaagcccattttcttccttttcataggtcttggtcttgatgccaagtttgggaaaggagctaagaagacatcccactaggaagagagagactacctccacatcaagaatatttaagttattatctcaaacagtgacatctcttgggaaaatggacttaataggaatatgggactgagttccagtcttttttaataaaataaaatcaagc

SEQ ID NO: 36165 - DNA, 26664 bp, Homo sapiens
aagcttgcaaggcaactggcccgcccccgctctgcgcctgtctctcggccacgcctattgctgcaggatgacgcgcacctctagaacccgccccggaggggaggggacgcagggaagagtcgcacggacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacaggtgccgcccacgccctccctgccatctcttctcccttcctccctcccttccttcctccttccttctttccttccttctttgtttatatccattctttttacccttcctctctcctaccattccttctttcatccatcattcgttccctccctccatttttcactccttcctaccgtcccttcatccctcccttccctctttccatctattcatccatccatctcctatccctccgtgcttcccttcctctttccccccatctttcccatctctatccatccatctttccccctcctttcctccctccattggtccatccgtcccttttaccttctatccattcatatttctctctcttctcccctccttctctccatcctttcttcccttcagctattcatcttttcctccttatcttcctccatccaaccatctgtcctttcctgcatacatcattctctttttttcctaaattcatctttcctttccaccatctttcactcactatctcgcttcctcacccaggttggaggccatgaccaaagcctaaccctgccacccaggactcaggcttcctcctcgagccccactcccacccttgctgaggcacagcgccctccctggctaggctgttaaggtgcagggtccagccttgggcctcttagtaacctagcacctaccatgagggagggttcagtgtcagtgcaggttacctcaccaaagcccctccctcctgtgtagatgctctgaacgttcttctcatcatcgtggatgacctgcgcccctccctgggctgttatggggataagctggtgaggtccccaaatattgaccaactggcatcccacagcctcctcttccagaatgcctttgcgcaggtatgtctgggaacctctagctgtgggtgtgtgctgcttcgtgcactgagggttgggggcggggagcttcagctattgtcagatggcacagattgtgcgggacatcttgttagagggaagcatagtctggaaaatggtagtggagaaaatctggttttccactcatgggaaagcttgaccttcaagggtggccttctccttgggtgcaaggtgcgccctggccctgatgtgttcatggcagccctggccagctttctcccagaacgggcgcttgcctggtgctcagaaggaaggggtgctgcagaagggcacccacaggtctgcaggctgggcctcaggtgagagctagccagggtggccctgctccctgaaccccctcatggctctgcccccagcaacactggccgctctgtgtgcctggggaggccattgcgtaggaggagataagcatctgctggtttcaggggctgattgcttcccttttctctcccggaagcagtctgttgcctaggtgacacccaaatcccagtgtctggtttgagctctgcatgactcagctaccaagctgtttgctaggagcctcgggaggcggttgcttggttacctaagagatggcagacatgttttgctgtggcgatgcttacctctgcttctgctccctaacagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctggtactgctccatgtccagagtctgggttctcttggtttgtggtgtctgaatccagcattcccatcctggggatggggctgtctttgcagagccctcttctggctgggcgagtccctcgctagtcagtgcttcctttctaaaaaactgacttgtcaacccagccacgttttcacccaaagtgaaaaagggtagaaagagctttgcttcctttcagaaaccactgagggtgtgctgttgggtctttcagctcctcgggtggtagggaggacacaggctggggaggtggcagtgttgggtggagtccagctcagggccccaccctctcccctgcagggtacctgtcagtaaacctaggggtggggtgaggacacctgagggcctcccgtgtggccagcattgctgttgctgacttattgcccaatgagggggctgtgcttaggtaggggctgctatccactctggaaattaagtcagaaagatgagtgtaatctggtacccaggatctatagggtcccagagacggacattccttacctcaaatgctgcctgataaactggctctctttaatgccaatatggggatagtgaaaagcaaacaaactttaaaactttttatttatagaagtaatgcatgagtatttgagaaaaaaaatggagaaaaaagtattggaagacaagagcaccatagggacaataatgcttatcatttgggaatgacgaatgttttcagtctctttccctttgctcagtggttacaccggcaggcttggcagccttctgcaggagctcagctggccagcccaggttgagagtgacattcagctctactaagtcaggccagtttcagaggtgaacctgtcaggaatcatattgcacagccaaaagtccagtgtcaggagaactttctgcagtttggtgttctcattaccataccccttgcccaaatgcagctggagggaagtgatgattttggagagaggaggaaacacagcagagggaggagattgtgctttgggaggggaaaccaggcaaggactgagtgatgttgcttgacctcctccctcctgatgattggattttggcaccaggctctaagcaccatgtccttctcagagaataaacctttccctgcagcccttgtgggaacacatttttcagctgaatctttgttctcaagacctttttctgttagcattgggcctgcttcaagatgacagtagccaccactgtgtgccaggtatgtaccgtttaccatgctggccactcctttaatcctcccaacagcaagcaaggtgggtttttatcatcatcatcatttcccaaggaagacatgaaggctcatgggagtcaagtagcttgccagaggttgcaaggatgctaagaggcagcatcaggatttggacctgtggttgttggcttcctgtgtgctctttccacagtgcttgctgtcttcataggccctccacccgctgccctctttctctccattcctgtctcttctggtactccctatgggagtcccactgtgtgactgctgctgatgctttctcacgaggttctgcctgtgatcccctccactcccagctaaccactataggcagcacttcccttcagatccctcacaggcctcactggctcctagaagtcctccctgccagtcctcacctgactcacaataacctctgtgcttggaggatcccccacttggcacttcgatgcttttgaaagctggaagtccttccttggtttccagtgctgttatactgtcttcacaaataaactataaactactaagcttaagggtgggtttctgcttcatgaatgagcacttgaacttggaattctaaaacaaggttttgagtcctggctcccttatctaatatctggttagcataggtaagtcacataccttccctgagcctccctctcctgcccccatcggctccctgatggtgctgatgcctctgctgcctccttcatagggtgagagataggtttcagcatgggctctaaggagctgactgatcttgtccttgtgggtcccttccacagagcctagcacaaatcatcagggcttagggaccaggaagtcagatgcttagttctcaaatagaaactagagagtttggctttagaggggacttttgtagatgaggaaactgagccccaaagaagggaggttccacttgcccatttgtttacagagttttaattatggggagtggggtgttgaaagactcatcatgttttaacaacctttttttttttccaagggatatcttctaaccataccgatgattctccgtatagctggtcttttccaccttatcatccttcctctgagaagtatgaaaacactaaggtaaggctgtgaaagggacatttctgaagaggaaccactttttcctttgtcacataaactactgggtatactgcatgttctgtgaagctggttatataccacgaagttgtgggtttcatttgtgataatgttttgacagaagtaagtgttgggatcttcagcattaggcccgacaggagcagtggcttcattctagaagctggtgggtgctacttgttctaaaaccttgggctctaacgtgtcagactcattgaatagctccccagtgctcacgctggatgagactgagagttgtaggagatgctgagacatgggagggagaaaagaggctgagctccaggagcctcagcccagaatgggagaaaggcatgccgtgtatctgtctctgacctaatgtgtatgttcagcagctgagacctctgataggggttttgaatttttagagcattatgaaaaaaagtaacctacaaagaaaatcttggtttagaggaatcccaaatgtataaatgaaactaaaacccacatttaagaaactcagaaaaccagctggggaactgagacatgaaatgtatctctgaggttttagtaaacatcgtgttgggaagggtgaggatttggaagtgaggtggaaggtattgttctaagttcttgacagctttccatttcagaatacagtgaaaactgtgagctctggcctttggcttgtggcttgaatagggaagatcccatcttaattccctgaagccatcttgcttctttttagtggcctcacttacgaatgccaggtccctgccctaacttccccctacccatttcttctcaaagtggtgggtctgacaatactaaatctccctcgagtgctgcaaatcgtgtatatatagatgatgaacaagtggtctgaggcgggtgctgggctgtcctgcccaagggtggggtgagcaaggcagggctgtgaaaaggcaacactctttgagatggaacagcagctgacacagcccctcggtctttgtggtatacaaatcatggtcagaactaactttggtctcacggccagcatgtctactttaggaagcaaagcaggaggtttcattctgtgcctagtgtagctgaagttctggaaattccatggactgtcaccttatcaagttgattgggaccctgtcacttacaagccttagcctgtctttgaaatttgaaatgggttttttttttctttttaaatttttaattaaaatagagttcatataccataaaactctcccttttgaagtatataatttaatggtttttagcatactcacggagctatgcagccatcacccaaatcgatcttagatcatttttatcgctctcaaaagaaaccctgtacccattaccagtcgttcctcattttgtctcagcacccagcgtgggacaacaactgaactatttttggtctccatggatttgcctattttgtccatttggtataaatagagtcatacactatgtagccatttgtttctggcttctttcacttagaataatgtttttgaggttcagccacataacagtataaattggtacttcattcccttttttttttttttttgagatggagtttcactcttgtcacccaggctggagtgcaatggcgcaatctcagctcactgtagcctccacctcccaggttcaagcgatgattctcctgcctcagccttccgagtagctgggattacaggtgcccaccaccacacccagctaatgtttgtatttttagtagagacggggtttcaccatgttggtcaggctggtctcgaactccttacctcaggcaatccactcacctcccagagtgctgggattagaggtgtgagccaccgcacccagcctttcattcctttttatggctgcataattgtctattgtaccacattttgtttatcagttcatcacttgatggatatttgggttgtttctacttttgactattaggaataatgctgccgtcgacatttttgtacaagtgtttttatgggcatatgtttttaatttttttgggtataataactatgtttaactgtttgaggaattgccagactggctttcaaagtggctgcactattttacattcccaccagcaatgtgagagggttctaatttttctgcatcctcgtcaacacttgttattttccatcttaaaaaattataaccatccttttgggtgtgaagtggttttgatttgcatttccctaatgactaatgatgttagccacatttccatgttcaattggccatttgtatatcatctttggagaaatgtctatccaaatcctttgcccatttttaattggcattttttaattgttgaattagagatggatttttttttataattagtctatcggggtttcttttaattagttatgatctggagaaagagtattagtagcaagaaaccaagtgctagtggatttctggcccctgcctggaaaacaagaaacaccttttctgtcttagttctacttctgatgtctctgttcagtctgagtgactaacacgtgaagggctgattatgtgaacattaaatctgtgtgtgtagccttcatggcttcatttcttgcacttaaaaagctgatgttatattattttgttttgaaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggtgaagagctggttgagggctgatccagcacagctgtgacagctgtgttgtttgttgagggagggatttgcacagggaaggtggctacatcctgccatcgccaggcaccatggttgcctgatgggcactagtgtcctcagtggagtaaagatgggatttagaggtcaaggccaagaacatgtaagaatcttgtaagaaatgcttggctttccgcttcactccactggagggtttgatttcctttccttgaacttattgagcagatgttgggttggatggtgagatcaccacagagtagtgaatcagagctggctgccaaagcctgtaataagggatggcccttccaaaacagccccagggaatgtgaaactctcttcaaaaactgcctgttccccctgagcctgtcaggttagatcatctaaacacaaagcactgcattgcttcttggaacctcaaatcctgtacttgcttgtatgtcatttagagcatgtagtcttttctgttttagaatccttttccatttttccctatcatgttttatgagggcctgagcatcccatccttttgactttgcagagaatgcccctcacatgtaatgagagtagagaccagcagtatgctctttgatgttgcaggtatcttgctttgattggcccaggggatcttgctttcctagtaggagctgtcagcccccttgatagaagaaggctgtgaggttcacctctcctgcctctttgcagaaaacagttaacaaagctggcctggctgtgattctttgaaaggcctgcttataagtctagcccttggctggcatctgggaactttgatttctgaagtgttctcactattcccagaattggcttactatgcttaaaccgtttagacaaacattatggttgatgataaacccttgggtttgtttttttttttctgggagcctggaattttgatatgttccagacagatagtacctacctgaccagccccaaataaaaactggataatgaggctttaatgagcttccctagttagcagcatttcacatgtattgtcacacaactcgttgctgggagaagtaagtatcctatgtgacttccctggaagaggacttgaagcttgtgcctagtttcctctagactttgcctcatgtgccttttttctttgctgagtgtgtttcactgtaataagtcatagctgtgagtgagactaaatgctgaatcctatgagttcccctagtgaattgctgaacctgagggtggttttgggaacccaacacctcaccacacttttctagccaggcaggaggtggggacaggaacagaagggcgtctgtttgtatgaaggaagagagttgttgctgctcagtttgtaggaaacagaagtcgtatgatttcattgccattggcatctcatgagagtaacttaaggctggacttccaggtcagggccgagcacgtggggaatgctagtgagccaccactcaaatgcatcccaggcttagaggaaaggcagtatagacagtgatagagccacaagcttgtgcttttgctaaaagagtgacaactttgtggctttgtgtttttccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcaggtatcaaggacatagtttggggatgtattggacactgatgacatagtgtcgtaggtgaaaccactcttctcagtagacacaactccacctataatgtcttattaagagctttctttgtgtgagttatcaggcaaagtgctggggtggaggtgtcctataggtatttaggacacaggcagtgttgcctggatcaggactctcccaaccagtgtcttactttctaaagaagggaatgtccagagagttggtgacttgttgtgtgtggacacagaggtggggaaccagcctgggtgaccgttcctaacccaggggatactgttcaggtgacagctcattaattgtagagtgatgggcaactcccgagcagcccagaatgcttggtttgctggtacttgcaggttccctctgtgggaaagcccatcctggctagctgtcactctcagggggtggcttggtgaacaggcccttggtgcagagggaactgggacaccatcatggccagtgccacccagctgtgatgtccggcattcctttgccatgatttaggggcggagcaaccacacaattagaatcctcacactgactcatcagtcaccctttctccctggagagcagaatacacattgactaatgctctttctggaatattccacacagaaccctgcccttctcttaccacatgaatgctgtggcaggcaagctatagcggatggaagatggcagtgttttcaaagtgtgcatcctggactacctgccttagaatttctgggagggcttgttggaaatgcaaagtcttggcccactcagatttacacaattggaagctggaggtggaacttgacctgacaaccgacatttcttaaaaaaaaaaaaaaaaagcacaccaggtgattctgattcatcagaagtttgagagcctctgctgtagagtattgtttaaagcaaacacagaacaaaaccactgcatacagatatcccttgctatccaaacttacttggcccctgagtttgcacaacaagagtttggttggtgagaggtgtacattcctcaaatgtatttgattcctgtttcactgagagtttggaaagcaatgcatccatctgtttgttttctaattttgtgtttctgggctcctgatggtgaagtggcttgaactggctctgaggctgcacctggatgctttattagtgatggtcacttaaaatgacccttcaaaatggactgtgtgccaggaagggcgctgattcatgtgtggtatcgcctttagtcctcatggggacttagtgaggtacctgctctctgttgtctaggtgaggaaactcaaggcatgggaggtgtgctgacttgtctgacagcacaaaattagtgctgggtggagccaattcatccccagggactgtaactccaaagccccatggttggatctgttggttcccagcagtgtgggttcgaattcatgttctacctcataccagctgcctaacctctgtcaagtcatgttacctccctgagcctccctgagttttcttctctataaaactgaaacaaggtaggtaaagtttttccatgataacacctactttagagattttcagcaagaaccaaagagagcatgtagaagtatctaggaccgtgtcggctgcacggagctatctccttcaagttctcttagtcccctccttacacacagtggacagcatgactcagagggcctccctgatgcctgcatgtgctggtctcagccctgtgttccccttgaactctggcctgctcactgtcctcttgtagctttggatgtccgcatccaagcccatctcactgcacccttgagactcagctctgggatctcttcagctccagccctctaactcagctctacatgagccagtgacctcaggggccacactcaggagtttgttgcctgctccttccgagtcaccatactgaccacaacctcttctcctagcacttcccttgctctacctcacggggattgctagagtatggatttctatctcccccttgtgtccaggtcctgttggctttgttgcttccctaaatagctaaggcctggtggcaggtgacttactgtacttcccagccgcccagctcaccatacttgtccatttatccttgcccctcctgcagtacctttatcgtcagacactccagccacaccctctgctctgtagtccaagtcctgaaagctgctggagaaaatccatgcccccacgaagcagggaggccctcagatgccccgcctccagccccagcagcccaggcaagctctctgctcagctcacctcacttgtcctctgcagctgctccgtttgcatgacctcttctctactccctttcactgctcccctccaggcctttgccacccctgtgccccatttctcagtggatagcacctttcctcttgtagaaatggaagctggtggacagccagaggtaggggatcggacagggtggatgtgggtacgcatcctggctgtgccccttatcagctgtgtgactctgggcaagttaacctttctgagtcttggagtccttaatgtgccgttcacaggatcagatgccacctagtgtgtacttgctgaatgggctctattaataatctctgtcactgagacctggaattttgtgtatgcatgttctgggctcgaggcctcttccctcaactccccaccactgtccctgcttcccacgtctgcaagcagaatgagcaagatcttccttctcacctacctaccctgcagcctctccatccactctcatccctcccagctgcaaaagtgccagcccccttgcccctgcctgtttctgctttccactccttcacctgacctccaaggcagagcgagtgcacactgggctgttctggctgtgtctgtggcctcattgtccatttgttcttcaccatcctctacacaggcttccacctccccaatccactaaactctcacctcagcactgaccttggtggccagtaaaatctatctgtgtaggtcctgaccttccttgagctctgtgtcacttcctcactgttggccagctccaccccttctgggactgttggcctcccaatcctttctgtgtctgccacttaggtgccacttcccaggccccccactatatcctttccacctcttcttcccctgctgggctcagttgagccttggcagatgactccagaactaccccttcagcccaggtctctcctgattttcagatatgtgtgttgacctgcctgtgagagccattcctaggcagatgaccctggagacctcagctccataggcttccgcgtggtcaggccaccacccctgccctgccttttctccttcctcctcctcctcttgcgccccctgcccccaaatgccagcgaattatgccaccagctgaatgtgaaacctggagtcacccttgggttcctcaacacctcctcctcctctgctccctgcccccatgtctgcttgatgcccctgaattcctctcacatccacacagtcctctggatccttcagcacattgttctggaccacctcagtgggccttgctttgttttgttcattcagcaagtgtagtgagcacctcttatgtacccagcagtggcctagtaccattttgtctaaagcctctggaatctgtgtctgtgtcctgttgcaacaggactcttaataacttgaagcccagatcatgtcaatttctcgccttgaaagacctcagtgactccattggcctagaacttggagtctccactccctggatagacccaccaggtccatattatctggcccggacctaactttctagtcacccctctgccctcccatttgattctccagtcacatgggcctttcattggccccaaatgcaacctgctctgtcacaactccacactgttccgtgccctgcagcccctgcttggagcatctgagccccatttgtctgactgcaggtgcttcttgtcaaattctaactcctctgtgaagccttccctgaatctcccaggcagatttgagggcttattcccctgtgtcacccctgggcctctgtgggggatcggtcagagtggtgggaaaaactatagggaaaggatgcaaaccttctgaaaggtcagaaggttctgcagagccccaggggagaatagctgttctataaccctgaggcagagggcaaggagtaggtacaagggagtgtgggagaatttatcttaaacaggcttgtttacttatgttgaccaggaactgacctttgatcgtctgtgcttgtgaggttccctgaaaggggaacaataaatgttaattacctgcaggttggctctaggtttttggcattatgcctgcactgaataaaagccagcagctccagcttctcggggctgctctctggccactagagccaggcagtaacctagctgctcttatgctgcatacctgtgtctgagtactcatttcatccataggccagggtctgcaggacagacccagcaggcctcactgataattaagcattttcttgtctccatgattgtgtcctcactggatggggtggctcatcaagggtgaggaccttgtctgcttattgccttacgtccaggggctagcataggaaggagggaatacctttgtataggacatagccatcctgacaggtgtctttcatccccaggaggaccaaagttccacaggtttcagactgaagacttcatctaccagaaagtataagtaggccagggctcagcataatcctgctggaaggctagatgtatatcttttctcttgactgcaagtgagaacgggtgagtctcatgattgtcctcaccctggcagtgatgagaagaagctggtgggtccagctgataagtcaggggctggtctgcgaagacacggctctcttctcacccctctttggggtggaagattaatttttgtccttagcatttgtgaaccaggttgggaatgagagtcagcccaggaggggccggtggctcatttacttcagggcatgatctggctgttcccaaagtgcctcttgggttcagggactgtgaaggacgtgctgctctctggtatctcctttgctcttctcctgcctgctgacagtttgttagaaatgagctccacgtaacggccatagttcatgaagatatgcagttgtaatctgctgttgggttagcaagtgatcagagggaaaggctcagtcagggttgctgttatgtgttaaattatgaatttttttttccctgaaaagggctgttgacatcctaaccccccagtactgctgaatgtaaccatatttggaaataggtttattgcagatgtaattagttaagatcaggtcatattggagtaaggtgggctcctaatccaatatgatcggtgtcctttaagaagaggggagagagacacgggaagaacacatgaagatggagacacagtgatacagctgcaagctgaggaatgccagggactgacagccaccaccaccagctagggagaggcaagattcttctacttagagccttcagggagagaatggccctcccagcaccttgatcttggacttctagcctccagagctaggagacaatacatttcagcttaaaacaacagagcagtaggtgacacattcatccactgtgatctgtgccctaaagtgaaatctgatttgcttagaaatgtatcttatttgtagacctacagattttgctgtgactctgtgggtgaagtgatgctgatggtagggaaaggagtgttacattttggctgagaaaatcattaagggcatcaactaaggggtagggattgggagagatgcacaggcaagcattatctctgtatgccttggcaatttaaattgcagtcactctcatttttattttttttcaatttgcagcggaaaatccgccagagctactttgcctctgtgtcatatttggatacacaggtcggccgcctcttgagtgctttggacgatcttcagctggccaacagcaccatcattgcatttacctcggatcatggtaagcattttgaaattccctggtgagtcaaaacatctgaactttcctgtgaaacatgctttgcaaaattgccattgacataaacatgggtgtgttctcttttgtgaaccagtggttcacaaacaaagtgggatcctggggcatttttatgatcagcttgttagtcctgagacctctgtcttagatgcttgacggataggtgtgggtgggtgggggagggtcttgtagcaacttttttttttttcttgatgaatgcagcaggaaccctccatttgtgtggcagagctcttgtaacccccatttttaacctggagggttggaggacttttagtttgggtggagaggatccagaacaatcctggcagagcccagcaagctcttcacgcctggctccagccctcccacccctatccccgctgtcttctctgccgagagcctgggcttttcaagtctttatctccccctaaggctgtttcctacttttccaaaaatgaaactatctttttaaaagcattttttaaattcttcaacattccaagagcagggaataaaacagcagctccccccgtttcccactcacatagtcttgttcctctcatcctcacccactcccccatctctgaattgtttcaaagcaaatcccagatggttccattttccgatcactgtctctgaaaaatattgcctcttttgaagtataaccataatactgttatacttagagaaaggaaaataattttcatatcatcaaatatgaaataggataatagtaaatcataacatgtgcttatcatgaaaagaaaaaaggatacagagcatgtaattcagggccagaacatcctgcccttttctcccacctgctcagggctaacagatgacaatggattagggatccatctgccagccatcagttgtgcacatatgcacacagggatatatgttatacatgtgtatgtttgtaacatgtatgtcacaagatgtgattgcttgttctgtgtgtactgttaacgttccctggttttgtacacttaatgtcataggcaatctctgtgtcatttctcagaagcctaccttttcccttagaaatgtctgtaatattttattatatatggaggtgccataatttttcacatattcctgattatctgccatctgcttctgagccctcggtgcccagtttcctcttctccacgaacacactctgttgtgaggcagttgccgtagattacaaatagcccatctcagagtcccctcctgggacatcctccatcagaaccgcctgggagccagtaaaacatgctggtttctgcaactggtctcaggagctcgcagttctgggcatgggaaagtgcactttaacaggtgtctcaggtggtctggccacctctccctgagctcatcattccctgggcctccctatgttgccacgtcctcatcttgggcctctggggcaggagccagaaacctcctgagctgcctgtcaaggtcatcgggcttgttcctcctgatctggagatggatccttggggcccacacaggcacgcgttctccttagccagacttccccgtatttgctcctggctgcagcagcacaggctgaggcccggcaccagatgttcaatacgatcttgcagtcaggcggtccacagctatttctgtagcatttgccatgtgtcagaccctgtgccaggcctgggggccccctctgcctggtgcagggcagctcacaaaagctggcagaggccgaaggctgcgtgccagtattcagaatgccacagagcgcctggctgctgtaccttcagagcctccacaggcaccccagtcagagttccgggagtggattcctgaggtcgcactgccaggttccctcacgttgccatcctgcaggcttctcgatccttgaccttttagattcccgccacactgaatctaaaagggacaatgtgacctctaagctggtggcctaggagcctgccgataacctacccattcatcagccctcgtgggtcaaggctgcctcgtcctccccgagagagtggagaggtcgagcagtggggatgcccctcaggccccggggcttactgactggggcgggtgtcagggggaactccctctctttctgagctccactgagctatctgaaagtccccaccatactccccagtactgacagccagagggaggaacggctcaccagaatcattgggcatctctgatgggcatcaagtctgctttgattattgatgagtgggtaagagggtcctctcaacttggggtctccttgggaaagcactgtcaactcagaacaggtttcagccctgttctggagaccacaggccctggaaggctgggacatcatttgcagccccagcgtcatctattagacggagccagcaaggtctcatgctgtgcggtacatttcaacactttctcaaatttacccgtggcagcttttggtgtgtttggttatttttataacactactcactgtacaatttctgtcatgcacattttttgtatcaaaaagggtgctgtaactttaaaagactgggtatttccaacttggaatattcaaaccatcttttgcaagggatgttttaaataggcatgaagggttgtttttaattgaggttaaggatctgaaatgagaggttttggtttaccctatctatggtatgtcttaaaaatcaacgaagatgtccttgtcttttttgaatttgccgagtgtgttgcagttccacagctcactgttaggtggcacataccccaaactgaaaacctgacctcgtagggcatgagtcaaaagacaggtaggcacaggacagggcagtggtgacactacagctttcagggttcccagcctgtcaagaatgagcatgtcttagcaggggaggaacgcatgtgtgggaaccgccacagagtcctacgttaggtatatgttgctagtagtttgttaagatatttgagtttgggaatttaattattttttcttttttaaaggtttcctcatgaggacaaatacctgattttgaataaagcagcattcagttgaaataaccctttctgtggtaattccaagtgaatatttttcttctaggtgatgagtttctacttcctctggtttttacaacaggaaatgaaatggtatctaaaataaacaagctgtggtatgatgattattcattttctgtcattctgtgctttttatgaactagggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggtataaaatatgctgaaatgatattgcttgacagtaagatcacctttagtttatatgtgaaccactttattgaatcataggctttgggggttacacagacccccccttcctgccttgtgttggaatttcttctcaacattttgtggtcagcacacgctttctgagcatctcccatactctgggcggggaaagagtgacagaaccagaattgacaagtatggcccctgtccacaaggagccttgtgggatgatgatggacaaaggaacaggtgcatccccaagatggggagggctgtggtacagtctacaagagcctgctccagagcttagagtaaggggctgcccccgtaacagacgaggagaatcctttccctcgatgcgcacttttggtagggactcagccttctttgtggggggcacattttccattttgacagctcatcaatctagtgaaccactagatctgtaaaatctaccaggtgattctactctgccctccccagcagtgaagggcaagtttactttgacttccatgtgccagtccttcaaagctttgaaaacagcactgatgcccccgaccctgtccatccaccaatatcttctcttctctaggctgaaatccccagcccttcaaccattcgtcacaaggtagtgtttagacgcgtggttgtcctggtctctgtcttccaaaaagtttcagtttgagaaagcacttccagaataccagttggaccagatacccctcctggatgtgtgggcaacctgtatgggttcttgtgagttctatcctgacttgatctgcccagtgcatttcagggacaggttgtacactgtctctgaaatgacgtatgacgtttgctctttttggagtgcctcttctatgaactatgctaaaccagattgccccctttctggacttaagcatttaatccatccttaacatctaaatcttgtactgtatattgattcctgtttaaatttgtcttggttctggaccatcattcaggcctttctggatctttctgagcttgctttatactacccaattttattttttgcactttgatttttgtgcactgcatgtcctgtcttctttcatgtcattgatagaaaggttaaacagtttcaaggcatgattttagccctttgtttgctgggaaagatcttctgattggttgagaatcttttctgaaacttttgttgggaagtgttcagcaatttagaaattgatgtaactgcacggcctttcagtttatttccaaattttatctctagctgtgtcttttccctgaacttcagacttttgtttccaatagtctttcccacttagccagcctaacatatccaaagctggacttcacatctttcatcttcagcttttccttcaacactcttcttgtcctcaagaaatgagaatagtcactcatgccaaaaaatcatggaataatctcaacccctgttcttctcttactccatatgcaatattcagtctatgagaaagcctgtcacactccattcagactctgtgtaccacttcccaccacttcgcctgccactgtcttggaccagactgccactgtcttgtgctgaagtactgcaagagcttgctaaatggtccccttgcttgtgccctggatcccttggaggttttcctcctcagagcagccacagtgattccattaaaacccaagtcaagtcatgtcacagcccggcacaggagcctcttatgtacccttcttgatctgagtaaaagtcgtcacagtggccttacatgttctggccccattatctccctgacctcatctttttataagtatccaggccagttgtcctataacagtgtcccacagcctggatttatctgattgcttccacatgactacattcagggtaacatttttgacacgtgtgctacatgggctgttgtattctcccattgtgtcacatggtgggggcacttcatggccagcgttactagtattgtaagtttgaacactcggttgaagagctagctagcatcagccagatcttgccattgtaaaggtacctttttcaactttctttacttgttttctttttattttacttaaaaattaagtgtctagaaaatgaaatcaagcatgataaagcactgtcttaaagatccagaagggccagaatggtagtgcaaatccaatttcaattttaacaggaatcaatataaagtacagtatttagactttaaatatggatgaaccacaatgaaatactacttcatacccactaggatggctattaataaaaaacaacaacaaaagctgtgaaaggctgggcgtggtggctcacgccagtaatcccagcactttgggaggccaaggtgggcggatcacgaggtcaggagatcaagaccatcctggccaacaaggagaaaccccatctctactaaaaatacaaaaattagctgggtgtggcggtgcatgcctgtaatcccagctactcaggaggctgaggcaggagaatcacttgaacctgggagacggaggttgcagtgagctgagccgagattgcgccactgaactccatcctggagacagggctagaccccgtctaaaaaaaaagaatgaaacaagtgttaagagtgttagtgattatatggaaaaattggaacacttgtgcattgctggtaagaatgtaaaatggtgcagccactgtggaaaagaatttggtggatcctcagagttaaacatagaattactctatggcccagaagttccactcctaggtatatatccacagagctgaaaacaggtattcaatcaaaggttgtacattactgttcatagcagcactattcacagtaaccagaaagtggaagcaattcagatgtctattgacagaagaacagacaaaatgtggtccgtccatgcaatggaatattattcagtcttaaaaaggaaggaaactgacacatgctacatcatggatgagccttgaggacattatgctaagtgaaaaaagtcagtcacaaaaggacaaatactgtataatcccactcctatgaggtatctagagtagtccagttcatagacatagaaagtagaatggtggtttccagttgctgggtgaggatggagaaaggggagttgttacttaatggggacagagtttcagttgtgtaaattaagaggagttctggagatagatggtggtaatgatggcacaacagtataagtgtacttaattccactgaactgtatactaaaaagtggttacgatggtaaatgtcatggtgtgtgtatttgatcgtaataaaatgcaaagataactctaatgcagacatccagaagggagtaatgtgtggggtgatcctgtgggagtcagaatatcctgttcctcaacagactcttttacctagtggttgtagccttaattgatgatccttgtctgagtcagttattaaatcggtggttccaaaattcaggttgttttaaaaagcgccaacagcctcgtggggccctaattttgcatcctgctatttgattggatgagtaattaatgcagggtgaggtgccgaggtggtgtttctaaacgtctgttgctaaagataaatgttgtaaattaaaaaaagaaaacatatggagcccagacaggttcctttactgctcctgcctggccatggcaggcttttataatgtaacccattctgctctgtcgcttcctgtttcaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttgagttttgccaaccatggatggcaaatgtgatgtgctcccttccagctggtgagaggaggagttagagctggtcgttttgtgattacccataatattggaagcagcctgagggctagttaatccaaacatgcatcaacaatttggcctgagaatatgtaacagccaaaccttttcgtttagtctttattaaaatttataattggtaattggaccagttttttttttaatttccctctttttaaaacagttacggcttatttactgaataaatacaaagcaaacaaactcaagttatgtcatacctttggatacgaagaccatacataataaccaaacataacattatacacaaagaatactttcattatttgtggaatttagtgcatttcaaaaagtaatcatatatcaaactaggcaccacactaagttcctgattattttgtttataatttaataatatatcttatgagccctatatattcaaaatattatgttaacatgtaatccatgtttctttttcaaatctaaagttaaaaaaaaatagcagaagccagtgtcttaaagtctatcttttgtttctaagaccatgggatttcataatctcaagataaaatatgtatgaagtaattaatgtagaatttttacaccaaataataaataatgcttaataaactagagatatgagatgtgtaggaaatttggttaaacttttttcagatactttctggcccaaataataatttgttagcaaataatatgacccttgaactcaatggccatctattaaaagactgttgttcacactggaaaacatttaaagatgtgactatatccatgggtggattgaatcactcaaaatatattagtatccttctttagggatggttggttacagacatgtatttattcaggaggcagaaaatattccattttaattgcttattaaagaaaacattaaattctaaattattttgaggactgtgaagacttttcattagtgtaatattaggtcattgtcaatctcccagaatgtagttctatattctctaaatatgaaagtatccagaaaggccagtggtagtaaaaagcttagtgtatataatctcaaaagggatggaatatttacaactcatatttataacatgttgaatcttctcagttatcagtagtcatcagaagtgtcaatagctttctaaataaatattaaatatctactgtcctgtagtgaaggagtaatttttagtaattttctctttacaaagtctccagtgtttccaggtaaatatttgtgaaacaaaatacagcaaactacattgttacttcagtgtattgttgccaaaaatgacaagatattatattaaaatcagtaaattttagacagattttaaaaattaattagcctacaatagaggttatatggtaacacggtgatcttctaagcagttaagtgactgactgttctggcaacaacgacttctccgtgactgaagggccctgttcatttcctgatcctgaagctcgtctctcttttgagcctccgcttgctttggtcgatggtttccctcagctttttctttgctgttcttcatcctcgttgttgctgtcatcatgttcactgtggcttttacaatacagcctgtaaattccttatgacatagttcagtgcatttggctttattgcctgctccacagttctttacctttacttggcttagagaaactgtatctttgttgcttcatataacctttccccaaccccactaagctggacataacttattagtggtcctcccgtcactttatttgtagaaatctctctttcacatgagcaggggttctttcatgtggtttagctgacagcagaactagtgattctagacattttgcatggccctcattcagtggctcacaaacatgagggagcatcagaactacttgaggggcttgttaaaacccagtgcgttagaagtcggatgcggtggctcacacctgtaatcccagcactttgggaggcccaggcaggcggatcacttgaggttaggagttcaagaccagcctggccaacatggtgaaaccccgtctctactaaaaatacaaaagttagccgggtgtggtggtgcatgcctgtaatcccagcttcttgggaggccaaggcacaagaatcgcttgaaccaggagacggaggtttcagtgaatgaagatcgtgccattgtattccagcctcggcaacacagcaggactgtgattttctttggagactcctagattttctgtggttttgaactgaatttgttggatgttggcaagtgcctcttatgagctgtttctttatcctgcatttgccccacaaagacttatctggaggtgagcaaagtatgtttggtagtgaggtcacaaaggcaatcagccccttcctccccactcccattgccatcttctcagtccttctccctttctttccaagtagtttacccacccctcctctttcctcccctgtccctaaaataatccacgtgtcttcctaaaatctctctttgatcctgtcctttgataacaccgtcagtgcctactactgggtctagacagacctctgttgagcagtcagagtcttccctgactccacaatgcccctttccttggctgaccagtatgactactggtccccacctttcccttgcctatccctacctccctcctactaggttgtcccatccctctcttcacccattcattcatgaccatttttcactaccaagctccccccctcccgaaggaggctgaggtttttgtgactctctagactctattgtgggatggaatgaacattgctaaagaatcttgtgttcgctttactttaaaaaggtatttttttcctaattataaaactgatgtgtcagttacggaaaaattagaaatgcagcacaaatacatgaatattttaccacaaaattgccatataatatcttgtcttttttgggggtgtgaattttttgcattgttctggtcatattctttatcatgtaatttatgttcttttttactaagtattatgtgtggttattatagattttcacaaagatatattgctggtaatatattttattgtgtagtcttataatttacttaaccttctttcaattgttagaaatttaggctatttccagattttcagtattgtaaataatgctgtgatgaccaattttgtgaataaaatgtttttatgtatttcagattattcccttaggatagtctctcagtgccaagttgtcaaaaacatctctattttgcttatcttcctgctctcttgctgccttagggggtagtaaactgaaacataaagtaaacatgcatacaaataaaaaacataaaacaaaaataagcaacctgatggtaataggtgaaagtggtaacctgttttaactttgaattcttgccgggcgcggtgctcacgcctgtaatcccagcactttgggaggctgaggcgggtggatcacgaggtcaggagttcaagaccagcctggccaagatggtgaaatcccgtctctactaaaaatacaaaaattagccgggcgtggtggtgggcgcctgtaatcccagctacttgggaggctgaggcagagaattgcttgaacccaggaggcggaggttgcagtgagccaagatcgtgccactgcactccagcctgggtgacagagcgagactccgtctcaaataaaaaacaacaaaaaacaaaaaaaacttaaaattctttgcttgttagtgaccttgatcatggttctctttgtacgatagttgggcatctgtatttccacttgtgtgaatttgcctttaaattttggttatgggtttcaccttttaaaataatcaaacatatttatcttttcctgtgtgataggtttttttctgtatcttttcctgttaaacacacagacccctccccaatctggacattgaataaatattcattttcctttg

SEQ ID NO: 36166 - DNA, 217599 bp, Homo sapiens
gggggtcgggggtcgggggctgggggctgaggactgagtcgagccagcagcccagggcatctgtccacgctgtcagaggagcctctgggcgtggggctggcccttagagggctactgcgctgcttaacttggtgggtataaaggcaggtctcctgttgagctaaaaaattatggggtaccagctaggtaggcaacatagcgagaacccgtgtagacacacacacacacacacacacacacactagccaggagtggttatggggtaccagctaggtaggcaacatagcgacaacccgtgtccacacacacacacacacactagccaggagtggttatggggtaccagctaggtaggcaacatagcgacaacccgtgtccacacacacacacagtaggaggagtggtggcgcgcatctgtagtcccaggtactcgggagggtcgaggtgggaggatcgcttgaacccgggaagcggaggttgcagtgagacgagatcgcgccactgcactccagcctgggcgacagaggaagacttcgtctcaaaacaaaaacatcatggggaataaggcaagtgcctcccgcgcctctttctgcttggtctacattttggggtgtcgctactcttgtttgaggaggtgattaggccaaactgtgtggctgccaaggtggcctttggagaagggaacagctcgggattgaggcgagacggaggcggggctgtctgcagatgttcctggcccccggggcagggggcgcctgagaagttgtagggtctctcataatccctcagcgcagctctctctcccctccagtgggaagtacggattcacatatttttggagacctgttctcttggggtctgactccatcttttaggaagactgcaccatgtttaagtaaggaactgtgaatgcttacttaaaccatgtttaagtaaggacctgtcactccactccgctggttatttggtaggagatacagcccaggctctcactgctaattagtgactcagccgcaccacccagcgcaaagcaaagcgccgatgcttaggaaggtccactttgagggacacgctcagtgggggtcactttaaggaacacaaataaatcctcctttaagtctcctctgtggttcatgaaaaaggagagaaactccatcctcacctagtctcaacagatggcttgatgagcaattatcaggtaccaggtgagtagtagccgaccaatacgacctccttctatgctacttaacttttgcaaatttcctgctttccccttataaaaaagaataacagtgagtgaaaccctacattattcttgagatgatttttttttcattttattggtattccaaaacatttccttcaataagggtttatcaagtgcctcctttagaacatagtggttgtacgtgcatggggtcctgtatatccactcgggagagctggtttgaattctggctctgccatctttttttttccatttcttctccttctccttctccttctccttcttcctcctcctcctccttcctcttcctcttcttcctcttcttccttcttccttcttcttcttttttgtttaataaagaaacgagggtatcaccctgtcagccaggctgaagtgcagtggcacgatctcggctcactgcagcctcgacctcctgggctcaagcgatcctcttcttcagccaccacgccctgcaaattttttaaatgtttcgtagagacagggtctccctatgttgcccaggctctctgccacttttttgctctgtggttctgggcaaacatattacttctttgagcctcacttttcctcatctctatatctggggattccaatagtactaacttctttagactgagcttcttgagggaagggactgtatctgtagtgtttagagtttaaggtgcatctagtatttactattttgtctgtcacagtaaggactaaaaatagcccttgaatgtgtgaattgggttgccattaggattctgtgagataattcctgtaaaatgcttagcacagtgcccggcaaagataagtgctccatagacttagctagcattagtatgtgccaggcactgccctaggagttgtggagaacagaatgtggatcagactaaaggagaataaaaaagaggaaagaatgcacataaaatctataataccaagaacaaaatattcggacatgccataagattgacacagataaaatgctatcaagcttaggagactatgttcagctgggaggatcaagaaaggttttgcagagaatgtagttttcaagctaggcctgatggcctaggaatcagtgagagaagaggtagataagatacccgttaactgcttttacaataagtgtggttggagtgggacagaatttggtcctctttattttttatggatttcaaggttttagcacattcctcatagggttattgtgaatatcaagtaagttaatatctataaagtgcatttatagtacttggtacatagtaggtgctcaataaatattagctagtattattatcttaagcttcagcctggtctcccaaaatatgctctcacttacccagtatcatagccacacctcatctcatttgtctctcttccccattctattttagtcattccagttgaggcactactttctttttgtcaggtcagctctttgaaacttttcccagtggttcccagttgccacctctgttgccatagccttaaaaaaattttttgtgtgtacttttccaatctaatttaaattatgtgtagttatggtttcttctctcccaatagcctttcaattccttgaaggcagaaactgttccttatttgtccctaaacattccaggacctgttaagtagcgggtgttcagtagccatttgttgaaattactctgatttaatttttaagttaaatagacttctgttagcccacataaagaggtggctttgtggtggctcacacctgtaatcccagaagttcaggaggttgaggtggaaggattacttgaggccaggagtttgacagcagcctgggcaacatagtgagacccctgtctctattttttaaaaaattaaaaaactagcctggcatggtggctcatacctgtagtcctagctactcgggaggttgagatgggaggattgcttgagtccaggatgttgaggctgcagtgagctatgatcgtgccactgccctccagccggggcaacagagtaagaacctatcttaagaaaaaaaagagttggcttttctattaaaaaaacacctacctacatgaactttaatgaatgtaatgaatattcaattgtaactacattttctcagaatttaacatttagaaatttatgggaaagaagatgcttgaaatgaaactgaaaccaaaagactctaaattaaatctttgcatttgtttttatttttctatttgtaaatatatttgtaaatatatttttatatgtgcatatttataattttaaagattcatcctgtaaaccacagattgagagacttgagagattcctttttatcttttttaagattggctgggaataatgatagaacatgacctaccatcaggccccttgtggatcaaatatagcccacgccaaatgaaagccactggtgagaactgaaaatggaattgtaaatggagagagggcaactaattaggaatgtgcctggtcaacagggaaatagactgtcagtattgacagaaaaataaactattgatatgagtttttaatgacttctatcttcacaagggtaaattcactaatgagaacagatgaaagttagttgtcagggttctatgttttggaggagatgcgttggaagaggtctttaattgtgaaatggggaaagagactggtgctgtatttgggactttttgaggagaaaaaacaagtccagtgaagagcaatgtaaattccttttctttatgtgaagggggccaaaaagggttaaaaacccaggatgcaaaagtgggtactgtgccagagttagacagtgatttatactgtacataccagaaactgtataaatcattttatttgacaaatggtattgttatttctccagcagacttaagagctttggaatcatcacagctttgtaaggtagtattacagactgagtcattagatcattcattttgcctgattacatcatctcactgggttattgggggaatgaaagaaactcattatcaaaattgtcatcttgatgatgtagattaaagaaaatgaatcaaacttctgagaattaactttcacaatctgtttaaaattgactgggagttaaaaaaattggttgcagagcaggaatgattgaaatcttgtcatttttaaaagtcagagatcaaaggaatagtatttggaagatatttaatataaacagttgaaatttatgtagagtttttttttttttttttttgaagacttcttggctgggcgcggtggctcacacctgtaatcccagcactttgggaggctgagatgggcagatcacgaggccaggagattgagaccatcctggctaacacggtgaaaccccatctctattaaaaatacaaaaaattagctgggcgtggtggcaggagcctgtagtcccaggggaggctgaggcaggagaacggcgtgaacctgagaggcagagcttgcagtgagccaaggtcgcgccactgcaccccagcctgggtgacagagcgagactccatctcaaaaaaaaaaaaaaaaaagaaaaaaaagacttctttattgaggtataatgtacatatgataaaatttacctgtcttaagtgtatatttcagtattttttgtaaatttacagagttgtcaacatcaccaaagtgcagttttggaacactgtcattacctgagaaaaatccctagtgtataccatatgcagtcagttctcagctcctgcctctggtcctaggtgaccagtcttctgcttgctgtcttatgaattcgccttttctggacaattcatatagatggaatctgataatatgtgacctttttttgcctggcttcttttaattagcataatgtttttgaggctcacacatgtcgtagcatgtatcaatacttcattcttttttatgactgaatactatcccgttatatgaatatattacattttgtttatccatttactggttgatggtcatctgaaatgtttctggtttggggctattttgactgataatgcatagtaagactttgtgtggacacatgttttcatttctcttgggaatacagacttgagccgccgcacccacaccagatgtatgattcataagtattttctcccaggctgtgtcatgtatttcattttcttagtggtgtaatttgaagtactaacatttaaagttttgatgaactccaacttattaatttttttcctttataaattgtgcttttggtgttatatctaagaaatctttgcctaacctaaggtcatgaaaattttttttgaagattttttctatgtttcctcctaatagttgtatattttagtttttacatttaactctatgccattttgcattaatttttatgtgcattatgaggtaagggtctagattcatttcttttcatgcagatgttcaattttctcagtatcatttgtataaaagactatccttttctcattaaattcccttggcaactttgtcaaaaatcaattcaccataaatgtaagagttagcttttagactttaaattatgttctattgatctatatgtctgtccttatgccatattatactgtattgattattgtagttttgtagtaagtttggaaattgggaagtatatcaactatgttcttcattttcaaaattatttttatattctagtacagtcattatttccataaaatttaaattcagtttgtcaacttctgtgtaacaactgttgatgttttgatagagattatattgaattcacagattaattgaggaagaattgcaatcttaacaatattgggtttttgaatttatgaacatggaatgtctgtccatttatttcagttttctttattttttttactaatattgtgtagtgattagtgtacatattgcacttcttttaacaaatttattaagtatttttatgctgttgtgaatgaaattgttttctcaatttcattttcagatgaaattattactagtgtatagaaatatagttgactttttcatattgatattgtatcctgtaaccttgttaaactcatttacttgttctaagaatttttttgtggattctttaggattttctgtatactggatcagatcttctgtgaataaagaaaggctaacttttttcttttcaatcaggacttctttttcttgcctaatcgcactggcttgaacctgtagtacaatgttgaatagaagtggcaaggggaacatctttgccttgttcccaattttagaggcagaacattcagccttttaccattaagtatgatatttgtttttttgtagatactctttattaggttaaggaagttctcatctatctttaaaaattatttttaattagcttcttcaggttgagaagaagtttccttctattcctggtttagtgaaagtttttatcatgaatgatttttgaagtttttcagacgttttttgtatgtccattgatgtgatcatgtggtttttattttttattctattaacatgtgttgaatgaattgatttttggatattaagccaatctttcgttgttgaatttggtttgctagtattttactgaggatttttctgtgtatattcatgagggatattgatctctagttttcttgtttctggtctttgtgtcttttggtattaggataatattggccttatagaatgatttaggaatgttctatttcttggaagagtgtgtagaattggtattattcttaagcatttgattaaaaccatctgggcctgggctttactttgtgggaagatttttaattactaattcaacttttttccttgttttaggtctacttatattttctattccttcttttttttttttttttttttttgagacaaggtctcactcctgttgccaaggctggagtgccgtggcataatcacagctcactacagcctcaactccctgggctcaggtgattctcccaccttagccactcgagtagctgggactacaggcatgcatcaccactaggcccacctaatttttttggtactttttgtagtagagatgtggttttgccatgttgcccaggctggtcttgaactcctgaactcaagtgatcttctattccatcttgagtcagtttcaatacttggtgtctaagaatttgcccagtcacttaagttgtctaatttgttgacaaaaagctattggtaatattccctcacaatcttttttatttctttaagatctgattatggtaatctgtgccttctctctcttgcttttttttttttttttttaacatcttggtcagtctagttaaagttttgtcaacttgtaatatcctttttttttcttttgagacagtctcactctgtcacccaggctggaatgcagtagtgcaatctcagctcactacaatctccgcctcccaggttcaagtgattgattcttctgcctaatccacccaagtaacagggattacaggtgcatgccaccacacccgactaatttttgtatatttagtagagacagggtttcaccatgttggcctatgctggagtgaaactctgtctcaaaaaataaataaataaataaaactttaaaaaatacagatggccaggtgtggtggctcatgcctgtaatcccagcactttgggaagccaaggtgggtggatcatgaggtcaagagatcgagaccatcctgtccaacatggtgaagccccatctctactaaaaatacaaaaattagctgggtgtggtggcgcatgcctgtagtctcagctactcaggaggctgaggcaggagaattgcttgaacctgggaggtggaggttgcagtgagccgagattgcaccactgtgatcaaatgtaaattcagccatctcgataataatgttaaatgtgaatggtctcaacagcccattctataagcagagattgtcagactggcttagatccaactgtctgtctacaagaaacacaacttatagtcaaacacacaaataagttgaaagttaaagaaaaagatataccatgtaaactataagcataatattgctggagtaaagaaacagaatcctgcagataccttgattgtagtccagtgaaaaccatttcagacatctgacttccagaaccttaagataataaacttgtgttgctttaagcgactccccttgccaaaaaaagattgctgaagtaaatgtattaacatcagacaaaatagacttgaagacaagaaatatcactagacaaagtggggcatatcagaatcacaaaaatgacaaatcattacatctggaagatatagcacttgcaaatgtacatgaccctaacaacacagcctcaaaataccaaagcaaaaactgacaaaattcaagcaagaaatagacaattcaacagtggtagttggggacttcaacacctcactcttttttttttttttttgagatggagtctcactctgtcacctacactggagtgcagtggtgtgatctcagctcactgcagcctctgcctcctgggttcaagtgattctcctacctcagcctcctgagtagctgggattacaggcgcgtgccaccacacccggctactttttgtatttttaatagagacagggtttcaccgtgttggtcaggctggtcttgaactcctgacctcatgattcgcccacctcagcctcccaaaatgctgggattacaggcatgagccaccgtgcccagcccaatcctcagtcttaataactgatagaacaaacagaaaatcagcaaagatatagaaggctaaacgatactgtcagccaccttgacacctataggaaactccatccaacaatagcacaatacacattcttgtcaaatactcccagaacattctccaaaacagaccattattaggtcataaaacaagtctcaatgaatttaaaaggactgaaatcataccaggtatgttctctacccacaatagaattaaattagaaatcaacaatagacaatttggggaatctacaaatatttgcaaattaaacaacgcataggtaaataatccatgggtcatagactaaatcacaagggaaactaggaaatgttttgaactgaaaggaaacaaagatgtgatatatcaaaatgtatgagaggcagctaaaactgtgattagagggaagtgccaagctttagatgtctatattagaaaagaatataggtcaaatcaataacctaagtttctaccttaagaaactaggagccgggcatgctggctcatgcttgtaatcccagcactttgggaggctgaggtgggcagatcagttgaggtcaggagttcgagaccagcctggccaacatggtgaaaccccgtctctactaaaaatacaaaaattagccagatgtggtggcatgcacctgtaatcccagctactcgggaggctgaggcaggagaatcacttgaacctgggaggtggaggttgcagtgagctgagattgcaccactgcactccagcctgggcaatagagcaagactccatctcaaaaaaaaaaaaaaaaaagaaaagaaaagaaaagaaagaaaaagaaaaactaggaaaagaagaacaaactaaacccaaaggaagcaggaggaagggtataatgatgattaggtagaaatcaataaaatacaaagtagaaaaatagagaaaaatcaatgaaaccaacagttggttctttgaaaagatattaaaatttgggccaggtgtggtggctcacgcctgtaattccagcactttgggaggccaaggtgggcagatcagttaaggtcaggagttcaagaccaaggtttcactcttgttgcctaggctggagtgcaatggcatgatctcggctcactgcaacctctgcctcccagattcaagtgattctcctgcctcagctgctcaagtagctggggttacaggtgcccaccactatgcctggctaatttttttgtatttttagtagagagagggtttcaccatattggccatgctggtcttgaactcctgacctcaggtgatctacccacctcggcctcccaaagtgctgggattacaggcatgagccaccgcacccggcctttaaaaaaattttttagtgattgttctaggaattagaatatgcatctttatttgtcacgatctacttctttctttttttttttttgagacagggtcttgctctgccacccaggctggactgcaatggcgcaagtgtggctcactgttgcctccacctcctaggctcaagtgatccccccaactcaacctcctgagtagctgggaccacaggcacacgccaacacacctggctaatttttttttttttttttttgagatggagtctcactctgtcgcccaggctggagtgcagtggcacgaccttgggcactgcaagctccacctcccgggttcatgtcattctcctgcctcagcctcctgagtagctgggactacaggcaccaccaccacacccagctaattttttttttttttgtatttttagtagagacggggtttcaccgtgttagccaggacagtctcgaactcctgaccttgtgatctacccgcctcggcctcccaaagtgttgggattataggcgtgagccactgtgctgggccaatttttacattttttatagagatggtgtctcatcatgttgcccaggctggcctctaactcctgggctcaaacagtccacccatctcggcctcctaaagtgctgagattacaggtgtgagccaccatgcctggccacaatctactgattgatataaacttaatttaggtgaaatatagacacttctgtccaatataactccatatccccccttctcatgctgttatattacattcatatatgttacagatccaacaagacagtgttacaattattgctttatatgctcttatggcttttaaagaagttatgagaaaaagtgagaaacatatgtatagagtcctttatattaaccaatatatttactatttctgatgttctacattcctctctgtagatttgagtaactctaaaatcactttccatcagcctgaaaaacttccttcagtatttcttgtaaggcaagctggcaacaacaaattttttcagtctttgtttatcaactgtctttatttcaccttcacatttaaaggctataaggctatttttgctggatataaaatttttagttggcagattttttttttcctttaaacactttgatccctgctttcttagtctctgttgtttctgataaaaagtcatctgttaatttgattgtggtttctttgtaaatgatgatccacttttctctgctgcttacaagattttctctttgtgtttgcctttcaacagtttaaccttggtgtttctaggtatggacctctttgtgtttatggtacttggagttcttttgatcttcttggatgtgtagatttgtttttcctcaaatttataaagttttcagccatttttttctgtccctttctctttctcttctttttctgggactctccttatacatatgttagtatgtttggtggtatctctcaaatctctgaggcttgttcatttttcttcattctttttcttttcttttcttcaaattgtataatctctattgatctatctatcttccagtttactgattctttttctgtaatctgaaatttgctcttgagcccctctagtgaattttcatttcaattattttcttttcactccataatttgttttgttttataatttatttttattgatattctatattgtcactgttgccatactttaatttttaaaattttgttttctttagttctttgaacatatttacaacagctgccttgaagtctgtctgctaagtctaacatttgggcccctacagaaaaagtttccattaactgcacctttttctatatatgggccccactttttgtttgtatgtcttgcaattttttgttgaaaactgaacattttagatcagaggtcaacaatttatttctataaatgactggatagaaaatattttaggctttgtagtcaatgtggtctctattgtaatgtgaaagtagccatagacaatatgtaaatgaatgaaagtagatgtcttccaataaacctttatttaaaaaacaagcagtaggccataattgggccatgagttgtagtttgctgatcgctgttttaaataatgtatgatggcaactccagattctgatttccatccctacctaaggatttttgatattgctgctgtttgttggtttatttgtttagtgagttaacggggttgattctgtagtctttctttcctgtagtgtgtagctactgacatcttttcttaattttttcctttctaattcttgtttttattttattttacttcattttattttattttttatgagatggggtctcactatgttgtgcaggctggacttgaatttctgcgctgaagcagttgtccctcctcagcctcttgagtagctgggactacagatgtgtgctgctgtgcccaatttggttttatttttaaatctctttcctaggaattgcccctgggtcaacatagctagtggtcagctaataactgggaagagattgtacttaaacatcttgagcctagtaaggctctactgtttgctaattaatctgtgtatagtttggggaacacctttaaagttcagtcaaggccatgtggctatggcttatgcctataatcccagtgctttaggaggccatgacaggaagactgcatgataccaacagcttgaggccagcccaggtaacacagcaaggccctgtcttcgcaagaaatttttaaaaaattagctgggcatggtggtgcatgcctgtggtcctaactgtgggaggattgctggagcctaggagttcaaggttatagtgagctgtaattgtgccactgtgctccagcctgagcaaccatgtgagaccctacctctaaaaaaacaagaacaaagaaatagagttcagtcaagtctgccccaattttatttctatgtatgcaaggcttcacattcagccattgaaatctgtagcccactgtggtctctcctgggcatgtgcataaccgtgcccttgtacacagccttccagaccaccaagggtatcaggttccactatggctgtctttttccctagatctgcctattaaatttctggctggtctgttacttttcccaaccaaaactacagtttcagccagcaatgatattgactttccctgatcatttactaccaagatcacatgtttctgacaatgtcctatgcaccaaattacattgcagagctgctgattttcatggattttactgtcctgatagaactactatgttggagctgggggtagggagtgtagggattgcaaaaactcaaaataccatagattcatatttttcttaccaaggttcaatagtttgatttttttcctttataaatgctttttaatttgtcatgtgcctctggttagttagttagtttgtttgtttgagatggtgtcgtgctctgttgcccaggctggagtgcagtggcgcaatctctgcttactgtaacctctgcctcccgggttcaagtgattctcctgcctcagcctccagagtagctgggattacaggcatgcaccaccacacctggctagtttttaaaaaaaaaaattttttttgtattttttgtagagatgggcttcgccatgttggccaggctggtcttgaactgctgacctcaggtgatccacccgccttggcctcccaaagtgctgggattacaaggcatgagccaccgagcccagtctcagttttcaaaatcctgaaatgattgttttaacagttttgtacagatgttctttgacctaggaaggagttatatcctgataaactcattttaagttgaaaatattgtaagtcaaaaatgcatttaatacacctatctgaaaacatcgtatcttagcatagcctaccttaaacatgttcagaacactcacattagcctaaagttgggcaaaatcatctaacacaaagcctattttataataaagtgttgaatatctcatgtaatttattgaatgctgtactgaaagtgaaaaacagaatggttgtgtgggtattcaacatatggtttccactgaatgtatattgcttttgcaccatcataaagttgaaaaaaccgaagtcaaatctttataagtcagagactacctgtacagttttattgcggctttatgttaaacgatttgccagcctcctcactatgccattctggaagtgttccttgtgtagagttttagtgacctaaaaaaggtcacagtatttcccgacagatccagcagttttcaaaaattaatatattccaattcctgttcccttccaattttatattcctcctaaccttttttgtgatataattctggactctcttaaggcttacttttatatattcttttaggataaagcttatatttattccttccatcaatatttatttatttgttccatggacatttattaaacctcttctgtgcattgatactggaatgtatttccactccaggaagctctagcaagtagagtaggtagccagatctccagggttagtattataccagttctagagaaaattttatatctcctagcttatactaagtttacctaattataattatgggtatactctatttaataaatgtaagttatactgtgattatattactgtttgcattcaagtatttatatccctcagttttgtgacttctttttccagtcatataccataccctccacattttttttccaatttctaaaattgtggtaaaatacacataaaataggccggtcatggtggttcatacctgtaattcgagcaccttgggagccagagatgggaggatctcttgaggccagaagttcaagaccagcctggtcaacatagcggaacccccatctctaaaagaataaacctttctttaacaaaaaataaaaataaaaaataaaaaaacacacaaaataaaatatagttttctaagcatttttaagtgtatacttcagtggtattaaatatattcaaaatgtgcaactatcaccaccatccatctctatacttcttttcatcttgtaaaactgaaactctgtattcgttaaacaataattgtctattcttccctactcccagcccctggaagccaccaatctgtcttctgtctctattattttgactactgtaagtacctcatataagtggactcatacagtatttttcttctcgtgactggcttatttcatttagtataatgtcgtaaagtttcatccatgttgtagtatattgcggaatgtccatccattttttttaaaattttttttatactttaagttctagggtacatgtgcacaacgtgcaggtttgttacatatgtatacatgtgccatgttggtgtgctgcacccattaactcgtcatttacattaggtatatctcctaatgctatccctcccacccccctaccccacaacaggccctggtgtgtgatgttccccttcctgtgtccaagtgttctcattgttcacttcccacctatgagtgagaacatgcggtgtttggttttttgtctttgtgatagtttgctgagaatgatggtttccagcttcatccgtgtccctacaaaggacatgaactcatccttttttatggctgcatagtattccatggtatatatgtgccacattttcttaatccagtctatcattgatggacatttgggttggttccaagtctttgctattgtgaatagtgccgcaataaacatacgtgtgcatgtgtctttatagcagcatgatttataatcctttgggtatatacccagaaatgggatcactgggtcaaatggtatttctagttctggatccttgaggaattgccacactctcttccacaatgtttgaactagtttacagtcccaccaacagtgtaaaagtgttcctatttctccacatcctctccagcacctgttgtttcctgactttttaatgaccgccattctaattggtgtgagatggtatctcattgtggttttgatttgcatttctctgatggccagtgatggtgagcattttttgatgtgtctgttggctgcataaatgtcttcttttgagaagtgtctgttcatatcctttgcccactttttgatggggttgtttgtttttttcttgtaaatttgttggagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttcgcttttgttgccattgcttttggtgttttagatatgaagtccttgcctatgcctatgtcctgaatggtattgcctaagttttcttctagggtttttatggttttaggtcgaacatttaagtctttaatccatcttgaattaatttttgtataaggtgtaaggaagggatccagtttcagctttctacatatggctagcaagttttcccagcaccatttattaaatagggaatcctttccccatttcttgtttttgtcaggttcgtcaaagatcagatggttgtagatgtctggtattatttctgagggctctgttctgttccattggtctagatctctgttttggtaccagtaccatgctgttttggttactgtagccttgtagtatagtttgaagtcaggtagcatgatgcctccagctttgttcttttggcttaggattgacttggcaatgtgggctcttttttggttccatatgaactttacagtagttttttccaattctgtgaagaaagtcgttggtagcttcatggggatggcattgaatctataaattaccttgggtagtatggccattttcacaatattgattcttcctatccatgagcatggaatgttcttccatttgtttgtgtcctcttttgtttcgttgagcaacggtttgtagttctccttgaagaggtccttcacatcccttgtaagttggattactaggtattttattctctttgaagcagttgtgaatgggagttcactcatgatttggctctctgtttgtctgttattggtgtataagaatgctgtgatttttgcacattgattttgtatcctgagactttgctgaagttgcttatcagcttaaggagattttgggctgagacgatggggttttctaaacatacaatcatgtcatctgcaaacagggacaatttgacttcttcttttcctaattgaataccatttatttctttctcctgcctgattgccctggccagaactttcaacactatgttgaataggagtggtgagagagggcatccctgtcttgtgccggttttcaaagggaatgcttccagtttttgcccattcagtatgatattggctgtgggtttgtcataagtagctcttattattttgagatacgtcccatcaatacctaatttattgagagtttttagcatgaaaggctgttgaattttgtcaaaggccttttctgcatctattgagatagtcatgtggtttttgtctttggttctgtttatatgctggattatgtttattgatttgcgtatgttgaaccagccttgcatcccagggatgaagcccacttgatcatggtggataagcttttcgatgtgctgctggattcggtttgccagtattttactgaggatttttgcattgatgttcactagggatattggtctaaaattctctttttttgttgtgtctctgccaggctttggtatcagaatgatgctggcctcataaaatgggttagggaggattccctctttttctattgattggaatagtttcagaaggaatggtaccagctcctccttgtacctctggtagaattcgactgtgaatccatttggtcctggactttttttggttggtaagctattaattattgcctcaatttcagagcctgttattggtctattcagggattcaacttcttcctagtttagtcttgggagggtgtatgtgtccagaaatttatccatttcttctagattttctagtttatttgcgtagaggtgtttatagtattctctgatggtagtttgtatttctgtgggatcggtggtgatatcccctttatcattttttattgtgtctatttgattcttctctcttgtcttctttattagtcttgctagtggtctatcaattttgttgatcttttcaaaaaaccagctcctggattcattgattttttgaaggtttttttgtgtctctgtcgccttcagttctgctctgatcttagttatttcttgccttctgctagcttttgaatgtgtttgctcttgcttttctagttcttttaattgtgatgttagggttttagatcaattttagatctttcctgctttctcttgtgggcatttagtgctataagtttccctctgcacactgctttaaatgtgtcccagagactctggtatgttgtgtctttgttctcattggtttcaaagaacatctttatttctgccttcatttcattatgtacccagtagtccttcaggagcaggttgttcagtttccatgtagttgaacagttttgagtgagtttcttaatcctgagttgtagtttgattgctctgtcgtctgagagacagtttgttacaatttctgttcttttacatttgctgaggagtgctttacttccaactatgtggtcaattttcgaataagtgcggtgtggtgctgagaagaaagtatattctgttgatttggggtggagagttctgtagatgtctattaggtccgcttggtgcagagctgagttcaattcctggatatccttgttaactttctgtcccgttgatctgtctaatgttgatagtggggtgttaaagtctcccattattattgtgtgggagtctaaatttctttgtaggtctctaaggacttgttttatgaatctgggtgcttctgtattgggtgcatatatatttaggatagttagctcttcttgttgaattgatccctttaccattatgtaatggccttctttgtctcttttgatctttgttggtttaaagtatgttttatcagagactaggattgcaacccctgcctttttttgttctccatttgcttggtagatcttcctccatccctttatgttgagcctatgtgtgtctctgcatgtgagatgggtctcctgaatacagcacactgatgggtcttgactctttatccaatttactagtctgtgtcttttaattggcacatttagcccatttacatttaaagttaatattgttatgtgtgaatttgatcctgccattatgatgttagctggttattttgcctgttagttgatgcagtttcctcgtagcattgatggtctttacaatttggcatgtttttgcagtggctggtaccggttgttcctttccatgtttattgcttccttcaggagctcttgtagggcaggcctggtggtgacaaaatgtcttagcatttgcttgtctgtaaagaattttatttctccttcacttatgaagcttagttggctggatatgaaattctgggttgaaaattcttttctttaagaatgttgaatattggcccccactcttttctggcttgtatagtttctaccaagagatccactgttagtctgatgggcttcactttgagggtaacctgacctttctttctggctgcccttaacattttttccttcatttcaactttggtgaatctgacaattatgtgtcttggagttgctcttctcgaggagtatctttgtggtgttctctgtatttcctgaatttgaatgttggcctgccttgctaggttggggaagttctcctggataatatcctgcagagtgttttccaacttggttccattctccctgtcactttcaggtacaccactcagatgtagatttggtcttttcatgtagtcttatatttcttgaaggctttgttcatttctttttactcttttttctctaaacttctcttctcacttcatttcattaatttgatcttcaatcactgataccctttcttccagttgactgaattggctactgaagcttgtgcattcatcacgtagttctcatgccatggttttcagctccatcaggtcatttaaggacttctctacactggttattctagttagccattcgtctaatcttttttcaaggtttttagcttcttctcgatgggttcaaacttcctcctttagctcagagaagtttgatcatctgaagccttcttctctcaacttgtcaaagtcattctccatccagcttgttctgttgctggcgaggagcttcgttcctttggagggggagatgtgctctgatttttagaattttcagcttttctgctctgttttttccccatctttgtggttttatctacctttggtctttgatgatggtgacgtacatatggggttttggtgtggatgtcctttctgtttgttagttttccttctaacagtcaggaccctcagctgcaggtctgttggagtttgctggaggtccactccagaccctgtttgcctgggtatcagcagtggaggctgcagaacagtgaatattgctgaacagcaaatgttgctgcctgatcgttcccctggaagttttgtctcagaggagtacccagccgtgtgaggtgtcagtccgcccctactggggggtgcctcccagttaggctactcgggggtcagggatccacttgaggaggcagtctgtccattgtcagatctcaaattccgtgcttggagaaccactactctcttcaaagctgccagacagggacatttaagtctgcagaggtttctgctgccttttgtttggctatgccttgcccccagaggtggagtctacagaggcaggcaggcctccttgagctgcggtggactccacccagtttgagcttcctggccgctttgtttacctactcaagcctcagcaatggcaggtgcccctccctgagcctcgctgccaccttgcagtttgatctcagactgctgtgctagcaatgagccaggctccatggacatgggaccctccgagccatgtgcgggatataatctcctgttgtgccgtttgctaagaccattggaaaagtgcagtattagggtgggagtgacctgattttccaggtgctgtctgtcacagcttcccttggctaggaaagggaattccctgacccttgcgtttcccgggtgaggcgatgcctcgccctgctttggctcatgttcattgggctgcacccactgtactgcacccactgtctgacaagccccattgagatgaacccggtacctcagttggaaatgcagaaatcacccgtcttctgtgtccctcatgctgggagctgtagactggagctgttcctattcggccatcttggaaccacctgtccatcctttttaaggctgaataatattctgttgtatgcacataccacatttgcttatccattcatccattgatggacatttttgttgcttccacattttagctattgcaaataatgctgctatgaacatgggtttataaatatctctttgagaccctggtttcaattttttgggtatatacccatggttgaattgctggaacatatggtaattctatttataactttttgcagaatcaccatactgttttccacaatgactataccactttatattcccaccaagagtgtacaagtgttccagtttctccatatcctcaccaacatttgttacttttattttgcctttgttttccttaatggtagccatcctaataggtatgaggtggcatctcattgtagctttgatttgcatttccgtaatgattagtgatgttgagcatcttttcatattgttattggctgtttttgtatcttattttgagaaatgtctattcaagttctctgcccattttcgaattatgttgttttttgttgtcgagttttaggagttctctacatattctggatgttaatcccttatcagatatatgatttggaaatatctctcattctgtgggttgcatttttactctgttgacagtttcctttggtgcccccaaatttttaattttaatgcagtgcaatatatcaattttttcttttgctgcctgtgcctttgtgtcatatcccagaaatgattgccaattcaacgttttgaagctttggccttatgttttcttctaagaattttattgttttaggtcttgcatttaagtctttgattcattttgagttaatttttgtataggcgttaggtaagggtccaagttcattcttgcaacaatggccaccagcctctttctctgcacatctatgatcagaagcagcaatcagcagacagagcacagatcactgacatttgaaggacaagatcctttttgcccatcctggctccagcaagctgtttcaggaaatgtgtacagctgcctgccatgggggtggtcatgggtagcgtccactacactaagagccgaaattgaccaaaattaaccacaatttaggtccaagccttttcctggaagtcacaaaccttcaatagactctagagttccaaaataattacatcagacagatgctgctgtgcaaatgttgtctagctggggagagacattccagcagcttcctactccaccagaatgctgtctccttctccacattttgtgcagagaacataactggcctccacacaaagtttatttttttctccccatccccagtagtaacgaaggctaagatgttccatttgggagggaggggcagattgggtgtatactggaagtcacagatggtggttgtggatcatggggagggacctcagggttgaggtggctcaaattgttatctgaggtgccttggctaaaggatattatagcaggtagagaggtatgtcaccttttatattactttattcctttgattagggaagttttgctcccctttgtgaccaggcaagactgggcataaggtatgtggggcagaggatccttctagtatgagaaagaagaaagagaagatgtgtggttaggattggagctgaatagaacatgtggctggtggagagagaaaaggtatggaagggctgagtagactttatgcaagacagatttatttggttgacagtagatattatcagttaacacatatattatcatcctttttgcagttaagtaaagtaaaataaggtgaggtaggaggattattttagtaaagatagtagagggattttcaaatccattttctgttatacagtggggagagagggaaaatactagcaaatgtttcaggcaaattgattctaaacctggttctctgactaacttaatctttgactacaaccaaattgtttaacctgcctaagcattattgctagcacttgtgaaatgagaagttagaaaaaaatgaagataatgcaaaatattttgaaaaattatttgctatataaatgtaagaaagctttatcattctataatgccaaaatattaagagctgctgcaaaatgaaaatttattgtaagataaatcttcacaggccgggcgtggtggctcaccgtgctgtaatcccagcactttgggaggccgaggtagatggatcacctgaggttgggagttcaaaaccagcctgaccaacatggagaaaccccatctctactaaaaatacaaaattagccgggtgtggtggcacatgcctgtagtcccagctacttgggaggctgaggcaggagaatcgcttgaacccggtaggtggaggttgcagtgagccaagattgcaccattgcactccagcctgggcaacaagagtgaaactctgtctacacccctgccaaaaaaaaagataaatcttcaccaaaatcatgatgaaaattaatggaacggtaagatttaatttactgcaaaaatccaacagacatgtattgagtacatgtttgttgagccgtgatgttcatgtatgttaaaagtgacggacagaccactgatttaattgtcataaatcctacaggtactatcatctaaaatttctcggtgcccttttctgcttgttgtgtctatgatgctagtttaactcagtacatttgctttataaaaagccagagaaagatgatagtctgtttatctaggttctccaaagcatttcctgccaggcagttgacatgtagccttggcacaatttcaggaaactgtttgcttctgtttaccctttccagatacagcatctcctaagaattgaggtgaggaatctcctttaacttttttacattttagaagtatactttattctaacactttagaatgctcttcatgtaagagcaatgaaaatctttgtgtctttaaattaaaaaggatatgttttagtgcttcactagtagaaaaggcaaagccttaaagcaagttaacctaataagatgtactcagaagaatatttctaggctgggcgtggtggctcacgcctgtaatcccagcactttgggaggctgaggtgggaggattgcttgaccccaggagtttgacaccagcctggacaacatggtgagaccttgtctctacaaaaaaattttaaaaattagcctgatgtggacctgtagtcttagctacatgggaggctgaggcaggaggatcacttgaacctgggaggtcgaggctgcaatgaaccatgattgtaccactgcactccagcctgggtgacagagctgaaactctgttctccccccgaaaaaagttagaaaaaaaaagaatattcctttcctggaatattgttcacattagtctctctttcagaaaattcaatgtaattatagctgaacatacaaaacttattaattatgggatagttgtcaccatttccaaaatccttctttactatgaaaaagaacccaccactgaatttcttcagaatggtatgcttttcttgattcaattataatatttttctttttatataacatttcagaaatattcagttaagtggcatagacattatatttgaaaaataagttactcaacatttttattccttattgggagccaatttgtttctaaatgttttaaatactcattatgtagttagaaatgcaggaatgtattatagctttattgcactcccagagtacatgttaattaagtatgcataaatatatctttgagagaatgtggtggcaaatgtattaatttagagattgaaagcttgaggtgtggaaagatataataacaatgcacatactacagttaattgtgagcaaatttatatcctttctgcatattgttgtcacataaactaatcatctcttaattactttgtccttccagaatgaattaaaaaagattctataattttagccagcactagaactataggcagccgtgggtggggaagcaggataagaaactgtgatgagactgatatgcatggcatgggacaggtggcaagagaataatttagtttgtgatcaggcctaggcctggggtcaggaaccagataagcatttcagattggtagcatatctgtgacccaagattacaacaaggccatggatcagagccaaatggcctctgaatggcaaggatcatggcaagcaacaggtcagagacaaagcggaggaggttgtcacacaggtaccaatgggattggtagatggggaagaatgagcaaatatccagagttgggagtctcaaagttaagttctgccgttagaaaatggccccttagtacttctggacaacatagatctcttcccatcttcctttcctctctttacaaggtttcagacttagttggaagacatgactctggctttaacacactgatattgaagacttatgggctgagatgaatggctccctgtttaagagaatcagaagtcaacatagcttgcagagtaggtctagagagttctgccttaaagggtggagtaataaagccaaaggattcagcaaaccaagggtcatcattggtaccatgcatgaagagttatcttcatcttgtgaaattggtgactttgctccattctgtgacttatctctgttttgaaaccatattaactcctaggctgcctggtcctgtaaccatcgatcactgaatgactgccttaacccaatcctgtaaacctaccacaacttaattcttagaatttctagctgaatatactagaggaaataaagaataggaaatctaaatcagatgtggtggctcgtgcctacactctcagctacttgggaggcagaggtgggaagattgcttgagcccaggagtttgaggctgcagtgagctatgcttgcaccactgaactccagcttggatgacagatcctgtctcaaaaaaacaaaaaacaacaacaacaacaaaaaaacaaaggaagtccgaagaggatttttttttttttttctgttagtagactagtattagtatccttttagggactgaccccatccccaccttcactgaattgcctgtcatggagaaagcccttaataaatgttggttgaatcgtgaattagagggtcttcaagtgatcaaagtaactgaatgaaaggagtgagagagcaacttctgacacaggcatagagcctgaatgcattttgaagatgtgagagagatggaactgtatctctatagaggaaaatctaagaagtcaactaagatacaaagaaattactgacctagccaaggctatagaaccattgagggcagtactggaaagaatggggtgtcttcatttctagatttcatgctgtgcacactaaacaaatggtttgtaaagattcaaaacatcgcttaagtcagccaaaaatgtttttctattaatctaaagtttgagtaagtgaaattttgaagacgatggtatctaattgataacttccttactccttaacctgtagataatctccctttttaaagtgctcattacagtagtgattatgtagagaaaaagcttctgatgaaaatgtggtataaaattgtattctttgttcagcaagttaaaacaagctggtctgtaagcaattattatcttcatcaaatttcctagctctaatgttttggcttcataggcccagcacgtatgccttctcaaacaattggatggttttaaaacacttatgagatgtttgtgcttatatcttaacatagcatcagttcaacaagaaaaagaaaaagaaaatgtaagatttggcattagggcttagtttgaaaaagaaaatcaaaccaaactaaagaaaacaaaaagcccctaatgacacttaatccctgcataggaatgaacattcttcattcagcttcataatgcccttagtagcagtgctctagttaagagttcagaagtgtctttcttttcttcactctttaatcacttgacatttttggaaaagaaatttatcagaatgcttgttggctaaccactattaatatttttatatgggtcatatattctaaagagatctctttttgccttttctttggttttatttgtagttatcccaaatgaaaacaacaacaaaatgtgttctgtattctaagagctgttcaggtacccatctgggtgagcagatgatttaaaactgaattagctttttgaattctgtgcaagtaactctgtgcaagttactatgaagaatgcgcctttgtataagcttgggaatgtttattttaaaaataatatttaaaaattatttgattgattgagacagactctcactctgtcgtccaggctggagtgcagtggtgcaatcacagcttactacagtctcaaccttctaggctcaagagatccttccacctcagcctcccaagtagctgggatcacaggcatgcaccactattcctggctaatttttgtattttttctagagacagggccctgctgtgttgcctaggctgatctccaactgctgggctcaagcagtccactcaccttggcctcccaaagtgctgggatcacaggcatgaaccacagtgcccaaccaaaaaatgataatcttttaaaattaaaaataaccatagatgcattttgaaacttacataatatttttctagtgggttaggtttctggttacattctatgattaattaattattacatagtcaaatatttatactgtatgttcacctgaaattattgtaattcaacagctatttattgagtaacagccatttgctagaggttaaagatggaacttatactgatagataaataacccatgctttcaagaggctcacaatctggcagtcagcagattggctcatggtgagcaatacttatgaacaatggttatgggctatgaagtgagccttgggtgccaagggagagagtaatccattctcccaaggagtaggaagaagtcggagaaggctttattaaaaaggtgacatttgagttgggcctatcagagatgttacctttcataatattttctgggaaataacaagttgtttatgagattggagcataggatgccagaagccagcaatgtaatgtaaagtttgaggtgtctggaacatctaggtgcagatatccacaaggtagttggaagttcaggtctagaaattaaaagagagaagtcggagctagagataatagtttggcaatatcagctaaattgaattgaaaccatgcaagtagataagatgtccaggatgggctgtgtagaagagagccaagaaaaaaaaatccaattaaagagtatacagagaaggagatagtaaatgaaggccagtgaaaaagagtggtcatagagacaggagttgatagagatattaagagaatagagaagttaagtaagaagctcaagatgctctagagaaaaggaacaacaagaacaagactggccgggcatgctggctcacgcctgtaatcccagcgctttgggaggctgaggtgggtggatcggtcacttgaggtcagaagtgcaagaccagcctggccaacgtggtgaaatcctgtctctactaaaaatacaaaaagtagccagccaactgtgatggcaggcgcttgttaatcccagctactcaggaggctgaggcacaagaatcacttgaacccaggaggcagaggttgcagtgggccgagatcatgccactacactccagcctgggtgacagagtgagactgtctcaaaaacaaacaaacaaaaagaacaagacagagcatttggaaattaaaaaatcatagttgaaattttaaaaattgatagaagaatcagaagaaaaaatttacaaaatttcccatacagtagaacaaaaagacagtaagatggacaattaggagatcaaccaaagaggtccaacatagaagtcacaggagttgtagaaagagaaatttgagaaaatatatgggatgaaattattaaaggaacagtacaggaacatttactggaactatagaacatgagcctccagattaaaaaggcccacaagtgccttagaacgatgtttgaaaaagtacccatactaaggcacatcactatgaattttcaggaaaatatcctacaagcttccaaagacataaaaatatatacattatatttcccagctggtaaaaaaaaatttacctcctctgcagcctttcacagaaaaccactggaggagatactcacaaaaatgaaggggaagaacaggaaacaggaagacatgagatgaaggaaacaggagattcaacatgggtaagggtcgttcttcaaaataagtagagtaagcatgcttctgagacaggagatgggggaatgaagatacatttggacatggtaagggaaagttgagggaatttacatttctcctttctcagtggtgaaggcaaggttacctcctgagagtgagtagttggaagttttgggaagagacaggcttgggacagttgctgtggggaacaagaagaggatcgaaatcactaggaataaaaggattgttgagcagtattcagtattaggaggaggtttgtagtgaagcctgtcagttttatttattattttttagagacgaagtcttgctacctctaggagataacatgcgtgaccatagccactgtgacctcgaactcctagcttcaagctatcctcctgcttcaaggcttgtcaattttagaaatgaagatagtttttctgtcaggcagctttagtgctgtttattggagatcactttatcttgagatgctctgaagatgcattttgcaacacaaactgaattattgtcagaaaatgatttatttcttcacagtattgaaatctctattctggaaagctgaggctcttagcaattacatataataaatcacatttggtagtaaaaactacacacacacacacacacacacacacacacacacacacagttcaaagtgacagcttccagtgcatctgtaacctaggctttttgagctcttaaatattttggctcttcaagtcttgattagttgaaagttgactgatgagtacctaggaggaaggaattaagaagagcatagaatgccaattatcctaaaagaaaaggaaaaaggaagcaaagaaggaaaggagatgtaagagtttgaccttctaggagactgaagatggctctgtcctttgtctgtggtatgtcaaccatgttccccagcataatggaaatgttggggtaggctgctgcttagttagcaatagagtagatgcatgaaaactaccaccaccattctattggtacctaaatgttcaaagtaataactctgactgtacaaatgttaatgtgactaaccttttcataacttactatttcaatcgaaactccctaagcatttatcgttccattattttattagaatgcttatttgaattcactaagcatgtgaatttggtcatctctgactgaagttggtatctcctccttgcctctaacctctagtctagaatttcccataatttttttttcaatcatatgtacctagcatagagactctgattcaggatatctggagatgtcttggaccagagcattgcattttgaaaagcttctcgggtgatttttttttctccagaggacaaatattttattctttaaagaatttataaaggaattggaagatgactacagttctctttgggtgatttttgacatgcaccaaaggttaagagctacttttgtttctagagttattttcctcaaatgcacatcatgtcactcttctcaaaaatattgtctctccacatccttcagaatcaaattcaaattccttcatattgccttcatatccttcctagatctgatcctgtatcagtcaggaggagctaagcttatgctgcaataacagcttctcacatttcagtggcttaagacaatgaggatatttcatacatatccagcatggccagcatggatcagtagggaggtattggtttattcagggatccggtccgctacagtctcacatggctttgggtttatgtggcagagaagagaggcatggacatctcttaccccttcttcaatgctttggcctggaagtgacatgtgtcacttctgctcacagcctgttggctagacaagggttggacagtcacatggccctgcctaactgcacagtgactggaacggtagacttctgtggactgggaagtataacagtgagcattagtgagtctacctttttaaaaaatgtttgaggtgaaatttacacaacataaaaaccattttaaagtgtataattcagtgacattaattatagtcacaatattgtgcaatcatcacttctagttccaaaacattttcaccactctcaaggagctcccatacccactaagcagttacctcccatttctttctcccccggagccctggcaaccatttatcttctgtctctgtggattgatggaatcatacaatatgtgactttctgggtctggcttctttcacttagcataatgttttcaagtctcactcacattgcatgtatcagaatgttattcctttttatggtcaaataatattccactgtatagatacaccacatttaaaaaatccattcatggctgggcacggtggctcacacctgtaatcccagcactttgggaggctgaggccacctgaggtcaggatttcaagaccagcttggccaacatggtgaaaccccatctctacaaaaatacaaaaattagttggtcatgatggcaggtgcctataatcccagctatttgggaggctgagacaggagaactgcttgaacccaggaggtggaggttgcagtgagctgagatcgcgccattgcactccagcctggacgactgagcgagactctgtctccaaaaaaaaaaaaaaaattcattcaattgttgatggacatgattatttctaccttttggtcctgtatatagtgctgctatgaacttttgtgtacaagtagttgaacaattgttttcagttcttttgggtatatacccaggagtggaattgctggtcacatggtaattctatgtttaactttttgaggaaccaccaaactgattcccacttaatttacctttttaacttcctacttcagtcaaatgaggaccagtcactgttcttacagctggtttctcattttcatggcttaggcaattcctttggcttaaaattttctccccttcttttctaatgactgaaatagaaattctgacaatcattgaaggttcagttccaaccctctttctctaaattctagtaagaatctctactagttctgcaaattcccatatttcctcctctttatctcttgtatgctattatttttgagtagttgtttattaatgcctttatcactagattttaaatttgcttacacaacttattacttttattccccccagtgtcaaaaatagttttgtgatgtttaataaatgcttattgaatgaataaacaaatgaataaggagctacagatacaatcgtgatttttttgggggggaactatggatttctgttttgccagtaagatggagaatgacaaaatgatattaaatttcacaagtctggtttcagggatgcatgttgggtaaaattcagtgaattcagtgacaaatatagatcattattttatctggagataattcattaaatctaagactgataccattagaacaaagattggtaactagtgtttcaaatgagtaaatttttagactttaatttcttccaataaaaaattatcttcaggctggttcaagtgcagtgatgtttacaactaattgatgacaaccagttacagatttctttgttccttctctgctcccactgcttcatttgactagtgtttaaaaaaaaaaaaaggccgggcacgatggctcacgcctgtaatcccagcactttgggaggccaaggcgggtggatcacaaggtcaggagattgagaccatcctggctaacatggtgaaaccctgtttctactaaaaatacaaaaaaaattagctgggcatggtggtgggcacctgtagtcccagctactcgggaggctaaggcaggagaatggcatgaacccgggaggtggagcttgcagtgagccgagatcgcaccactgcactccagcctgggcaacagagtgagagtccgtctcaaaaaaaaaaaaaaaaaaaaagtatcttcaagcccatgagagaaggaagaaggatgacttagcaagacagaggagtgaggggaccatccaggttggatgagcctttctgagcttgtctcctgtccgtctaaaggccacctgacatctcctctcatttactctcagatccagcctgcccagcatcagcagtcaagctgccttattactttcttttcttttctttctttctttttttttttttttgagacggaatcttgctctgtcgcccaggctgatgtgcagtggcacaatcttggctcactgcaacctctgcctccggagttcaagcaattctccctgtcttagcttcccaagtagctgggattacaggtgctcgctaccatgcttggctaatttttgtattttttagaagagacggggtttcaccatgttggccaggctggtcttgaactcctgacctcaggtgataggcccaccttggcctcccaaagtgctgggattacaggcatgagcccctgtactttatctaaatgagtattagacagcttgctatctggaacaaaaccccaaacaacatagcaggataaaatcaaataaatggattggagtgaacctttttgtgagctgatatagaaagagaactttgattggatgtatcctgtcttctgtacacttagtagggagggaacaaaaggcactgcatggtatccaaggcaggaaatataatctactataaaaaagacataagtaacacaattcagtttacttattccttatatattttaagaaaatgaataatttatttttaattttatattaaaacctcagtaatacttgaaatccaaatgagatttaccagcttgacaagattaaagtatatatatgtactttagtataatatagagatggggtcttgctatgttgcccaggctggtcttgaactcttgggctcaaacgatcctcctgtctcagcctatcaaagtgctaggattacaggtatgagccaccatgcccggcctatagtatatcttaattcttctcttaagatcttgattaataaccctgtaacttatgttaatgatattaaccaggagtactacatttatttttctcctttaattctgtgtagatctaaataaaataataaagtgttgaatatctcatgtaatttattgaatactgtaccgaaactgaaaaacagaatgctgtatggggactcaacgtatgctttctactgaaggaatattggttttgcaccatggtaaagtcaaaagattgtaagttgaaccaccatatattggggatcatttatatatttttaaactgtttctgaagtttttacctggtgtatatcttacctacatataaaaaattttttttaggtcaaaatgtcagctaggtgtggtggcttatgtctataatcccagcactttgggaggctgaagtgggaggatcacttgaagccaggagtttgagaccagcctgggcaacacagtgagactcctatctctatagaatagagatttttaaaaatctctattttaaaagattagccatgtgttgtggtatgtgcttgtagtcccagccactggggaggctaaggtgggaggctgcagtgagctctgattgtgccactgcactccagcctgggcaacagagactctttctcaaaaaaaataagaatagtaaaattaaaaaaaaaaatcacagtgtcaaaaatttttgcatgcaaattttggtttctgggcttcctactcagtgcaatttagaaaatttagtagttttttttttttttctttgagactgagtctcactctgtagcccaggctggagtgcagtggcgcgatctgggctcactgcaagctctgcctcctggattcacgccattctcctgcctcagcctcccaagtagctgggactacaggtgcccaccaccacgcccggctaattttttgtatctttagtagagacgaggtttcaccgtcttagccaggatggtctccatctcctgaccttgtgatctgccctcctcggcctcccaaagtgctgggattactggcatgagccacggcgcccggcctagaacacttaaagtcatctaggctaaccacctttcccagttgtctgctttagagaaaactggttgtttggatcatgaagcataaataaggccccacagccccaataccttttctttgagacagggtctcactttgccgcccaggctgaagtgcagtggtgcaatcataattcactggagccaggacctcctgggctcaagcaatcctcccacctcaatgtcttgagtagctgggactagaggtgtacataaaccaccatgctcagctaatttttttttttttttaaagactggggtctcactatgttgctcaggctggtctcaaactcgtgagctcaagaggtcctcctgccttgacttcccaaaataatggcattataggaatgagccactgaacccaaccctcactgcccctttaatgaatacatataatattacaggcagagtacctaggaagaaatcattgtttcgtgagtgctagacctgcaaacctgaaaatcttcctagaaaatcttaacccttctgtccttcaaaggaaaaaacaaaacatgccaaagcaaaatccatgaaccagaaaacccagacaactcaccatgcttaagtgcaggatttaaaatagcaaaaggaagtaaagctcatctttgtgatgtcaagttctattttggtatataacaaagtagttgaattataaggctctcaaggttaaaatattaaacagacccttagctacaagatgtgttgccaggcatctgtatggaatataaccatgtaatcagggcatattgtacttctctgcacaaagagaaccaaagctactgcttctaaagattaggaaactttcattagactgacagaagaccgtacagaggaaatggcttgcgggtggaggagacgtatgagagaggatgaaaggaacagtattcataactatccaaattagagccaggatgtttatgctcaaatcttgtcttggctctgtgttgatgggactgaataatggaacatgggaaagtatatctcagacccctaaattaggcagtaaatttaccaaattcctcctacaagcgcttcctattttcagcagtctctgcacatttctcaatatatgctgtgattaaagtccaaagctggctaatgctaatgatcccttcctcttttttgttgctagtatccttccatggcgatttcattctgttgtttataagtcacatgtctctacaacaggattgtaaccttatgaggagtgtttttatttatctttcatttattcagacagcatatatttactgtgcgcttatttcatgctgggcactgtgctaggcagataggatgtaattattagcaagacaggctaggttgctgtcctcaaagagcttgccatctcttatacatagtcgaccttgtttgtcaagtgatgtgaacattacgttaacgcaaattactaaattactactatttaaaatatagcattaacaccatttctgatgtcagtgtctctaataaatatttggccagtattaagatgaactaatagtcacatatatgaagtttagactcaaggctatatttagactatatttagacaatttaagggatgttaacttttctttctgagagagcagatctaatgaagtttttttcctaagaattaaaacagttccatgcataacttacaatggaattggccaacaaaaagaacaagtatttatatctaattattgccctcttacattgcttcagcacatataagaggcagcagcagcagctgccaatgatgaaaataattattgtcctgggtctgattagagaaaatcttgatgctgtctgttgagttgtctttccttagagatgttacaagaaaaacgggactttagtagtagaggttctaatagttttgaaagtgggagacttaagaacctccttacagagctcagagagctgcaggtagaatttacctggaggctggctaaattctgtggcttgcctttacattcatgagttctcttgttccacgtttggggcagaaccatcctaatttgagattggagagattggaaaagactggagagggctaagttcatccaaatatggcccaggtctcctgaggtgttcaagcacttcagtgaactagagtagaaactcacttagattgtgagtttggagaaaaacttgttctgattaaagtaaaactgttctgatttttggagtaaaacctgtgctgatttttggcctttgtgttttcaatgtgcctcaacaacagctgaaatcttgggctttcctaatgtagaagcaactcaacgaggaattgatttatttttcatgcgcagactgcatcacaccgcatataaggccttctgctagaaaggccaaactgtcctttggcctcagtattttggagacaaagagttaatactagtaattcctgtgtaatatccttttttggcaaaggaacagtagactttatcagtttggttcttgccattacttgtgttcgatcttgaccaagttaaattatttccaggatgtatctttttttttctttttttttttttttttagacggagtctcactctgttgcccaggctggaatgcagtggtgcgatcttggcttactgcaatctctgcctcctgggttcaagggattctcctgcctcaaggctccctagtagctgagattacaggcgcctgccaccactcctgctaactttcgtatttttagtagagatggggtttcaccatgttggccaggctggtcttgaactcttgacctgaagtgatccgcccaccttggcctccaaagtgctgggattacaggcctgagccaccgcgcccggcctcaggatgtatcttaaactcattatttttgatgcttgccctgcagctgagtaaatacctctttaggatatgtgacaattgaactggcttggattttggaacatgtcctggccttggagcctgcttatgttcatacacactggttccttagaaatgtaaatttgtaaagtcaatgtaaaactgaaacttcaaaagtcaattttcattgctgctgttgtgcatttctattatcaaattttatttacagtgatttacgtgagtaaaaaatggattacacgatttcctaacatctcactaagtatgggtttggatcttaagtaatttacatttttcttttccaagttgattgttatactgggctaatgatttccttcaaattccactaataaatcacagattctcagtgctgttattccattgctttattattaaatggcacccttttctagtttttgtttttgcaaaccagtggagtatttaaagtaaaatttcagaatcccttttggagctttcggttgagaccaggctccttggaaccctagtgctttgggagttctgctgctgctgcagtaccaaaagtagcttctttgaatttcatttgggttttgtagggctcccccgaggcccgagaactgggagaagggaaagagctcatcggtttgtttgaaggccggcgggcggtgcaggcagcttttcccagactctcccagctccggcttttcacgcataccagaagagccgcttttttcctccagtgattgaaaccatctggactccaggggggtcacgtgtgtatgagaaaatgacataaagtttcagaccccgttgtgctttgctccagacccagacaactcttggtcggatggtgaggaggtgagggccgtccagtttgggggccaacttctcctccctgctgcccccggcccccgcctccctcacccctgtcccccaccctccctcgcacactctcggcgcggctttctcgctgcctccggcgcctccgagcgctcccctccgccgggctccagcagcccaccctctctgtcttgggtggaggcgcacatcctccacgccccctccactcaaatctgcgctccctcccctctctctccctgcagcccggccgcagcccggggcgcggatgcctgcccgccgcccgccctctctgcaggagcggctcctcctccgggccgcgcggctcccggcgagaccccatccaggcgccgcgcccggcccggctggggaacgcagaggtaagcgcctccgggccgggtggccccggttcccgcgtgcgcgcccggtcccgcccctgccctcccagcccttttccctctgctcccgactcccggccccggcagcggtgtccagctccgtgagtacgcgcgtgggggccgccgcaggcgcagaggagcggggctggtggggtccgccctcccgggcggtcagtagccgccggctctgctttccggcccggcgggggccgcgcggttgggggtggggaacctcgcggccagagtccggcggtgaagagctgcctggtgccgagcggagacccgatctcgggacgtcctgggagctggctctgcgcaccgccttgcctctcggtggcggcattcgagctcctacctggagctgttgcagcttgtatgcaggctccttgaagaacgcgcgcgcgcgcgcgcacacacacacacacatacacacgcacaacacacacagacacacggaactcaaacaaaggaaaattaactttgcatgctattactgcaacaagttaaactatgtttatttgtggatggttcactttttgcccttgtgcagacacgcactaagtattaaagggtccacactctagtcaacgtttatggcacgttatccaataatttagtaactgagtagagttcaagagacaatgttttcaagtgtttctaaagagggcttattgcattttcctgggatctttatatgaaagtagttgatgattaatatgaataaaataacttcttcattaagtgagaaaatttgccttagtacagccttagtccagctcttgcttttattaccaaccaggtgtttctgctgtttggatagcagggtcttgggaatggcaaagaggtcattatcccatctgcaagactgttttcagctacctcttagctgcacacactgcaactggccattttgggatggggccacagggttaaaacccaaagggctgcattgttttgttttaatatttttcagaaggtgaatcccttaattgatttttttttgccagaattaggggtttctaaaaggttagacgtaatctggggtccagaaagctaatccaagatagagactgaattgttcacagcctatctcccttgctgaattaaggaccgcacaaggccagaactcaagaagagcctgttgaatgcatgaagtgaaggcttcttaaattctgctggtctggcagagagttcctaggtgactaacatagatgtaaccctcctttttatttatctggcatatattttttatttaaaaaatttttttctttttttttttcgagacggagtctctctctgtccctggagtgcagtggcgcaatctcggctcactgcaacccccgcctcctgggttcaagcaattctcctgcctcagcctcccgagtagctgggattataggcgcctgccactacgtctggctaatttttgtatttttagtagagatggggttccccatgttggccaggctggtctcaaagtcctgatttgaggtgatccacccgcctgggcctcccaaagtgctggaattacaggcgtgagccactgggcccaggctatctggcaaatattacctttggaaaaactccccaagatagggggaagaaaaattgttcaagtgtatgtatgggaaatgttatcccctaattgggccagaagggcacccattttggtagacaactccaaggcaactcttaccttaaaagtatttttttactgaacgcttagattggattggcttggtaattagggaaatccttggtcttgagtttgtggactccttggggaaagagaagtgacatttgagtgaaggataatttcagatcaattggcttagaacaggaatgtccaatcttttggcttcccggggtcacactggaagaagaatcgcctggggccgcatgtaaaatacactgactctaaggatagctgatgagcttaaaataaatcgcataaaaaatcataatatttttaaaagtttacgaatttgtgttgggccacactcagagccgtcctgggcggcccatgggccgcaggttggacaaacttggcttagaatctaagaattataaagctcaaggagaaaatgattctgaggcagggcggtttcatagaagaggggagagccttgaagcaaagtatgcttctgaaactggtggagagttgctggggaaagctttcaagagaatggagagcagaccatttggactggacctagagagaaaagtaatagcatctgctctatgccacctgccagctctctctttcatccttcagtgttgtgacataggtattgttgctcttgttttaaagatgagggaattcttgtttttaaaaagacaagatcaaaaagatacgtaactggcttgggatgacacaagtggtaaagtggcagagctggaattccaatgcctggctctcagactaacatgggtgctttcacagctgccttctccaaagagcagtgggaggtccagtggaagccgaactgtggtcaggttgaattctggctcaagggctggaactttatcctgtagacattgtttaggttttaaagatttttgagaaaaggagctatgggtaaagcagtgattttagaagattaaggtgacatctatgtacaggaatgtgacatgctcatcacaagtcatgtgcaagtcataattcctaatgaggaggttcaaaaaggaaatgtagccaggatatctgggtgtttcaattcctgtctcacttactgtaccctgcagcgagtagcttggttcactgggtaaagagctagttggagtgaccacggggctgctctggatcagaaaagagctgaatcttaccaggcatacgctgaaatggaatgtgtatgtggatcaatgccactgctggtttgtcctttatgttcccccatgtttcgcaatgctttggttttttctttcatgactaccctgagaggtagatcaatgttgtaatttgtttaaaagcttttcctcgccctaaacatcttaggtaagttgatgtgccttttcctctcatattctcttatttcttaaaaatgctgaattttggccaggtgctgtggctcacacctgtaatcccagcattttgggaggcagaggcaggcagattgcttgagctcaggagttggagaccagcctgggcaacatggtgaaaccctgtctctacaaaaaatacaaaaattaatcatgcatgttggcatgtgcctgtggtcccaactattcaggaggctaaggtgggaggatcgatcacttgagcccaggaggttgaggctgcagtaagccatgatcatgccactgcactgcagcctgagtgacagagtgagaccctgtctcaaaaaaaaaaaaaaaaaaaaaaagctgaattttaaaacttggtactagtaaggtaaaagtgaatttagattacctttcttaattatgagaaagattaacataaaatatacatttatttcactttgtgttatggaggaaaaacaggaggcctttgtagagttcctgcgtggggatttagaagggataggaaagccaggatttagagatgtgcaaaggtcttcctacccctccacatttcttaccagttaatcgtattgttcatgtatacagcttatggagcttataaggacattggacacccacatttatagccaggccctttgattctcggcagataatgggctcaggaagggcagcagtgggtggagacattttactagaattagtctgccgctttgaatacaatctggatttcttgctatttcttgtgcaacctgtacgccgtttcctctgaacttgctagtgctctggagacttggttgtttggccaaggaatatcccctagcaggagggctcactaaggaggggcagcttgacaggcagaaaagtgatgtttgtcaactaaagaagttttcttttaattaatgttagagtcacccatggttttttgtcaaataaaaaatgcgaaatcaaaatatgatctcggttctccacacccatttttacctttaagagcctctcacaccttggagagcttgccttactgaatggggttttgataggtgaaattatcaccaggacctctacatgggtcaggatatgactcagtttgggttttggacctctgaggaatgtgacccctcttagtgtaggggatttggagtacaaaaacctgggttaaagttccagctttgccatttattcagaagttcctggaatttgatgtttgagagatctctgagctcagttttcctagttcttctagatcagggtaatcccttagggccagatagaggtggtcacaccctgattagcaccttggttccttctcccagtttgtattttgtgtcacctgaaagtcattttattttctctgtagcctctggttataggttatgtggtcattcctccagagaatggcaaagctcattgttggttggggatcatttggtatgtcttcccgggagaatgctcttgaacctagttttgagagttggggcctcaagaagagactttggcaatgcccttatttaaatgttagaaatgtttggttgcatttttgatgcattgcttacatagttaatgtttttgtatttggtacttgtcattttaataatttattaaacaggtgatttaggttttctaagatagctaagagcttagaaaaataggactgcaggtcgggtgcggtggctcacgcctgtaatcccagcactttgggaggccgaggcaggcggatcacaaggtcaggaggtcgagaccatcctggctaacacggtgaaaccccgtctctactaaaaatacaaaaaattagctgggcgtggtggcgggcacctgtagtcccagctgctggggaggctgaggcaggagaatggcgtgaacccgggaggcggaggttgcagtgagccgagatcgcgccactgcactccagcctgggcgacagagcgagactccgtctcaaaataaaagaaaaaaaaagaaaaagaaaaatagggctgcaatatcctctttaaaaatagtctaaattattttttagtggggatggcatttggacaattccccaggactggaatatccctttgatactcagatgtaatctcctagtatggtagaactttgactattttgacctcctccacctccaaatatccttaaatctttctgaagagatttaatctctcttaaagagatctcacaatttccctgggaaacactttctaaggaaggtttccagattgatgatcacagattatctccttgtagttagcttttcttttaatgtttcctacttttactgttttcctgtccctcttcaatgcacacatgttcacagagtgaacaaattgtctttcctggactccaaaggcagctaccaaatgtacagactgtcccatctgtacccatcctttccttcccttcctctggctaaacaagctgagctttctctgttttccttaacaagtctctctttttagacctatgattatacttgttgctttgtgttttgttttatgcaggaagttcatatcagatatgttggcaattagagctttcaaactggaaggagccttttggagtaaaatatatatatttttttctatcagcataagtaattgtggaatatatgtaaactctggagatgatcttttaaaaaaattaccatcaaaagaattttactcaagtcctttaagggcttaagaagaatccagcctttgcgagattgcactaaaagtaacagattagcccaattaaggcctatctagaagtctgggaatcatttgtttaaactggaatttaggatctccatgcaaatatgatagaaataatctgcttaaccctttgttagtagcattagaaataagcccctttttatgggactcttaatgataaaaggtcatagtaattagaatatgctgggaatttgtccctgtttgttaatgttttggaaactcctttgagtaggcaggggtcactttgggtggcttttttctttctttgatgtgaagttgggatcttggatgtaaatttagccaaggacaagtttgaatttagattttttaaattttttccgtcttgttccattcttccttttggaggcggctaactagagtggggtaaaaagtgcctttaatcagagtcagtgtcctgagactgtcagacactggtctctgggaagtgctctgtatcactatcatttatatacttttcctttcttgtgtcctatagtttttgaatatctcctgcggaaaaagcactggggtgtgtacgggcatctgtttattctcttattacctttcttcagtgaatatgcttaatgttaggggtttgatgaatcaatgagtggatgaagttaagaaattagatggaggccaggcctggtggctaacacctgtaatcccagcactttgggaggccaaattgggaggattgcttgaagccaggagtttgagacctgcctgggcaacacagtgagactctgtccttatgaaaaaaatacaaaaattagccgagcgtggcggtgcgtgtctgtggtcccagctaaacggtgggctgagatgggaggattgcttgatcctgggaggtcaaggctgtagggagccgagattgtgtcactacactccagcctgagcaacagagtgagcccctgagtgaaaataacaacaacaacaaaagaaattggatgggaaattagttttggatatgagtgttgggtacctcctgatccaaatattgctgttgggaagcaactgtttttacaacactctggtctctggaagctgagatgacctctgttaaggctcatcatgtggggatatattttctagtgagtaaacagggcctagtcagttattttttctattagtcatgttggattacatttactgttgccgggaactctagttagcataatatccccttgaattaggaagtgccactcaatagctgtctttctccaggactgcctggagaagcttttcttgaaagtctggtcttgcctcttgagccagggatgagtgcattctaagtacttagacccaaaaggcttcttctactgggtccaagtcccaggggaatggaaattctcttgaaaatagtataattgtatgggaggggaatcaaagctttgtacttttcagtagtcactcgaatctgtacatagatacctggagataaagaaaacccaacttgcaaatgagtatttggtgctgtgggttaacatggaaaaatggcacttaaggtcaaagtatattaattgaatccttcttgtccagttaatcagcaatatcagttgtgaggattccgttttgctatttttcccccatttgtacattgacaggtcactcttttgaattagaatagcactcaggaccacagtgtttgcataggaagtggcgtaagaggcaggccgggcgcagtggctgacgcctgtaatcccagcactttaggaggccgaggcgagcggatctcaaggtcaggagatagagaccatcctggctaatatggtgaaaccccttctctactaaaaatacaaaaaaattagccaggcgtggcagcgtgtgcctgtagtcccagctgctggggaggctgagaggtggagcttgcagtgagccgagatcgtgccactgcactccagcctgggtgacagagcaagactcggtctcaaaaaaaaaaaaaaaaagaaagtggcgttaagagtcatggggcgtgggtagaggccactttatatcttgtttcagagggccatttaaaattttttttaattaattaatttacttacttatttttagagacggggtccccctatgttgcccagacaggtctcgaactcccaggctcaagcaatcctcccacttttgcctcccaaaatggtaggtttaaagatggaccatttttaaaacctccatgagtagctcagtgatcagaattagctagaaatagctctgccaaaaggtattggcaaaataacatctagcagcctttgtctatttcaggttaggtttgttcaagaaaaccaatttgggagcagtatgatgtgcccagctctgtctacatttgagtcgcctacatagttcccatgtatttgtcactatttctggtccctggagggctggggtagatctcaggatatgaggctcagacttggttgaagccacatcaagagctgtggtcctggtgggtcagcgttattttctgcggcttatcacccaggctaggcgtgtgggagcatgggtgggtaggacagggaagaaaaacagaagaccagatagttctgtggaaactgaataaataagtgaaaaagttggccaggcactgtggcactcacctgtaatcccagcactctgggagcccatggcaggtggatctcttgagctcaggagtttgagaccagcctgggcaacatggtaaacccctatctctacaaaaattagaaaaattagccaggcacagtggcacacacctgtggtcctagctactcaggaggctgagatgggaggatcacctgaggtgatcacccgaggttgagattgcagtgagtcgagactgtggcactgacctccagcctggatgacagagtgagaccctgtctcaaaaaaaaaaaaaaaaaaaaaaaaagagtgaaaaagttaatctttttcccctcactgacttggacctttgttctgttggaaacccttatcacttgaggtcattttatttatgtatttatttttaaatgtttcattattattatattttaaaaatatgtattttttatttcaatagcttttgtggtacaagtggtttttgattatatggatgaattgtgtctgaaattttagtgtgccagtcacctgagtagtgtacatggtacccaatatgtagtctttgtaacccttcatctcccctccctccctcccttcctcccccttctgtgtctccataatccattataccactcgatatgcctttgcatacccatagcttagctcccacctataagtgagaacatacagtatttggttttgcattcctgtgttacttcacttagaataatggcctccagctccatccaagttgctgcaaaagacattatttcattctttttttatggctgagtagtattccatggtgtatacataccacattttttaatcactcattggttgatgggcacttaggttggttccgtatctttactgttgtgaattgtgctgcgataaacatatttgtgcaagtatctttttgatataatgactcatcctttgagtagatacccagtagtgcaattgctggattgaatggtagatctatttttagttatttgagaaatctccatactgttttccatagaggttgtactaatttatattcccaccagcagtgtataagcatttgcttttcaccacatccatgtcaagatctattgttttttgactttttagtaatggctagtctggctggagtaaggtagagtatttcattgtggttttaatttgcatctccctgatgatttgttatgttgagcatttttttcatatatttcgtggctatttgtatatcttcttttcagaaatgtttattcatatcatttgctcggtttttgatgggagtgtttttttcttgctgaattatttgagttccttgcagattctaggtatttgttgtttgtcagatgcataatttgcaaatattttctcccattctgcgggttgtctgtttaatggttatttcttttgctgtgcagaagccttttagtttaattagttcccatttatttatttatttttgttgttacattcgcttttggggtcttagtcataaattctttgtctcacccaatgtccagaagagtttttcctaagttttcttttagaatttttatggtttcatgtcttagatctaaatctttgatccatctcgagttaatttttgtatatggtgagtgatagggatccagtttcattcttctgcgtgtggctagccagttttcccagcaccatttattgaatagggtatcttttcccagtttatgtttttgtttgctttgttgaaggttagttggttgtaagtatttggcttatttctgggttctctattctgtttcactggtctgtgtatctacatttataccagtaccattgctgttttgttactatagccttgcagtataagtcaggtaacgtgatgtctacagatttcttctttttgctcaggattgctttggctatttgggctcctttttggttccatatgaattttagaattgttttttctaatattttcgaaaatgatgttagtatttggataggaattgcattgaatctgtagattgctttgggtagtatgctcattttcatgatattgattctttgatttcatgagcatggggtgtatttctatttgtttgtgtcacctgtggtttctttcagcagcgttttgtagttctccttgtagtgctctttcaccttcttagttaagtatattactaggtattttatttgtttttgaaggtattaaaaaggattgagttattgatttgattctcatcttggtggttgttggtatatagcagtgctactgatttgtgtacgttgattttgtaacctgagactttactgaatttatcaaatctaggagtcttttggaggatctaggcatcttttagggttttctaagtgtacaatcatatcattagcaaacagagatagtttgacttcctgttttccaatttggatgccctttatttctttctcttgcttgattgttctggctaggacttcctaaggtcattttataaatattcatagtaactagttgaaggcactgagattcctgtaccttggcgggaagaaccctgctggatgattctctaggtgtttatttgggttatgcccattttctttccctcttttcttcctaagttttgatgctcctgtttttctgggaatattttggcttcattgtttaggcttttttaagggccatggggaattctggggacaggggcaggtgtgacatgttgctaggtatgggaggtttttacagcttgagaaatttccaggaaagaagagacagaaaactttgttcacaaagcatgtggacaggaagtcaggtgggaaaatggcatggcagatggtgtaacttctttggtcagcatgcctgtctctgccaagatgggactgatagggtagtgggggtagtggggcagtgctgaggatataacttataattcacattattccttgaagagaagatggttctttgttttaaaaggaagtatagtgccttacattgatttctttgaaatatacatgatataatccatgaatgagtatttgcaaaacacgtggccgggcgcggtggctcacgcctgtaatcccagcactttgggaggccgaggcgggtggatcacgaggtcaggagattgagaccatcctggctaacatggtgaaaccccgtctctactaaaaaatacaaaaaattagccgggcgcgatggcgggcgcctgtagtcccagctactcgggaggctgaggcaggagaatggcgtgaacccgggaggcggagcttgcagtgagccgagatcgcgccactgcactccagcctgggcgagagagggagactctgtctcaaaaaaacaaacaaacaaacaaacaaacaaaaaaacacgttagtgtttatctaaccctatgccaagcctggtagtagatatacaatacaactgagggaaagtgataacctgaacttagaacatataattgttacctaaagaatgatataaagcagtacatcatcaagctctaaattttgagttattgatacatacagggggtttggagccccagacaaggtttaggacgtgcaggcttatggcaaatcttgggccaaatggaggcctttggagcttttggagcgcccaagggctcagtcttcagcctgtttcttgtctctgtcttcacttttcttaggtgattccctggctttgaagtactagcatttatggaatgtttactggctgccagaggctgttgtaagggttttatgtgcactaatctagccttccagacaaccttataatataggtatttttattatccttgcttaaaggtgtagaaactgagacaagagatggactttcttgagctcacacagcttataagctggagagccaggaaatgacctagtttgggtgaccagccaagccctcgactggttcagaatagccatcctcagctggtcctggctcctctgctcctgtctttgcagtctcttctccacatagcaatgagaatatatatattttttaccctcatatggaatgctatcacacttagaagtacaatgcacatttactaccaagttcttgtgtggtctaagccccagctctcccatctgctcctgccttcctcccatctcttctgtctcatggcctttgcctgctcctaggatgctcttctccttgaatattgctggtttgtcacccagttcatttgagtgtgggctcgagtgtgccacctcagggaggccttctctgcccatcctatgtaaaactgctccgagtcactctttaatcccctcctttctttttcttcctaaaattatattacatatttctgtgtttttcctgtctgctttcccaaataaataaactccatgaagttagggacttgatccatttgtttactgatatctttactttttagaataggacatggaaggttttctttaaatatttgttaaataaatgactaaatggtatcttttgcattcatttgctgttcatgacttcacttgggtaaaaatagtggagaggaaagggaggtacaggtgataactacagcctgggtcctaactggttttatgtttattaccaaggctttgctatcataacatggccaagaaaatgctcagaaatcttggttgaatgaatgcactgtgtaatttgttctggattccacacagaggggacagaatagtgtgggctgaagtgctcagagaaatttcttggaggacctgcagactttgaaggagagattggatttggtcgagcatataggaatcgaagaatacttttttttaaaggtggaagggctatagggtgaactagtccaatctttctgtttatagacaggaaactgagcccagagaggtgtaggacctgcccaaaggcacacaaccagttgatgtcagaaccacgtctggcatccaggtgttttgactcctaatttagttccctttcttctacacagtgctgccttcagaatccaggaggactctgggggttggggagtaaccaggggcagcatgagcaaaggcccagaggcagaaaagatgttggcttgtatgggctggaaataggtggtctattggaatcagcaggtttataaaggagcccatcggagacagaccaggctgaatcagatcctctgggatcttgaatgtcatcttgaagactttgagtttggaatgagtgggaggcatgtgaaaatgctttgactattgttctgtctttctctacagggatggtgacagaatggatagtatagaaaatggattggaattgaggaggaaactagaagctaagaggagttaggaggcccttgtaacaatccaggtattattgctaagggcctagtatcattttagttatttctgtttctgtttttagagatttgtggtggtttttggagaagatgacatgaaattatcaggcaatatgtgtatactcagctttctaatagagtttggggataagaaggaggagacctggtattttgccttaattctgtatgcggctataaatgacattttagtatccagatgataattcttctaagaaacctgggccaggttaggacaggagggatacaagataacattatactgatgtgaaaatagtgatggggctaagtgcagtggctcatacctgtaatcccagtgctttggcagactgaggcaggagaattgcttgagcccaggagttctagaccagcctgggtgacatggtgagaccctgtctctgcaaaaagtaaaaaattagctgggcatggtggcacacatctgtagtcctagctactcgggaggctgaggtgggaggattgcttgagaccaggagttcaaggctgcagggagccattattgcaccactgcactctagcctgggtgacagtcaagacctgtctgaagaaagaaaaaaaaaaaaaagaaaatagtgatagagtgaggagagactgaaggaacagacggaaatgaatgggagcagctgcccagagagggcctgggcctgcctttccatcaggggagctgcccaatatagtggttggggagtcaggcatccagggacttccaaccaaccttgcacatttttttttggacacgtgtgaccagtggaagtaaaacctgtctcctgggcccacaaatgctttggacggataagttgtgctcaagcctaggcccattcaggtagtccacatatgttttcaaccagagctgatgagaacagattgatacagcctgtaccaggccagtgaattggcagtgtatgatactttaaaaatttttccatacccagaaatctttttccatctctaacaaaacactttgaaagtcagcataaaagtgagaacacagacttttaaataatatcttctactggatctgaaagttttggatgcaagaaaaaaatcctggatcatttaacattcaatggatatttattgaggagcacttcttaaacaccagatactgtgctgggtactagagcttcagtcttttgatcatattgcatcaaatgttattaatggaacattaacatttgattctatttcatgttaagctcttttagccccaaacgttatacagcttggtccataaaccttcagttggttcagcctgttcacttatgtttgtgttcagttgttgaatgtttatgtgtaacaggcaacatatgttgggtgctcagacagttttgaagatgaacaagaattggagagagttctccaattctctagctggttgactggaatttaccaggtagatctggcagctgtctagtttgctgggattcctcccagaggagagtatagtcagcagcaatgtatcccctttccttattctgtttggattgggcccttccctttgccctttacaccttctccctaatccctgtctttaaatttgagacaaacgaaaattagctcctttgtattaagtttgggcagctccatcaggacagcacttccctgatgatgccctaaagttagaaacccttccaggagaatctctgttgccatgtaatcccaaagaagagccttctcggcgtgctgtttcctccttcctatgaaagttgcttttgcctactgtgtggatacagggtgcacagcacttggtatttctcgggctctttgcatctgcctgctccgttggctcactgtggggatgctggcaggggcttggtgtcttgttttcttagaatgaatgatgcagatgagcagcctctctagatgatgggaaaatttagcatgatccatcatgatccatcaggctaaattttcccgtcatctagagaggctgctgctcagaataaaagagaggaacataagatgggcgcccaagaggagtgctttattgagcctttagattgccagcctgagcgagatagtcttcccctccttgcttggcatctggagccagcttgtacactacacgtttgaggtttgctgttctcttcttttcttttctctcttctctactcttccctccccctcccttcccttttcttttcttttttcttttctttctttttcttcttttgagacagagtctccctctgttgcccaggctggaatgcagtggtgtgaacacagctcactgtagccttgaccttctgggctcaagtgatcttttccacctcagcctcttgagtagctaggaccactatgtgggccactatgcctggctaattttttcaaaaaaatttttttgtagagaagccgaggcaggcggatcacttgaggccaggagtttgagactagtctgaccaacatggcaaaacccatctctactaaaaatacaaaaattagctgggcgtggtggcacaggcctgtaatcccagctacccaggaggctaaggcatgagaatcggttgaacctgggtggaagaggttgcagtgagtcgagatcatgcctttgcactccagcctgggtggcagagtgagactctgtctggaaaaagaaaaataatttatagagatagagtcttgtcatgttacccaggctggtcttgaactcctgggctcaagtgatcctcccaccttgccctctcaaagtgttggaattacaggcatgagccatcatacccagtggctgctgctttttttgtgtctgtgagctcctttaatagaaaactacagaatagaaattatttccaactttcaactttaaattggttcttttaggccaggcactgtggctcatgtctgtaatctcaacactttgggaggccgacgcaggtggatcacttgaggtcaggagtttgagatcagcctggccaacatggtgaaaccctgtctctagtgaaaatacaaaaattagctggtcgtggtggtgcacgcctgtaatctcagctacttgggaggctgaggcaggagaattgcttgaacccaggaggtggaggttgcagtgagctgagattgtgctgttgcactctagcctgggtaacagagcaagaccctgtctcaaataaataaataaatacataaataaataggttcttttaaaaatgtaatatatggccagacatggtggttcacacctgtaatcccagcactttgggaggccaaggcaggaggattgcttgaggccaggacttcaataccagcctaggcaacaaagtgagatcctgtctctacaaaaaaaaaaaaaaaaaaaaaaaaaaaaaaattaactggggcatggtggcattcacctgtaatcccagcactttaggaggctgaggggggaggattgcttgagcccaggagttcaaggctgcagtgagctgtgattgtgccattgcacttgagcctgagcgacagagtgagaccttgtctctaaaaaaaaaaattaaaaatatagtgtttgctttgcagtacattctaaaaaaataaaaacctcactttcccaacacccagagaaaaatcttagtcctctcctttctaggtctttctctacgcatacagatgtacatatttatattctttttctaccaaagtaagattatactatatatactgttttttattctatcttatttttcaattacgttcacttttctaattcagtaactttttattttaactaatactcagaccatattcagatttccccatagtcttagtccattcaggatgctataacaaaatactttaggccaggtaatttgtgaacaacaaaaatgtattgctcacagttctggaacctggaaagcccaagatttggtgtttggagagggcctgctcttcataggtaggaccttctggctgtgtcctcacttggcagcggaggctaacaggctccctcaagcgtctttcttttcttttctttttgttttttgagatggagttttgtgctcttgtcgcccaggctgtagtgcaatggtgcgatctcagctcactgcaacctccacctcccgagttcaagagattctcctgcctcagcctcccgagtagctgggattacaggtgtgtgccaccacgcccggctaatttttgtatttttagtagggacggggtttaccatgttggccaggccggtctcgaacttctgacctcaggtgatccacccgcctcatcctccctaagtgctgggattacaggcgtgagccaccgcgcctggccgaagcttctttcataaagacagcaatcttgcttatgaggacagagccctggtgatctaatcacctcccaaaggccccacctcttaataccatcaccttggggttagattttcacatgaattttaatcacgaagtttaattagcagtcacactcataaaagcttatcaggcccacctcccaaatgtgtcatgaatcgtccttctccttactgtcttgctgcctccaatccagccaaagtcttgaccctcttttgccagaatgcagctttcatttctcagagtgctgcctcagggtgttcagtcttctaggctgctgaacaaatgagctttctagaatagtttaattgtgatacttctttgctaaaagctctttgctttcttattgaggagtaacacagtaaagtacgcaaattttaaatgtatagcttaatggatttcaacgtttgcatacattgttataactaccactccgatcaagatgtggagcatttctggcatctcagaaggtcacctgatgcctcttcccagacagtatccacattcctatcccaattactcttctgttatcatttgttttttcttttctcttatttacttgtttatttactatttttgtaaagacaaagtcttgctatgtttcccaggctggtctcaatctcttggtctcaagccatcttcctgtgccttggcctcccaaagtgttgggattataggccactgaacctggcctgttttacctttttttgatccccatattaatgaaccacgaaagctctttattgattcttctttgacaggataattccaccctttaatgtgacattcagaagtctttgtgatctggcttttacttcagtcctccacttgcaccctgcccttctgccacgccgaaattgcatgtagcttgtcaacatagtaggcgctttcattttttgcacttgatagtctcttgccctcctcactttattctttggcaaattcatccttcaaaactcagctccaggcagaatcaaggccttctctgctctccagaagcaacaactgttatagggagttgcttttatacctataacgtttttctcctctactggtggctttgggctttcaggagcccagggataatggggcatttcccccctaattagttagttgaatttcatacaagtaattcatggtctttctagaaaaattggaaaataggaaaaagatcacccacaatcctactacacagagataattagtgtttatatatataccaaaatatatatgaatactttaaaacgaattaaaaaatattcacaaaatactaaatatttgatctactttaatctcctgttattgtttagtttgtccccccctatgtatttaaactattacagaaatgctatggtgaatatccttatacccatattttagtgcagttccttgattattttggggattcctagaagtaaaagggatgaacatttttaaggacttttgatgtgcttagccaaattgccctccagaaagtctttaacctgtgtacactgtacacttctactagcgtgagcgagagtgcctgtttccagccattcttgccaaactaaaaagaatgaagataatcggtatttgcaaatctgataagataaaaatggtattgcatttctgttttaatttccatttcttggattgctatggagcttgaatattttctcatatatttaatggccgtttaatttctatttcttttatgatttacatgtttttgttattttatttttaaattgacaaataattgtatatatttatgatgtacaatgtgctgttttgatttatatatatatatatttagaatgactaagtcatgctcattaacatacattaccttacatacctatgtttttttgagggtgagaacagttaaaatctacactattagtaattttcaagtatgtgatgtattgttattaactatagttgccatgatgtgcagtagatctcttgaacttatttattcctcctatctctctgaaattttgtgttctttgaccaacatcaccccaatcccttcatcccctagcctctggtaaaatggttattttaccctctgtttctatgagttcaacttttctagattcggcatataagtgagatcatgtggtgtttctctttctgtgcctggcttgtttcatttaacatagtgtcctcaggttcatccatgttgtaggaagtgacaagatttccttctttttttatagctgaatagtattccattgtgtgtatataaaccacattttctttttttatttatctgttgatagacactcaggttgactccatatcttggctattatgaataatgctgcaatgaacatggaagtgcagatagctctttgacatactgatttcatatcctttggatatatgctcagtagtgagattgctggatcatatgatagttctatttttaatttgttgagaaatctccatgctgttttccagaatggctgtaccactttatattcccgtcaacctccacatcctctccaacacttattatcttttgtcgttttggtggtagccattctaataggtgtgaggtgttatctcggtgtagttttaatttgcatttccctgatgattagtgatgttgaacattttttcatatacctgttggccatttgtatatcttcttctgaaaaacgtctgttcaggtcctttgcccatttttaaataagttgttttcttactattgtgttgattccttatatattttgggtattaaccccttatcagatcaagcagttttatattttatttaatgcattttaccaacttttaaaatattaagaacaactcatatatactacatatgtttttcacagtttgtcttttaactttgttttccacatacaaaaatttttagtaatttaatgtgaaatttatcagtttttgtgtgtgtgtgtgtgactgggtatccctctgtcctccaagccagagtgaggtggcacgatcacagctcactgcagccttgacctccttggctcaagtgatcctcccacctcagcctcctgagtagctgggattatgggcatgtaccaccacacctggctaatttttgtattttttctagagacggggtttcaccttgttgcccaggctggtcttgaactcctgggctcaagtgatccacctgccttggcctcccaaagtgttggaattacaggcatgaaccacagcacccagccttattggtcttttcttttctttttttttttgagatggagactccctctgtcacccaggctggagtacagtggggcgatctcagctcactgcaacctctgcctcttggattcaagcaattctcctgcctcagccgcctgagtagctgggattacaggtgcctgccaccacacctggctaatttttgtatctttagtagtgatggagtttcaccatgtggccagactggtttcaaactcctgacctcaagtgatctgcccaccttggcctcccaaagtgctgggattacagatatgagccaccatgcctggccttatcagtctcttcagtctttctgtctgtttttttttttttttttttttttgagacagtctagctctgtcgcccaggctggaatgcaatggtgtgatctcggctcatggcaacctccacctcccaggttcaggtgattctcatgcctcagcctcctgagtagctgggattacagccatctgccaccacacctggcaaatttttgtgtttttagtagagacggggtttcaccacgttggtcaggctggtgttgaactccttacctcaggctatccacccaccttggcctcccaaagtgctgggattacaggtgtgagccaccgcgcccggcctgtagtattctcttcacctttgtatccctagtgcttagcagtgactgtcttattttaagtgttcagtgaatatttgcagaatggtgcaacccttgggggtccatgggtagaatttgaagggtctgcaacttggataggaaaaaaaaaattacatcattttcatccaccccgattgaaatttagtatttcttttttattatgaatataggcaataaaacagcagtaatggcagtacctgtgatttagccacccatagaaatcatggatatttccctggataaaccctgggttaagaatctgctttactgttttttttttcttgaggccattttatttttgtgtcaaatacctaagcaatacctggtactcagtagatacccaataaatattaatttaaaaaacttcttatttcaaaatatgcacaaaagtcaggagaactgattcagtatcttggctattatgaataatgatagccattgttcccatctgtataatgaactccatatattcttaatctgcttcaaatattattaacattttgccaattttatctttctcctccattcctggacattatgttatttacccaataatatttcgggaagcatatttgataagaactttaaaaatctataaccactctctcacatttaaccaaactaacaataattccttaatatcatctgttattcaggtcatatttaaatgtcctcagttgtctcaatgttgtctggtatttaaatgctgggcatggtggcacgtgcctgcagtcctattttattaataatgtgtttttgacaattgctctttccctatttaacattttattattatttttaatgggaaattattgatttgggttctttggtcttatttgtaaaacttaaaacatttaagtctcatttacagttgttcttggacataatttaaagtgaagtgtgtgatgggtaaatttcttcaggtatgatcaaagctctaagagatatttctttttcacttgctcaaagagtctactcaccttgttacactggaggtaaaaatactttctctgagagttttatatgcatctctggactttaattgtatcctttgcaaaattggaagaaatttggatttgggtcttctcagcctgctgagttttttctttttcttatgcttaaaaatatgagaatgtcatagtggtagtctctggttgatgattttgtacatcttttgtactcagagcaaatccttctgttgtttttagatagcatttttttctattaaactttatagatttgaggccatttgttcaaagactttgatcatttgcgggatagttctctgagctgcattccttcttgtgcttgtcatcttgtgcatgctttgaatcttttattgaaaaatatatttttgtattttatatctttttctgattagttttttctgtagcatcacttctgtttttattgcattcatcagttcatttagtatggaccttacgtttctgtttcttttgcagccagcacttgcgtagtctgtttcattgccttgagaatcaatatcagccattctgtaaatttgatgacaaatattgagagcttgctgtgaggaaggcattccattacagggattagcttttcttttcttttctatcgttaagctttgttttctttgactgcttatacccttttcctatatattcattcttctctgtttactgatctttctttcatagtttcaaactattttatttgtattgtatttactgagatttgtgagaaattcttttaaatatactattgagatcccactttatgttcgttataaaaggtaaaggaattgaggtattttgaattttgtaatggcgagtgtaattaatgatcacctaattataatccccccattttaggaagtgactttgtataagggaaacgaaattccaaattcccatttcattcttgttaagattagcttgaagggagagcctcccatgatgggagaatgctctccactagaacgtggtttgtaccatgtgggcgtgtctctggagagctggctcattggtgctacagcctcaggtagagcagcagctgaatgactgactctggagaagtttcactgagtggttagcaagtgtgaagccctaagccaaagactatgaaagacccaagaattcagaatccacatgtatataatgaacctttaattttgtgaaagagatagacatttggatgagtggcaggagacagtgtgtgtccattggaactgtaagcaagtaggtgtcccgcacagtaaagcattgaggggtcaccctgtgggacaggaacatgtctaagtcacaagccttatcttcagagaggcatcaaacacctacagcaaagagctaaggattaatatcaaaatacaaatggatcatggagcggtttagaaatattgcaggccgcctctggtataaacagagaatgatgagggtttagaggtagaagaactgactataagcagaagtgtttgaggaggctgcatggagaacaaggggcatcatcttggcccttggcaggttggcaggatttgacttggtgaagagaacgagaaaggggactttaactgggaggactactctggggcacagaggagggaagctgttttatgaaaccaggttcatttgttcccatctgtaggttctgccctgtccgcaagcagccgcgtcttggctcactcctcttctcccctcctccccattgtgatgaccatgagccttctcttggagtgtctgcccagtgggcccttcagcctgggcgctgctttggttcggatgatactgtcctccacttgtcttcttccaaggatagatagcgccctgacctctagggccagcagcctgttgggggatcttccttccaatgtcaccagccttaccagcttcttgagtatttattccttcataccacactcagccttcttctggctccttgctacttgttctcttagcatagacactgtcccctctccctttccccagacataggcttccaggttgcaattccatgagtgttcataacaagcctcagcagtacactttaggtcttactgtccttatgtcctctggcacgtccctgtctgtgttgctctgtggaccatggtttcccatctagaaaccattacttgcagtggggaatgatgcacatgaggaccttcgaagggcttgtaggagctgaggctgtgggaataaagtgtgggccctgattctgaagggacttgattcagtcctgaagagaaaccgtgtatttttggtttctagacactctgtaatttatttaatcagacctttattgagcacatttaggctgtcttcagtctctttctgttaaaatataacagtaattatccacgaataaacataatttaatgttaattttgataatgccactgttttggtgggagaggcagataagctagtagtcttcagacagggtatattttctagatccttgactttctatgtcccctttccaaaggctgatctgtctgagaattcagttgcactcaaggtgtttcctttctcaatcactcttctcccactttacaaaaggaagacatagtcattattaatctggagtcttgctgtttgtgtgcctgatgtgtgaaagcctccagattaacaagcaaaggaacaattaggactattattaggaaagtgaatgactgtgagtagcaaatccttttctaagtcagatggtttccaattcttgctttcaacaaaattgaaggcattgtcagttggtagataattaaaaataatttttgattataggtcatgacatgattttgacttgtgattctaaagatactgatattgctatagcaaaatttattttacttctcccattcaagtactaacggggcctgaccctgcttagcttttgagatcagacgagatggcacattcagggtagtatggctgtagactgtcacttctgtttagttatttatgtgaacaaggtttcttggtgcttaccactataaaaatgaaaaattaatgcattttgaataaaattttactttttatgtttaataatagtaccaatttctaaaccaattatgttttgatcatttgcatattcaaacaataaagataatgaaaacccaatccagaagaagaattttttttttaacatttacaagttatagcctggatgtggtggctcacacctgtaatctgaacactttggaaagccgaggcaggaggatcacttgaggccagtaattcgaaaccagcctgggcaacaaagcaagactctgttcctacaaaaataaaaaatagaaagaattagctgagcaatgtggtgggcatctgtagttctagctgcttgggaggctgaagcaggaggattgcttgagctcaggagtttgaggctgcagtgagctatgattatgccactgcactccagcttgggtgatacagcaagaccctgtctctaaaaaaaaataaaataaatagaataaaaaattgaggttataatcatagcagaatttaaaaatttatgcatttatatgtatatatgtataatactaatatatatattgcagagaagtataggttgatcagtaaaagattttgaagcataaatattaggataaaattctgaaaacgaaataaaaggaagtaagagttaacaaaaaggcatagtataaaatgtatgttcttttaaatagatgatccactatggcatttagagtccattggatcatttagattcatttaagagagtaatgttgtatttaatttaaaaatgtaaatatttatttatttttaataaaacatttttgtcgagacagagttctgctctgtcacccaggctggaatacagtggtgcaatcatggctcactgcagcctcgatctcccgggctcaagccatcctcccacctagcctcccaagtagctgggactgtaggcatgcaccaccacacttggctaacttttcgatttttttgtggagctgaggtttcactatgttgcctaggctggtcttgaactcctgagctcaagccattctcccacctcagcctcctcaagtgctgggattacaggcatgcaccactgtgccaggcctgtaaatatttataaaatgccaatatttagaatatggcagaaagtacgtctttactactggttgtgatgcaaaaatttaaatattaaatgtaaggagggtaatataacattcttttagggcacataagataaacagacatttacaatggagtatgatacagatgtttgaccagaggaaagcaaagaatgttgaggagaagatgcaagggaagcccatggccagagaaagcaaccaaaggaggtgccgtgggagcggcatcttgagggactgttggagttggcttagcaaacagaggagggaagccattctgggaagagggagtggtgtgtgcaaagggtctggaggtagagaatatcaggatcaaccttgggggaaagcacaggggtggcatgagcaggatggtgatttacggcagccagacagcgtattatttgtgacaggatttgtgtattccgtatgagaggagggcttggaaaggagaggcggtggtggggctggagatctgtggaggtagctgttgccaagggccaggcatgagcaagtgaggccaagaatgacccctgaaggggtgcttccttcccagtgactgttttccatcttagtaatcttctggacatttttacaaatgcagagattcttatttacattctgctagaggaagaaattgaggcccactgagagtctgttcctcttgcaggttttgtacttagtagcaatgggctgattgggcttagtgctgcagcctaaggttccacattggccacatgctcaattagggcctttagcttgttattaagacgagtgactccggccgggcacggtggctcgcgcctgtaatccctgcactttgggaggccgaggtgggcgaatcacctgaggtcaggagttcgagaccaacatggtgaaaccccgtctctacaaaaaatacaaaaattagccaggcgtggtggcacttgcctgtaatcccagcccctcaggaggctgaggcaggagaattgcttgaacccgggaggcggatgttgcagtgagccgagatcgcgccactgcactccagcctgggtgacagagtgagactgcatttcaaaaaaaaaagagagaaaagaagagcaactctaattttggagccaaaatttgagatccttaggccagtacaggatttttgtcctgatttttgaatttgcttacatgagaagcctttacagagtcctaaacattaaatcaaactgaatgtatgcatttacgaaatcacccttactgtaaagaatttaactgtataaactctttggtctcaggaaaggtagcacgtgtgacacttttctggtacagggaattacagggaattctttgtctttcatgatgtctccatcatgaaataagtgaaataagactttaaataagtgaaagacttgaaataagtgcagtgaaataagactgtgagcagtcccaaaaaatatttatgacaatttttttcccatttggaacatttgtttagcacagtgatagagacctgatgtggtgtttgcgcagggcagattgaatgcactccaaaaggaaaccataaagggtcgagtcgataccacacagaaacacgaggtggtgggatgagtggtttttccacattttaatattttccaggatgacactgaaagccttacccttagagaaccctgagccacctaataattcataactccagactcttgagagggagaaatggaggtttataccattaaatagatgttctgggcctttcctaagagaggctggaaagaaattgagggcagtcatcggaatgtgaccagcacagcaaggtaagggacactgcacgactttgattccttgtggaacaatgtcttcttaatatcagtatttccagctccctgtttttaaaaaagtctctaaaaagcctatcttttttgggaggacaggagagaaacctgtcaaggaagtaatgagtcagcaccggggacctactatgtgccgttcacaacttgatactttcgtgaacggattgtctcagagaggaggaaatcatgactcagagaaattatgtaaatcactgaagatccaggatttgaactttggttcatttgattgcagatttctttctactactttgtgatgccgccttgtgctgaaatcgtggagaatgggggatactctggattgaactggggaactcatggtatccagctaactggcctgaaaacccaagtacccttgatctggaggtgtttggggagaggaagaatgatggttagaatagaggaatcgaggagagagacatcaggagttgctcagactgtttccgtttcatggaaagggaattttgtgccatgtcatgtagtccatggtggtggttcggaagaagtgggtcctgaattcatctgctaccagttacccaatgaaggaaaatgggagaaatgtggcatatgggattttacaaaacacgtttttcttttattttgagacatggccttactctgtcacctaggctggagtgcagtggtacagtcataactcactgcagcctcgaccgcccaggctcaagcaatcctcctgcctcagcctcctgagtagctgggaatacaggtgtgtgccaccatgcctggatagttttttaaatatttagattttttttgtagagatgaggtcccactatgctgctcaggctggtctcgaactcctgagctcaagcgatcctccaagcttggtctcccagagtgctgggattacaggcgtgaggcacctggcttcacaaaaacacacgttttgtttgtttgtttgtttgtttcttaatttggaccaatataggaaaaattttaaattttttttttaggcaaagggactaaaaacaaaaacctcaaatctattatcatcttcacaacatataagaagagacatttgcaaatcaaaataataaataaattaaaaacaagtcaagaaaatgggctaataagacagcaaagaaagaaccttccacttgtctattatatagttaggttagatttaagatgtttgaatcatggaaaatgacagcgtaagtttcttgatatttgtcagtttgggaatttttatttagtagtgcaacattaagagaagtttgactgtccagcttgtttcatgcctttttcttttaaaatcacagttactgttgggagtccattttgacagattttgatgaaaacagtatcaacaagcattgtaatttcactcaatatggaatattctggtggatggcaaaaggggagtgagaacagttcttaggctttcagttccgtggccaggccaggaagaaagcaggagtagcagctcctgtgtgtgactggtgagggctgcaggaaggggctgcaaggacctgtctgccagtgcttcctatgtggggtggggctggatactgcacagcacccttcctgcccaatatggaacgggtaggagtcttacttgagagggatgctgtggatggtaaaaactttcatcttggccgggactgatatttaggagagcccctcttgtaaaggaattatcctgtttggttctccaaaaagagatctacaggagaaggcacagacaaaggccccattgttttctccagggcagctgttcattgcgttggtgctgggaggggtgtgggaagcttgcccgactcaggcctaggtgctcagatgtgggagtggtcctgccgttcagccctattattttcttctgagcctttcttgtggggtctttttgcaaactgcattttcctccaagcagcagaatcttagcttcaccttttttgtggtcttggtgccctggaattttggtgaatgctgagtgcctgggaacagaaaagcctgaaagcaccttgggaactccccaagtcccctctcttttgtccaagagaatacctacttctgcctttccaggggctgtgctgggggaagtgtgtgtgttggcctctctggagaagggcatgctggcttccctggcctgtttacattagtctcattctcgctgcccttgattacaaatgaggcattgggcgggggatttccctgcttccagggaggtcactccttccttttgtctgtgctctcaatttttccacctggggaagagctgccttgaaaaaaaaccccaaaactccccttagcttaactccttgtctcatagactgtccagtaagtggatcagttcataatcaggaagcaattcatctgtctcctgaaattcccttcccctgggttctcttagtccttttctcattctcctgtctctgctgtagttatcagcactccttcctaacaaaacagtgttcccaacccagagtctggtctgctcctgggtgcttcttgagctgaggtgttgatgcaagggttctggaccttaggaatgtgtgtcctggcactttgagtagaatggaaaccctttgaggttaagagctccaggttttttccttccctcttccccactctgtatgtaatgcttgtgagaggacaggaggggtcactggggagggggaccactggtggcccagtttgctggtgtggtcacctcagaagtgagggaaagcctgttgccctgagcatgggtagaaagctggcctcagacccctttgctcttctgtggaactccccgcccacctttcttgttcagttgaacagtgtcaatatcagagcctctaatacaattaagggatcctatttgaagccctttcttaaaggttattggaaagtgtaagtgaattttacttggtggtaacaacctttccactcttttcacagatttcacaccctttggagagtttctttcttggataattcaggtaggtttttaccttttgttttttaaatcagtggatctagttccatacagtgacttcttcagttcccccggcaaagatccttgttcgggtcccttgaatttccttctgattccactgatgatgctcctggtttcccagggcttccatctcattctcatagattcctgtgtaccttatcatgttgcaagctttattctagcttctgttaggccaaattagtatccattctctttctctcttcctccttttttcttcactggaaagttaatgttttgcctttgggctttttttctaagccaggtttcagttcagaccttggtgctgggagtaggcttggattcctgtgttatgttgcttcagcatacatctgtgttgtaggcctaagaatggtcattgcttctatgttgctctgagattttagctccatatccttttgatcaagctttgtgttggtgagcactttttgtgtcctttaagaattcctttcccgccccaaggtcatgaagatagtcctcctaagttttccgtaaatgctttccctcttagataacattcccatttagacctacaatcctatctttagatctcaaccacttttaaaactcggattcctttgttcccagcttgtcctcagtttaggattgcatttttcctcttttgtcacccatctgctggcctttgcagtggtctcttcgatttccctctgtgctgtgcctacccaactcccacagttttcctctctggcataggtcacagaggaaatatttagttagtccctgccaaacattctggctgtgttgttttgcttaaaaagacatgcagtaaactgttttgattcttggtcgtggtgctgtagggcagatgtttctcctataacggaggtgttgtggtcagttggaaggagcggtggacgtgagttcggagaattggattctaatccctgcagtgttactagtttgtggtgggatcttgcgcaaggcacatttgtatgtctgaatttccttttgttagaggggaacttatttcatggtgaagaagacaggactctgtgggtatgagataggaatctaaagagtaagcctgggagatccaggaaagactagacaggcaagaggcagagaaccattagtgtgagcatccttagtggaactggaagggaactcagatgactccaaacagataaaagtaatatatgtagtcactttgaaaaagtataaaacgtggtaagaaaaactgatggaaattctctgacgaggataacttaaggagataactgcctgtccatgcctcggcttgctgtgggtccacacgtgtttgctgtcacccttgggatgtgggaggcttagccttctgcgggttcagttccagaattcttcttcccaccttccacctccttcataaactcaggaatatttgaaactcagcccagatcttcacctggctttgatttctccatcatgcggagattggtccttggaagttgtagcttccagagaccttcgatgtttgctaacatgtccaagctctacatttattgattgttggttctgttcatggctatgttcaaattcttgtaccctgagggtggtatgatttggttccagcaaggaaggggagggtatttgggggaccctatcatcaagaactaagaaataaagggaaacggctggatgtggtgactcacgcctgtaatcccagcactttcggaggctgaggtgggcagatcacaaggtcaggagttcgagaccagcctggccaacagaatgacaccccatctctactaaaaatacaaaaattagccgggcatggtggcgggcgcctgtattcccagctactcaggaggctgaggcaggagaatcacttgaacctgggaggtggaggttgtggtgagcccaggtcgtgccactgcactccagcctggacaacagagcgagactccatctcaaaaagaaaaataaagggaaacaactgagtaggtgtcctcttggtgttcctgagaggcaggcctttgaagaagaaacaaaatggtttaacttctgcctatgtaatccccatccctcctccccaaatacacttactcagacagagctacatttcttccttatccctgtacccttctgaaatgactgagatttaatcagatcttgcatagtttagacttttttttttgttccagttaaagatttgcattggcttcttccagtacagaatgagttggacaaagacaatctccaaagtattttgctgttctgtggtcctttgtcgggcagaaattctcctaaagaagtactgagggccgggcatggtggcccacgcctgtaatcccagcacttcgggaggctaagacagacagatcacttgatcccaggagttccagaccagtctgggcaacatggtgaaaccccagctctataagaaatacgaaaattagccaggtgtggtggtgtgtgcctgtagtcccatccactcgggaggctgaagtgggaggaccacctgagcccagggaggtcgagactgcagtgagctgagatcgtgccactgcactccagcctgggtgacagagtgagaccctgtctcaaaaacaacaaagtagccgggcgcggtgggtcacacctataatccagcactttgggaggctgaggcgggtggatcatgaggtcaggagtttgagaccaggctggccaacatggtgaaacttcatctcaactaaaaatacaaaaattagccgggtatggtggcgaatgcctgtaatcacagctacttgggaggctgagacaggagaatcgtttgaacctggcaggcggaggttgcagtgagctgagattgcaccactgcactccagcctgggcgacagagcaagactccgtctcagaaaaaaaaaaaaaaaaaaaaaaaagaagtacagaaggatgcttgtctttgcagggttagtgatgaggatgaggacccatgctcactgttgctgtgcccaaccctgggaggctctcaggctgctgaaacttgctagagaaagttgtggagctaagtagaatatttctgggcagaagagctccataattgattctgtatactttcaagtaggacttctctgttattttgcaattttttttttttttttgtatttttagtagagacggggtttcactgtgttagccaggctggtctccaaattctgacctcctgatccaccaacctcggcctcccaaagtgctgggattacaggcatgagtcaccatccccggccctatattcaccatgtttttatgtattccataagccctaactccactgtgacctacatccccgatgaggatgcctcctactttcctgagactgttagagctaggtgacatagaactctggggtagtttattttctttagatagatcggtactcagccagccagctcaggagaacaggcagtgagcattccccgtaggctctgtagacgtgttccttgcgaatgccaacgatgtctggttgaagtaatagtttgatctggggctggataagagttgtgagcctgtgtctggcatttggtattttcccccattctttgatcttaagttgtcctaggcaggtgatccaactggtatctgtcacataatatccagtgcgtcctccctggcactccgattctcagtagtcatgaaccagctggcttctatatctctcaccaatcacaggtaatttaggtctccctcaggtaagtgttcttcagatcctactcacatcctctttaatccccatctttccttctctttctgtccttatgattttgcttaattgcctcccaaaaaaccctccttatcccctttcctttttgcctgtgggataaaagctagctttgatcatagctggtaaagtgtgaaaccaagaatacttctgaaaggacagtcagacatttgggaatgaaagtagacggtttgaagtatcagtgccatcactattgttcttgagaatgcttttaaagattccccccagatatccatcttttaattaacctgcccttcttccaggaccacaatttgaaacacgtaaaaattattatttatttgtttgtttggagacagagtcttgctgtgttgcccaggctagagtgtggtggcgcgatctcagctcactgcagcctccaccctctgggctcaagcaattctcccacttcagcctcccgagtagctgggaccacaggcacacaccgccatgcccggctaatttttgtatttttgtagagataggttttgccatgttgcccaggctggtcttgaattcctgggctcaattgatccgcccaccttggcctcccaaagtgatgagattacaggtgtgagccaccgtgcctggccaaaaatgatataattttattcctcttacattttgttttattgctagtatttacagaggtattgttttgtgtctttattatgtataaacagtatttcagccatgttgttcattaatgagcttgtctgcgcatctggctaccatgtctggtgttgtttctgtggaaaactgtcttcaacctataaagggcgactgcctgaaaaaggagcttttagtgaaaacacagtctgttcaccctctggcccctgctggtgaagttgctctagaagagactgactctgttcccattgcatgaagaggaagaaaagtgcttccaagggcttccgggagcaggtcaggaaagctaggtctgttttcttcagtctcggctagaggagctggaatgtgccatgcctaactttgcctaagctcttttctttttcgcactgtgtgtcacactgggaaaaacttgagcttaaaacccaatgaaattctcccactttgaaaatcatgatgtaattatgacaggatcgcattctttaaacttactgtttagtggggttagtggagttatctcctctgatttttgacaaggaaataatacattcttgttgcaatgctgtatcaggtcttaggatggaaagcgtctaatttaaagctacagacctttcctgtaggacgcatatgctgctaatctatgaaaactgaagatgtcccagtgcactgtgtgtaaactgcagcatctccttgtggaatgaacagttcaggaaaatagaatgactttccaaactgtactaggttccaggtgactgaaaatttcctgtgagggtgggaaagcttatccagatgttcttgcttggggatcagcatgtgtcatcccgttccaaagaagtacagtcacagctgattttatctttgtccttctttctgtggtgcccagggatgctctttttgagttcatctttggtcttgtctctctgaaaaaagcagcatgcattttgatctaggtttaaacagttaaaatctgtggccacagggtaaggtgaaactaatggctctaagtagccaactttttacctttgcttcactggcaccaggctgtgagtaactgaactaaccagctgcagacccttattatgcaattttgaggtaaggatgggtgaaatcctaggggctgggagacagacatgtttggctaccagagagatgacatcagttcatttactggtgctgtggaggaaggggagattccaggtgcttagccttcttcctgcatgtgggggtgtccagagccacccttaatcctattcgcagccaaggtctttgcttgggaaaaaccatatttaactctgtgcctcctgttatccccatagggacatgaagttggaagggttcttgtatctttggcttcccgaacaaagctttgaagaacagacgtgtgtctatatgtgtctctgtgtgtattttgtattaatgctagcaactgattaaggttttcagagtccaggtcgtatatgagaaggggaagtgtcatctggattttatggaatctgtattaggaattgccctttccttgcaaaggaaacagttaatgatgtaatccacttttaaattaaaattattttattattttattttgatatccttcacgtggacacttagtatataacaggaaggcatctttaataactctttctgtgttctgctccttctcctgtgcttatcctagaacagagccttacagggtcataatttggaggaagcacaggcttctgggagctgtggtactaacagtaggactaaaaaaagccttatgacctctgaagcatgactgagagaatcaagctgggaggcattagagcccatctgctcaccagctttgctggcctgtcagatgttgggcttcccctccggtttgccctcctccctcaagatgtgttagaaaatgaagcctgcttcctggaaagcaggtgacgccaaagcctatgctaagaggatccgacctcacatctgcgtgcctgccttgggctcccctgtgactggattgcttcgggtctccctaagacccttgctgacattcaagtgcagccgctgcttactggaagccgtctggggccagcccaggcttgttctgtcagggcctcttcccaccactgtgtcctcgcctcctgtgggctttcacatacaagggcctcaccatccctgaattgccagaatccttgttgtgagaacccagtgcctcccagtcagggcccaggaagctgtgggtaagctcttggtttccttctcggccagacacttctgggaaactatctgcattcctttctgcccaactctgcctctgggctctggggctgtgtggggtgtggctgcctcatgcctctgtgaggaggaatgctagttccactgagaccagccatggaaggtaaccaggagtttgaaggtggaattcccttttcttgcagtcctagagccaggagctagcttttcatggattgtgatgaggtgttggttcttttttttttttttttttttggagacagagtctcgctctgttgccaggctggagtgcaatggcacaatctcggcccacagcaacctccgcctccccggtccaagcaattctcctgcctcaacctcccgagtagctgggactacaagtgtgcaccaccatgcccagctaatttttgtattttgtactagagacggggtttcaccgtgttggccaggatggtcttgatctcttgaccttgtgatccgcccacctcggcttccaatagtgctgggattacaggcgtgagccactgtgcctggccgaggtgttggttcttttaaaaattttccaacttgctttcctgtctcgctgtcactctggaaggcgggggtgaggggtaggaggagagacagtcggctcagtcggctgtgatccatctttggcactggagatgggtgtggcagataccttttgtgaggaaggagcttagaggcagatgagagaatctgcctcttggtcttggtataactggacgtctccccagtctggctctgttgacactctgaatggtttgtgaaggcatcctctggcccctgaaggcattaccatccttaccaggtttaaaatctttcagagtgcacccagcatcatcagctcctgcaagcagaaagggcccaagggagcatgaacacacactgggtagaagttaagcctggttttttaaaatttaagtttaaatttttaattatttagggagtgaatcctacagaatttaatttttccatcttttttttatggagacagggtcttgctgtgttgctcgggctgctcttgaactcctgggctcaaacagtcctcttgcctcagcctcccaacgtgctgggattacgggagcaagccaccccactgtgtgcagcccagaagttgagcctgagaggtaggcttattgccctgtgtctacccaagggtgtgtgtgtgtgtctggaagtggagattaggagtgaatgcatcttataaacaggagaagatctggagagacgatggtgggggctggctgtggggagcacaaaagctgggacttttgcagaggtgtatttgctcccgagtggccagaagccaggagtagtggggaaggtgggtttaggcatgctaggttatgcttgcattgctgagtaccttgggtgtgatggccaggaatgctttcctctgggaattgggccgatctcctgacaatcctccccattttacacccattacatacttatgtgattcttacctatcagggaggtcttggggtcatgtgttgtggggcagaggctctgagtctaagaatgggctggtcagccaggggctccacctcccagtttgttggcttcctcaaggatgccatccttctttgcagctgccaatcttcactggtgtctgtgccctggcagggtatagagcccttctcatgggtgctctgcctctttgggggcttgagaacagatggggcttaatttgaagcagatttccctccagggcccaggtatgaaatatatattagaagatgactactggtcttggcttttctttcttatgtgtctctttcttccttttatcttcccactactgtcaggcactgtgagcagctgttgctatcacacgggcggatcagaacatgaagaatggagctaaatagagctgtctgcatgctgttctgatgggctcaggctcagcctcagagaataggtggattggagcctgtgatgggggctctttcccccaccagagtgggtgaaagcagggaggaacaggcgggaagatactttaggagttgggagggtattaattccacctcttctctccttcctctgtaccccaacattccctgtgagttgtcaagggctggagagataacaaagatctttctttccaccatcaggcagtaaggcaatgcagccctcgctgaattttcagctccactgacattgtgatgcaaatattaaataaagcttattttctgacctgagggaatttataagctattgggagagacagtgtttgttaaacaagtagagaatatccaagatcttaactgtgttggtttacgaaccatggatacatttatagttcagaacaagaaagttgtatcttaaaaccacagaaaactttccttggaggaggcaggatttttctggtctttaaagttgggtcaactttataaggaaaggagagatgttcactccagtgtcacggcgatgatctaccttggaggggtaggtgtggcagagcagagccagggacctgagctctggaagtcctgccattacataggtgatgtgaagtgatgcagtgaaggtggagttttgtggaaatctctcctgtagatcgatgaaaataggataattttggagaggccagagaaaggcagtgaggaggcctgctaaaggacctggcaggtcagcaacaggagagaggaagggggcgagtcctagagaatattccagagtagatgaggcaggactgacatgaaggatgaacttgaggggcaagacggaagacaccaacgtttctgacctgtgagagctaaccaatactgacacgttctgtttgtgaagtacttggacttttcaaagcactttttcattcagcagagcattgtctgggctcttagagttcatctagtctggctctgttttatagaaggggagattggggacgaaaggggaagcgactgttcccagcacacacagctatttagtggtggggcgggacccgtgatataggcctctccctcctaagacaattttaagacaacagcagcatggaagagagtgtgggcttcgcaggaagtccgtctggctggataacattaggtgataaaccaatctctgagagctgagagaaacttactcagaagcattcagaccatatcaatggttcagctcctcagaattgtttttgagaaccacagagaaggaagatggactccttgggtccttctagttctcagattcataggagtgcacaaaaataatgtatatgaatagtactgaatggggctccccggagactggcgggtctccagtgtggtgcctttctaagggaattttcaagataacttgactccacatgatttttgccttgtgctgaccacggaagctgactgcaaagacaccactgctgaattgcgctgtggccagtcatcaccacagccaggggctcagcattgcagtgacggctctgatgtgtcacccactcctctcccacctcctcttacaacatatgctgcacatgcacatgcacacacataccacacacacaaacaccacacacaccacacatactacacaccacacacacaccacacatatgcacacacaccacatgcacaaaagcacaccacatacccacaccacacacacaaacacaccatacacaccacaccacacacaccacacacaaacacaccatacacacacacgcacaacacactccacacatactacacacacaccacacacatgcacaccacacacacacccacacacacaccccacacacacacactttctcctcccttccctgcctccctccttcctttcatcttactttttgtcctccacagtttcttgtctcatccctgtcttccacctctgctccccgctcttgtctggtctaattaacttcctctgttggagcagcttcccctcttgggtaaactcagacatgaccgcagcaaagcagcgtggaatcttctgtttggtcagtgttccctgaaatggtggtggcactcagccatccgggtcagaagctggagtccttctggagctttgctcacctctgcagctggtcacctccgagtccttgtttcctattaaaagagtgctcggtccgccctgcttgtccccattctcaccaccccacatggcaggagaggaagcagagagggatcatggtggaagaaaggaacgcagagatgagggtcccctttggtgtccttgaaagcagtgacccctcacagagtgggttcttgtggtctgcgtcctgacccccagcttccccgcagatacagctgcattggagcccctgaagacaaaccagagaagtgctgcatcctggggggcaggaggctttgctttgcccagggctgggctcctgaatgaattttggtgcagccttaacggccgagttgtgctgttgaaggtgcactgctctgtgtccaggcacttctggaagaggaagtcaaggtcatgaggctgaattaggctttgtgtgctccttctaggttctcagcgtctgtctggtcctttacttgctttagatctctgccccagccactgtaggcaggaacagctctcttccttgagaactcaagaggttctcaaggtagtaaacttcatggtgctcttagtttagtctgaatggccttggccttggggtccatcccaagttccatagccagcagttgggtccatgtctcacatttttgtccctgtctcctccacacaacattgccacagtccacccccgttccccctccccacctccagtctggtgcaatagggatttaaggaggaaatggattacctggatagtagaggaaggaagtttgtggctggcaaattgttattttatttggaaagtctatcccattctctcccaaccctcagagcataaggtgaagtcagatgtcgttgagctgtctctcttcctagccatcttggataaaacagaggtacagggttcacccttcagaagcttgctgagacagtcttatttactaaaacaacaacaaaacaaaaaacacttcaagcccccaaatcccaaccacataagtctctaagcctctgacaactctcgcatctctctgggtcttggaccctctgtgacaaagcagtggtaacttggtaactgtcttgggagcacgcagagagagtcaagcctcatcttgccaaattttcccagagtatgcaccccttcttcatctcctctgggcctttaccttagaagagctgtgtcatgcattactgatggcagaggctgtctgcattggagatgagtggctataatctttcatcaccttcaggagaactgtgaaatcgttgacttcctttatctgctcgggtttgagatgagctagcatctaccagttttagcctctggagtcccatggccttgtaagaagggagtgttctgctggcactagctgtgcgggggacagtagtccttgaccctttgttcttttcactctgccttcctcctctcagtcgttcacagctcagccaaccagctaagtggggtgtaggcagatgtatcaccccagggtaaggagccccagacagggagggaataaaggctttctgaattctttctttcctgcaaattcaaaaggctaagtggtgctcaagtatgttccctgacatccctgggagtaatgctcaggaattcccccaaatttgccactctgagacttccaaacaagcttcctcctgtttctgtccttcaagatcttaaattgctttctactctccccgttccctccacattcctctgcttttcctttcatcatctccctcatcttcccttccttgaatcgtggggtctaattgatttctctatcacacaggttgttcaatgttgatctctaagtgaatgaacattcataaggacctctttttacacaaaggcaaactagctctcttccgcagaaacataggatgggcccagtgcatgtcttgttagataaggagctaatcattgcatagattaggaacttctaagttcttaaccttggggaaaaagaagatagtttaaaaaatggcatcttctcctgtaggatgttgacgtttatttagtatgactcatctgtagatcagggccgccttccatgttcctaggataagaaccggatgttgaatggccactgctcttctctctccccagatccttagaagaagcatcatagggttcctttacaggagataagctggtatgtctatatcccagcaatccctgaagaagctgaaatgctgcattcctaccatctaatgtttcggttacagcatttaagcctgagtccttgctcacaacagctatcagatgacagcttagtataggaggttaaagatccacaagaattcactctgatagttaaaaatatcactgtgattctgcttgtagtgaaccatggtttggggagatgatgggtcagaattgtttggattcctgagctgctctatatccttgataaagctcggatggtcagagccccagctgggaggttttgatgtgactagcaggagggacaaagggcaggtcaggcagggcccagctgtctcttctttctgtgagcgttctttattccccagagatgactccgtggggataaaagcggtagttttctatcttcttgttctgcaggagaacttacaacctcatgaatcagacgtgttatcttctcagtttaaggggctccaaaagacttgatttcctttttttctttcaatatatttgtctgaaatgttattcaagactccatttaccccgggactgcaaatataatatatgtcccctggaaacacttttgttctaaccagaatggagcagagtaggacatgaatctcatttgatctgggccctgtgttttgtcagctaaactcaaaatcacatttgctcatcagttgactcatattgaacctttcctcaggtctttttcactaataaccatctttatcctgttgtcttgcagtatttttctaagcttcagtgtaaaattacatattttaccctttaaaaatttcatcttgccgtatttaacctatggttccagtttgtggaggcttttctctctgattatatctagtatattcattatccctcccaattaatttatcataaacatatttgataattgtgtcttatccaagtcattgataaaaagggtaaccatgatgagatctagaataaatgggaagagaaaggaatattacagggcaacatccctgatgaacatagatgcaaaaatccttaacagaatactagcaaatagaattcaacagcacactgagtctaataagacaaaggtccagtatccagcatctataagtaacttaaacaaatttacaagaaaaaaaaaacccatttttaaaaagtgggcaaaggacatgaacagacacttttcaaaagaagacatacatgtggccaacaagcatatgaaaaaaagctcaacatcactgatcattagagaaatgcaaatcaaaaccacaatgagataccatctcacaccagtcagaatggctgttattaaaaagccaaaaaagtataggtgctggtaaggttgtggagaaaaaggaatgtttatgtagtgttggtgggagtgtaaattagttcaaccattgtggaagacagtgttgcgatacctcaaagacctaaaaacagaaataccattccacccagcaatcccattactgggtatatacccaaaggaatataaatgatttgattataagatgctgggtgcagtggctcatgcctgtaattccagcacttcaggaggccgaggcaggcagatcacttgaggtcaggagttcgagaccagcctggccaacatggcgaaaccgtgtctctactaaaaatacaaaaaaaaaaaaaaaaatagctgggtgtggaggtgtgcgcctgtagtcctagctactcggaggctgaggcaggagaattgcttgaatctgagaggtggtggctgcagcaagccgagattgtgccactgcattccagactgggtgacagagtaagactctgtctccaaaaaaaaaaaaaaattttgtttgattataaagatacaagcacatgtatgttcattgcaacactattcacaatagcaaagacatggaatcaacctaaatgcccatcgcagtagactggttaaagaaaatgtacatatacagcatggaatactatgcagccataaaaaaagaatgaaatcatgtcctttgcaggaacatggatggagctggaggccactatccttagcaaactaatgcaggagcagaaaaccaaataccgcatgttctcacttataaatgggagctaaacattgagtacacatggacacatagaggagaagaacaggcaccaaggcctacttgagggtgaagggtgggaggagggagaggatcaggaaaaatactaatgagtactaggcttaatacctgggtgatcaaataatctgtacaacaagcccccatgacacaagtctacctgtataacaaacctgcatatgcacccctgaacttaaaaaaaaaaaaagaggccaggcatggtggctcacgcctgtaatcccagcactttgggaggcctagttgggcagatcacaaggtcaggagatcgagaccatcctggctaacacggtgaaaccccacctctactgaaaatacaaaaaattagccgggcgtggtggtgggcacctgtagtcccagctactggggagcctgaagcaggagaatcgcttgaacccgggaggcggaggttgcagtgagctgagatcacgccactgcactccagcctgggcgacaaagcaagactccatctcaaaaaaaaaaaaaaaaagaagaagaagaagaatgagcagtggcctcaagtcacaaaaaaaggaaaaaaagggttcatgtaccatgatcaagtgggatttatccctgggatgcaaggattgtgtattagtccattctcatgctgctataaagaactgcccaagactgggtaatttatatgagaaagaagtttaattgactcacagttccacatgtctgggaggcctcaggaaacttagaatcatggtggaaggcacctcttcacagggtggcaggagagagaatgagtgtaagcaggggaaatgccaggagcttataaaactatcagatctcatgagcctcactcactatcatgaaaacagcgtgggggaaatggcccccatgacctaatcacttcccattggatccttcccatgacacctggggattatgggaactacaattcaagatgagatttgggtggtgacacagccaaaccatatcagatggctcaacatatgcaaatcaataaatgtgataaaaacagatgggatgtgcctaaacttctaggagttccagagctcctcttcctggttgatgcagattcatttcatagcactgtttggacccagctgtcctgagttaccagtccatccagctgccggtgcatctctgatttttttttctttaaagatcaagagagatttttctgaagtccagataaattatgtccctgacattctttgccatatgtatgtgcatatgtgtgtattcatttatgatatatatattatatacaaatatatattgtgtaaatatgtatggatattactttttaagtccccaatctgttatttatggatcacttactagctattgctgagtgttttacatgtattatctattttattccctacaataattatatagtaacctcattaactaaaagtaatgatgtctcttgatgcgatttgtacttaatctccagggatcaatacttccttctctgagtccttgccactttttatatattcttttctggagttttgcctatgatattgattaagaaatattttttgagcacttgctatgtacaaagaaagtactgcattacagcctgctggaaattcaaagatgaatatgctagaagagattatatgtaattaaaaatgtaagggaatgaacaatagcttggtagggaaaggaggaaaaacaaaagaacagtcctgagtgtgaatggaatgccgaaactagcccacctgcagagttcgaaagggaaacctttagaagccatggggatggtacagtccacgttagattctcttcacagaggtggaaagtatccagttgactgacagttttaaatcctatctcagtaccttgttggagtggctccgtgagtccgaggtcaaagcggaaggttgcaggaaagagtccacttttgaaatcttttctttaaaaaaatgttgctaaacgttcagttataagataaatcctgggaatctaatgtacagcatagtgactatagttaatactgtattgtttacttgaaatttgccaagagagtaagtcttaagtgtcctcacctctccccaccacatacacaaaatggtaactgtgtatggtaatgaatgtgttaatttgtttgtgatagttgtttcacagtgtattagtatatctaattatcatgctgtacatctttagtatatagaacttttgtcaatcataactcagtaaagttggaaaaaattgagaaattatttaaaatatgtagaatgtctatttttatatgtatagtttaagtgacccaccacctagcttaagaaagaaaatgctactattaactttaaaatctcctgtgtccttaccagtaattgatttaatttaagaaaataaatgtatgttgaatggtagaaaatagttcacaagtttgagaccagcctgggcaacatggcaaaaccccctgtctacaaaaaataaaaaaattagcagggtgtggtggtgcacacttgtagtcccagctactcgggaagctgaggtgggagaattgcttgagcctgggaggcagaggttgcagtgagccaagatcttgccactccactccagcctgggcgatagagccagaccttgtttcaaaaacaaaacaaaacaaaacaaatctacaatagcagcagtgtagaatatgtagaatttagtaaaaaggaaaaaaattgctaacatgattattgcttggtataaatttttttcacttgcatatgtctttacattttaatgtagttatagctttattatgcataattagcgttgtctcccatgctaataaagtcttcgtaattgccatttaaagttagttctttttttttttgagacaggatctctctctgtctcctgggctagagtgcagtgacgtgatcactgttcactgcagcctctatctcctaggctaatgtgatcctcctacttcaacctcctgtgtagcggggactacaggcttgtgctaattttttttttttatttttggtagagacaaggtctctatgttgcccaggctggtcttgaactcctggtctcaagagatcctcccaccttggccttccaaagtgctgggattactggtgtgagccagctagttaatttttaaataaaaaacgtgttataaattcaaaaggtacaaaaagatatacagtgaaaagcaagttttcctcccaccctcttttctccttagaacaaattgctgctaccagtttgtggtttatagtagtttcttttaaattttttaaatttaaattaaattaaattaattaattaatttttttttttttttgaggcagagtctcgctctgttgcccaggctggaatgcagtaacacgatctcagctcactgcaacctctgcctcctggttcaagcagttctcatgcctcggcctcctaagtagctggaattaaggcatgcgccatcatgcctggctaatttttgtatttttggtatagatggggtttcaccgtgttggccaggctggtctcgaactcctgacctcaagtgatccacctaccttggcctcccaaagtgctgggattacagatgtgagccgctgcacccagccatagtcatctcttacaatggctgcacaatagtccatctagtgcagtttttcagaccaagggccataatccattattgggtcaggaaatcagtttagtggggctctatgtacttcgttttcttaatttcttaataacatagattaggattgaaaatagcagagagcatcacatacagtaaagatagtgttgttttgagaaacctttttggttcagttttttacacacatgcacatacacacacaccctctcacacatgcatatgctagattacaatgtaaaacattctttattgggttgcggtttaaaaaaatactaatctaggaatgactgatatggagattgtttctaattcttaaaattattaaaaatagtgctggaaacagacatttattctgcatacttaggaattttctcttaggatattctccctgagtgaggctactgagtcaaagtctgtgagcattttaattgataagttactttccaaaagccatatcccatttactatttaataaatgtcatctgtgctttgtttagcataggttatttttattttaacacagactgttttctatgggtaatatatgtgatatatatattttttaacagaaagggatgatttattaattttacccccaagtaatataaagtgaacatttccctattttactaaatattcttcaacagcagtgattctcattctgggggcgacttttcttgggtgtagggtaaatactttagtgcttcccaaacttgagtcagtcttacctacctttatgattttttcctgtaaccatgtattgtatatacttttatttacttatctttaaatttggcttttaaaaactttttacttttaaataattttagacttagagaaaagttgcaatggcagtacaaattctcctaatcttgtgtaactacagtacaatgatcaaaactaaaattgatattgatatagacttactgggatttcaccagtttttcttacgaaactcctttttctattccaggatcaaatccaggatcccatgttgcatttagttgctgcgtctccttagtctcctctaatctgtgacaattcctcagtctgtccttgtctttcatgaccctggcccttttcaggagtactggtcaggtattttgtagaatatcccttaggttgggtttacttcatgttttctcataattagatcaaggtcatggatttgggaagagcaccacagaggtgaaatgcccttctcagcacatggtatcggggtacgtggtgtcattatgtctttattgcctgtggtgttaacgttgatcacttgattaaggtgatatgtgtccatttctccaccgtgaggttatttctacctttgtaattaataaatactctgggagagatactttgaggttacacaaatatcccattttatcttaaacttttttttttttgagacaaggtctcactctgtcacccaggctgtggcgtgcagtggcatgatcatggcccactgcagccttgacctcctgctaggctcaagtgagcttcccacctcagtgtcgaaagtagccaggcctacagctgtgtgccaccacgcctggctgttttttattttttgtagagatgggggttttgccatgttgcccaggctggtctcaaactcctgagctcaagcgatcttcctgtcttggcctctcagattgttggaattacaggcatgagccaccaagccccgcctctccttaaacttctacctgctataaaacaatactaaaagcatacaaaaaacgtaacttctttagtattgatctaatcagtgagattggtaataatgaggttagtagctggctttgttcttctatacattaagtaatataaaagtattaaaaacttaaaaaaagtttgtccatataccacttataatcatcttgtatacacaccccatcttggacactctggactactgtgaggtgttaagcatcaaatggtctaggttctgtggtgacattattaataccctttttagttggattgattagttggttggttttattagttcattcatttaaaaatttattaattgtacgtggtacacagccctaagctagaattcagagttaagacatagttctttctctaaagaatattacagctagcaggagaattaagctgaatgagctttggtgcagtcacacaaggcagtggggcatggctggcattggagtggcagcctgttctgaggagtactggggggtagggctagagaatcagtctagccggggagaatgaggggagctaggattgaggaggttggcacagtctgggctcacacttcctacagccttgcccagatcttactcttaggggtacttctttcccaggctgaaggtattttcttgggtagatcatagaaaagcagcttgagtccacattcctcttaataccctacctcttccctttccctccactttgcaccttgcctccgcaatcctgaagattttaatcatggtaggttaaggtcattgttgaactcagagttctgagctagctaagcttggaaagcctattattattattattattattagagacagagtctcactgtgttgcccaggctggagtacggtggtgtgatctcagctcactgcaacccccacctcccaggtttcaactgattctcccaccttagcctcctgagtagctgggattacaggcgcctgccaccatgcctggctagtttgtgtatttttagtagagacggagttttgccgtgttggccaggctggtctcaaactcctgacctcaagtgatctgccagccttggcctcccaaagtgctgggattacaggtgtgagccaccacgcccggccagaaagcctattttagaagggtaaaatggtgctttcatggggatctagggtattgcttccttgatccagtctttcctggctggaagcctatgtttatgtggcccagtgttaacatgctccgacttaataagggacagtggtcaggggcctgtggatttgagagatttcagaaaattggcttatatattaacgttatcacagagactccaagaaactgaagcaagctgtgagtacctatgttgtgagtatctggacattgagctttatacggagggttgtgagctgagcggaggtgaactagggctggatgactggcagactgaaggagagggggcgcaacctagcatgaaggtgtgtggtagctgcttcactgcagggctgtggggtctagaagaattatagactgaattccacacttccctagttcagagccttaaggtcaggggtggggtgctggtggtaggagaggcagggggaattaggtcaggagtaaggacctgggaaaacttcctatcataaaacactaggacttgaccacagaatgggtatttctctgccttcctaggaaggctgtgcaagcaaagtttgtgtggcagtggtcaacactgtgcaggtcctgccagatgtggcttccaggtggagggggcccaggattgccatcttgaggaagacatttgttttgttgatctgaaggccctcatagcacccaggtagagaatgcttgatttgcagtagacagattgtcttccaagagaacttaggtattgtcagctgttcaatgtctgctttgtaaaggcaactttgtctcagacttatggataggggtgagtctgagcaaggacctcagcaggagccttagtcctcttccaggccatttcctaatttccccattctgtaatttagcacctttcttctctgtccagccctccttaggcaggaagcctgagtcttccattttttttcttctaaaaaaggctactgttcattggtgatggacctctgtctgatcccaaagccccaagcccggggctctgctgaaaggagtctttctgctgctttggacttagaaagcagtaggactgggtgactgcgtagaatgatgcagtaggacagtcaagccgaaggatgcttgaacagctagtccagccctctcatgtggaggaaaaagcaaaggcccctaagggagacagggacttgcctaggattttaccattccagaaagctggaagccaggactgggctccagcctgctagctgtctactcttgaattttaaaagcttccctcttgaccacattgccattcacaggcagaagaggaaaactgtaaagcccttaagggctcttctataaatggcagctagaacccagtgtaggagaattggtggagaggaatatgtttgattccccccaccttttttttttttttttgagacacagttttgctctgtcacccaggctgtagtgcagtgatgcgatgatgtctctctgcagccttaacctcccaggctcaagcgatcctcccatttcagcctcccaagtaactgagaccacaagcgtgtgccactatgcccagccaattttttaaaattattatttgtaaagatagggtttccttatgttgcccaggctagtcttgaactcctgggctcaagcaattctcccaccccagcctcccagagtgctgggattacaggtgtgagccactgcacttgacctgatcacccattaatttggtagaactggatgttttcagtgggaataccactggaccccagtctggggggcattagaaactaggcttcccagaggcatttgaaattagactgccatttcttaggcattctaagatccaaccaataatattgaaagaacagcccattttacttgaatttctttgatcccaaagtaaggaatgacttgaaaagatttactctgttcctgtgttttcaggttcagaatttcagttgtctttaaagagacaagaaagtactataaacccctctagtgacctaatccaaaatccgatttacatatatgtattttcttgtacaatgtaggtccatccactcaaattccctcaccttaagagaggaaatagctgtttctgtttgtttgtttggagagtcttttcaatgattcgtttatctcacacacacttattgcatacattgaatgaaatactaaagtggatacacctcgaggagctcaggtctgtgggggagacaggtgtgcaagtaacagtgataaagtgatatcaacgctatagtaaaggcatctttaaactgctgttgatttgcagaagagacaaacagattctatcaggagattgaaaaatattttacagaggaggtgataaatgagttggaccttgaaggcagtaagattttgttagtgggggaaggagaggcattcagataaaggtaacagcatgagccatagagggagggagaggaaaatgcaggcagtgttcaaagaaccaggcagtgcactgtggttgtgcctgtaatcgggtggttggtagcaggggaggtgtgggcaagagatgaagccagaggatttcagatttgggtgggagcgtaggccagaagagggaacgttggatgtagtcacactgctgttggtgttacttagaccttcatttttccaccagactgtagtgttcaaaattctttttagtaagagaaccctttttttctgaactttttacaaccatctccaaattatgaaacataagacttttttttttagtaaaaatgtatttttttacaagcacagtgtcttgcaccatggaggggagaggaggtgttttgtccttggagctgctggcctgagagaaccttgtcatcgtgggagctgggccattcctacacagtggtctggcaatgacccggtggtggtggaggcctgtgagtgggcactggtaatgggagcagctgtaaaaccctggagggcagccccaggagagtgaccttaccaggaaagttctgggaaacaaaccacagggaggctttacaggaatttttggttgtgcccacaggcaaggcacatgaggaaaagaaatgtaattatagtttgtaagtcgatgaaaagaggcaatgagtgacatgaaatagctgctctaagtttcttcttcctgtcggacaggaagaaatggggttttatgcatttcattcagcagatatttattgagtgccagctgtgagctgggccctgcacaaagtgcagggaatattggtggttagcaaaatagtcaaggttcgtatcctaaggaactcttctgagggaagactgagattaagcagataactgtataaatgcataattacacagcatggtgagtgctctgaaggataagtgtggggagcctcatttagattggaggattgtgaaagtcaagagacaggagagtcaaggtgaggcaaggtgagtaagagctatccaggcaaagactgcttggtaggggagtgtcccagcaacgggaaacaacctggaaaaaatatgacacctcaggggaactaaaagcagttgtatgtggctgatgcacagacagggaagggcaggaagtgtgctgaaagaaggcaggaggagaatcatgctgggccttgtaggtcctggtaagaagttagattttatcttaagtgtagtgggaagtcaatgaagtgtgttaagcaggaaatgacctgatctggtgttaaaaaaaaaaaaaaaaaaggtgattcagacagctctaatgactttgtgaggggagagtggaagctggggcaattaggaggtttttgcaataattaaggtgagagatgggtagcatcagaggtggagaaaagtggacagataaaagatatattttggaagtagaattgtttgcagttgggaaatgggttggatgtgggcagaaataagaagggagagttgaggatgtctcccaggtttctggcacatgtatgcttgcaggcctctcagtagacagcagagagcttatataaggttgtcaaatccttatccttcagaagggtcaggtaggattggtctaaatccagccttgcagaggcagtggtgggattcagctgtccctgactctgcccagttcaaggagtgtgtacacagtagcattacccaagcagggattccagttctctcagtaatggggcccttcctttgtcccttcccccaggacaaggccctaaggaacctccataactccagcatgccactagggggagcatggcccgcattctgggtctggtttggagggcttcttaagtttggattacttcaggaactgacttgtatcagttctagtactcagtcctgacccctggcccctcatactgcttaaaagaatgcctggcatatggtaggtgctcaacaagtgttaactgatgttactactgtattattaatattatcttattatagaaaggggtgggatcaccccttctttctcaggatggagactgggcaagtggaatgtgcattttgaggatcaggaggagagcagagggatgccttttggacaaggaagaggcggaaatttagtgatttgatgatactgcatttgcccttctgtcttgtctttctttgtctttctttgtagacttgggattcttcagctggggcttgggtggggttggggatttatagtgggtgattaggttcactccctttcaagctctgattgcttcactaaagcagtagtgccccccatttaggatttgtgccattctgtcatttcctgttggattttataacactttcctaccttaacttctggtatatatttaccttttaaactcaagtcaatcagaatcttgttttgagaatgttgtgatatgctggaaattaatgaaaaaaacccactagattctgcataggatgttgcattaaagattctatcaggctgggtgtggtagtacacacctataatcccagctactcaggagtctgaggtgggaggattgcttgagctcaggagttcaagaccagcctgggcaacataataagacctcgtgtcaataaataaataaataaataacatcaggaccttttttttgggagcactgtttttgggagcagcattggaaaatatcctccttaagcctcagtgtcctcatcctggggagggtattaactgtcccagtgttttttgtttgtttttggtgaggagttgtcaagaggagtaaagttcttagttcagttcctgacttgagagtgctttcacggacagcatctcttccgatgctcagtcccagccctgtcagtaggctctgtaggtggaaagggggaagtcatgggacttgcccaatggcacatggcccgttagtggtggagtcaggcactgccaaggtcttctgacccctggtgctgttgcaaccactgtgcttaatgtactcaagagacttgaaaggcttggggattgtttctagattttatttcctggttccatgacctggggcaagtaattttacttctgttgtagaattaaaaaaaaaaaatctgttaaattagtataataatgccaatcctaactttcagacctgtcatgttgaacagacgagccaagattttgagagtcgtttagaaaagtgcaaggtcacatatagctgtagggtagggctttttctccgagctgtgcatcaggacgttttacatcttagagatgctgtcttaaggtctttaggctgaaaggatggtagtcagcctatctcgccacaacttacaaggattctccaccttcccttgggagcccagcgttatctcataaccagttatcaaaaagttgacagtttttgaaatcaggtggcaatatactttagttgaaagtgtgctggactagggcgaacttggctgatctcttagttctttgactgcctaactgtataagtgcagatcaaatgtttaatctctctgagtctcagtttttccatctataaaatggtcataaggccagtatgctggctcacgcctgtaatcccagcactttgagaggctgaggcaggaggattgcgtgaagccaggagttcaaaaccagcctgggcaacatagtgagaccctgtctctataaaaataaaaattaaaaaagtagccaggcgtggtggtgcatgcctgtagtcccagctacttcagaggctgaggcaggagggttgtttgagcccaggagtttgatgatgtagtgagctatgattgcaccaatgcattccagcttgggcaatggagcaagatcctgtctctaaaagaaatttaagaagaataataaataaacttgaaaaaatggtcataaaaatatctgtgcagtgtatttcaaaaggttatgaggatcaaacaaaatgatacatgtaaaaagaatgttacaaagcagaaatgtatgctgggtaggggggagaggaagggacaggatggggatggggatgggactaaacttagggggtctgccgtgtcccagggactgtgctcattttctgacaggagcaatattattaccgactgtgacagcagctcccactaagcctgcaccttagctgcagatccttagcagggcagagagacaaggctgtatttgtatcaggtttgtcgtctgggttgtgactctcgacttgcccaggattcttcctggtcctgaccgagttgtctttgctctccatttcaggaagatgagagactgcttaggcgccaccactagtaccatgagtccctgcactggttaaagccatcgccacaacctggacaggcagcaaggtaagcagagaggccagtccaggcgagctcctgggatgtgagtgcatttccgccccaactgctgcccggaaaaatcccaagtgcacaaacaagtcaaggcagcgcatcagggtccctcctacccgagctccaggacccagaggaagctgggtccccttcaagcgcttcagctagctccctcccccctggcagggattcttccaagttataaaaaatgagacactggaggggaagaaaacaagtccactcactgtcttctcccttctcccctctgagctgttcaagcaagttcccaggagcagttcagagcccctgttggactggaagggaggtaggaggagtggaatgcatgcaaaaaccgagctgatcaaaagacagtgctgtttcatggaagcctcccagaactgagagagagagagagagagagagagagagagagacagtgagaaagaaagaaaaagagagcgcccttgtgcacgcgctaggccaagagcgcgccgctgtgcgcgcgcccgcctagcgaggacagggtctccatgacaaccggcctggccggctagcagtgctctgctcacttggctgcgaggagcgccacgaaaggtcagaggaaggagctgtgggaagctcgcagcaggtatcggagcttaagccagtggatttgggggccctgggctccctagccggctgcggtgtgagaatggagtgggcaggaaagcagcgggactttcaggtaagggcagctccgggctgggatcatttggcctcctttcctggcccttctctccggctgttttctgggagtcaggcgagtgtctgtagtctctgctcggggtttggggctcaggaatgatgtcatgctccaacagttggattctattagcttaaggaggagggaaacagccaattttcttgactttgcaaatctagctgatctcactcttgctgaatctgaggtgtttagacttcactctaaaaagcatcattttacttttatttagcacaaaggcacaggatatttttacaggaagaatcttttatatggaaaaatctgagttaacatcactcccgtggtgtttgtagttcttacagggaaactccagtgccttttgagccgcttgttcgtcctagtgaacactgtctgttttgtctcttggtgctgctatgtctgacctgtaatggaaaaaaaaaaaaaaaaaaggctaattaagctcagccaggagcctgtggtgagttccaagtccctctagagcatttattaggacagagggactgtcacagggatgcctgagctggggttttgcactctctctcttccaggcagcttggtaagaatcaagctgtcctcccacatcaaaaggtcgatcacagactttcctaagaggtggaggagggggctggcttggggttggggggcctgcaaacaggtttctcatccagatgtcccagagtgagctctcagcagcagctgctaagagctggggaacatgaggcactgtagttgtgccgggtggattcctttggttacattttgaccaaatctcagggcacgcagtgtccacgctgtgcactcctacactgattgtcctaagttttggtaaaacttgttctgacctagaggagtggtacatggtgagctgtgtggccttggaaaggagaccctcccagaaaggcagttttataggtgatagggtagtggggttgtcagtaatattatgaggaggatgaatgcagcaaacacttcctgcaacggagacccatcaggggttgtgcttccacttgagccatgttatgtcttaaattcacttcttggcctcagggaactttgcaaatgcctttggtttctctgtgggatgagggaacagctgctgtcctggttcttcagtttttcttcttgaactttctgaacagaatgtcttttgtattctggcaaacaatgagggggcattctgattaacttcggatcagcttgccaatgcaagcactggccatgtccccagttccggctccctaaaatgagtacatgtatacatcgtggttgtggcctgagggtccacaagggtgaactccatggccctggacctcagacggtccacttctgaagttattcctcttgctacatacactccagggatcctttgcttagttgaaacctacattttgctggagggatgtggcataacactgagccagtggccccttcagttggcagtgtaaatccagaacctcagccttcttttctacttgtgtgtgtagttggagctcttcaattttaccatccccacatctgtgaagagggctagcagagacccagtttcaggagctgctgctccttctgttggtatagcagaaagaataatggatttgggttgctagacttgagtcgacggctagattctgttcccatagggcggccacgggcaagtatcttaactaataggagcttcagattcttacctgtgagatggaggtaataagaacaacttcacaggactgttgggaggagccagtgggataacttccatgaaagtagtttgaaacaagtcacgtcctatctaacgaaccgtgttgtgaattgaagcttgaggaatgacccaactctctctggaaagtcactttgcctctctgttctggttctctcattttataaagtgccttcttcctttctgcatttataagtaaacatgagaaaaatctgaaaagacttcttcaggatgtttaaggaaacaaatgttgctttccttgggttgggtcgtttcataagagtgatgtttgccataaaactggagcctcatagacgatcctgcagggaggaagctttccttggtcacctgactcatgtgtttatatatagtatagaggagaggtattccaaaagacccgtcgcttttcctgtgtcccacagctgcctgtagagttgtggcaccataaactttagcagctggaaaagaggccaggcctggttccctcatcctgctgggtcctgctgggcacactctgcagtgggcaaaggggtctttctccttcattctgggtttagaaggcagggttctaactgggagaaagtgttattgctccgaaaggcttcttgggggctgggcaggtctttcaggaactcataaggccacagcttatggggaaagaaaaagaaacaaggaagtgggaattccaagggcagagattcttgatatgccatgggactgtgccaaggaatggaagagcaggggaagggagactccaggcaaggagagtcccaggtctgtcctcattgagtcgaaagggcgtatggcatactagagcgcgtcacccacagccccagctttactgtaggatggggaagacctgccagccatatcccggagtggtgtctgggaagaagcccttgagcagacccatagtaggcagattaaaaaaatgaaacaaaacaagcagctccccttctagttgagtcatgtcacaacagcctctaaggcctgaaggagaagctgcccacagcttagattggggctgcagctgttccccgactcccatcagtccggcttcccagagctgagtcacaaattggatctgtctatgttccttaaggattaaaaagtaacattcctgttctcactccctctttcctccttctactccgcttcctgtaccttctccccttgggctctctctctctcaaattagatatcagtcaccccgggaagatgaaactttgaaatacactggagaacaggccaaggacacccttggttctgctggttcagcctctttccctggaatgaagggcggggtgtacagattcaggagggcaatccaagtatcatggccccactggtagcctagacctaagagaggctgtgccccactccccaccgcatctgattctaagaactgcattacgggaggtccacctggcacctcagggagatgggaggctctgaggcctgggccttctgaagcacctccctgtggggcagttgggactgaaggattgaagaatacatcttccttcctgtcactcctcttagctgttaactgtcattgccctggaaacgtccccatttccatcgttgggcctaagagagtcggccgaggcagccaagcccggggaacacatagttgaggctggaggaggcctggcagcagcccttccgagccctggcttggccttccttctgtgcctctgcatgggcttgggaggagggtgtgtttagggcaggctgcgaggaggggaaggggaaatctgcaggcagataattgagttctttgagttggagggaccatggaaagtggagaaggggccaggagggcatagagcgaaaaaagaaaaagaaaaaaaaaaaagaccatctggcatagtctgcagagatttgtctttaaagcctatgggaaaacttgcattagtgtgtgccttctcctggggaggcaggggctggggaggctaggcatttgtttcatcctggaggggaggtgctatgtgtgtctgtctcagtaggtgggtcggaggaactactgggtgcatctgtcttagaggaatatgccacgtaatattgtgctgatagaaacacctgagctctctatttctagccataggccccagaaagctctcctgggtgtgtgtgtgtgtgtgtgtgtgtgtgtgtgtgttttgaagggagaggagggtgttaaatgagtctagattaccttattgaagaatttctccaaagaccccttctcttatttttttggctctgatgtcatgaatgtactgttgttggggagggtgttgaaactatcactatactcttctcatctaaaactgcctgaatgttagatttcactgtccttataaaagagtgaattatatgcagttagcgtatgaagccttcttaaccaaagcagacctattcctacaggcttgtcacgaaaccaccacagtttctcaaagctccagactcttcctctgtgtgacctgtcatcaccaaaggggttgtgtgtgagctggagatggactgttggaaatcacatagtggatggaggattatttggaactgggaaaaaatgagataaactgagggttacgggagacaagatctgaggcaggaggaagactactggaaggaagcaggagtgaggcactgggcaaggggccctgggcggaggcagttctcaggagcagcaggtggtaatcgagagaagggctgacctcggaggcctacacaatttagcagaaggccagactgcccccagggagctcagggtgacagtgtcgtgcaggccctcagaagcactggagggggtaggggtggctggcattagggttaacacctctgtttgtttgttcttggctcagaggtgtctctggtgcccatctatgcagtattggtctgttcacccatttagtcagtgaatacggagtgtctgggccaagagctggggaggaacgcagaagtatcaagtatgggccttactcccatctatgtcatgttataatagacgttgtgttgtagttatttcttcccctctctcccccactctgtctgtgtgattaagagagaagcagcatagacctgctgcagttctgagttttgatggtagggttaatgaccatctcatgctcttaggctgggaaaaaggaggagggtccaacagactgatttcaagcacgattcgaatgaaggaagagagccaactgaaggactggaagtaggagggtgaggattctaggcctgtgttgaagcttctcttgacagtgtcaaaggatggtgtatgtgggagggagtcataggaaaggggaaatgggaaagttggaaaaaaactatcaagtcagctatttttaaaactctagttttgttcgaggaactgacttttggtgtgcttgtgacttggaacacaggctaccttatggagttctgacaactgagtattgtagatggttttaaaatgaactagcctgtggtgtgtttgttcaactctcagtgactcttaggtactcagtgagtgcgtggtgctgccttagagcaattctgatggaaccatttgcatttaatatgagtatctgacatgcattgcagtgcactgcagtgatgaacagctatagctcaggggtcttagaggcctagctttagagcctgaccttgctgtgtgaccttgggcaggttatttaatctctctgtgcatcagccttctttgaggcatctgtagaatggatgtaatagtacttgacttgatagagttgtggtaaggattaaatgaaatgatacctgtaaataggccagtgcctggtacatagtaaatgtccaatgctttccagtatattattatcaacttacagcagcattttgaagagagtgggctggtgtctctcaaacaggttgatgttactacgctgggaacaaaccagattcttcttttagaagtagctgctggttgggcgcagtggctcacgtctgtaatcccagcgctttgggaggccgaggtgggtggatcacttgaggtcggtgtttgagaccagcctggccaatatggtaaaaccctgtctctactaaaaatacaaaaactggccgggcatagtggtgtgtatcagtaatcccagctactcgggaggctgaggtaggagaacagcttgaacctgggaggcggaggttgcagtgagctgagatcgcaccactgcactccagcctgggcgacagagcaagacttcgtctcaaaaaaaaaaaaaaagaagtagctgctattttgcatctcgttcatctttctgtcaagaccccaggtagtctggtctggggtctgtgcagtcctgggtgtgtaataatacaagatttcctaataacacaggatttcctccccacctctcaaagctgcttgtgttcagttcctgccacttgacagacagctccccatgtcttatggctgctgcatcaggcagaatgatcaaagaaagggcacagggagccatggacaaggtagggagagaaagacaattgctttggaaagtcaccagcagccaaggaggactgccctttcagacctggcctacacgttaggaaggtacttgagagtgtcctttaagaggaaggagtaggggccaatgagattttgaggacacggcagccgcccacactggagaggccagaagtcctgagtctgaggtagtccttgtcaacccagcttcacaggttcagctctttcctcctgctgtgggatgctcactcctcacagacggggagacccgtccatccagaactgcttctcgcctgcccctttcctgctggccagcctaggtggagcccctgaggtctttctcagtgtggtattggaggcccttcacaagctgctctcagtgctccagaccccggcctctgcctcagccctccttacccctgcttccacaaatactgcccttgtacccttccagatgcagcttagagcatagaataggctttgcagccagctctgagggtccatagtctggtttttcctctatctgtggacctctggtgagttcatctctgtaaacctctgttttcatctgtaagttgggagtgataatattacccacctcaaagggttattgtaaggtttcaatgtgttaatttatgtaaggcactcgacttagttgtagacacaaatatgctctcaataaatgttagctgctgctgttgttaataatccatccttcctgtgaatttctctgcctacatatagcggtagaaagtcccagccaggtagtcagcaggtctggatgttagttctggttctgtctctaatttgctgggtgatcttggggaagtaacttgacttctctagggttcagtctcctcttccagaaagtagaaggcatggattcagtgttctcattgacatcctgacttgacattttttttgagacagagtctcgctcggtcgcccaggctggagtgcagtggcatgatcttggctcactgcagcctccacctcccgggttctagcgattctcctgcctcagcctccccagtagctgggattacagatgtgcgccaccacacctggctaatttttgtatttttagtagagacggggtttcaccatgttggccaggctggtggccaactcctgccctcaagtgatctgcttgccttggccttccaaagtgctgggagtacagatgtgagccaccacacctggccctgacttgacttttcaaatgtgtatatcttgtgttttcaactagattccttgaagttgtatgaaatcaagtataatattttatactttttatttccccaaatggctaacatatatagttggtgcttaaaaaatatttgagtaacttttctttaaccccatcaaccagattctaggaagcattttgacttggttctcagaactcggaggctggaagcttgttctccaatgcgtagggcagtacaaggaggcctcagcctttagtaagtaagaaggtaggtttctcttggtgccctgggaaaattttggttaacagatgtttggggtacttatttgtttggctctgtagccttagaccaggtctttgaataaatatttccatcactgtttccttttctcagtggcgaaaaatgccagtgttttctgagcaatcccctctcctttagagtttagggtgagccagttagtgcccagacgcaaatctgtgtcttaggggaagagccatccaataggagagtaatgtttagagcctgggctctggggtcagattgggttcaaattctgcctctgccacctaatagctctgtaaccttggacaagttacttgtccgtgccctggttcctcttccgtaaaattgaggcagtggtagcattatctcatggggctgtaacaaagcctaaatgccaaatgtaaagtgcctagaatagtacttcctgcctccttgctgaacaaaatgtttgcagttattgttttgtttattattctcttgtaaaccaagtagtgtttagttccttttttttttttccagacagagtctcactgtcgcccaggctggagtgcagtggcacgatctcggctcactgcaacttccatctcctgggttcaagtgattctcctgcctcagccttccaagtagctgggactacaggtgtgtaccaccacacccagctaatttttgtatttttagtatcgatggggtttcgccatattagccacgctggtcttgaactcctgatctcaggtgatacacctgcctaggcctcccaaagtgctgggattataggtgtgagccactgcacccggcccttttttttttttttttttttttccccaagagagggccttactgtgtcacacaggctagagtgcagtggtgcgatattggctcactgcaacttctgcctccctggctcaagcgatcctcccacctcagcctctggagtaacaaatgtgcaccacacctggctgatttttataattttttttatagagatggggtttcttcatgttgcccaggctggtctcgaactgagctcaagtgatccgcccacctcggctttccaaggtgttgggattacagacgtgagccactgcacccagcctcaggagtgtttgtttgtttctttctttcttttttttttttttttgagacaaagtcttgccctgtcacctaggctggagtgaaatggcacgatctcggctcactgcaacctctaccttccggattcaagtaattctcctgtctcagcctaccgagtagctgagattataggtgcatgctgccatgcccagctaattttttgtattttagtagagacggggtttcaccatgttactcaggctggtctcgaactcctgagctcaggcattccatctgcctcggcctcccaaagtgctaggattataggcgtgagccaccacgccaggcagctgtgtttatttctttgtggcttgtctgttgggtttgttctgctgagaaatgcaaggccctatccccttcttctgtgtcttgggcagacggtatcagcagagcagtgataagcgtcccccagtcagcatatagatcggagctcctgtaccttgcttttgtaaagaaattataaaccagaaggggagtctggctgaatcaaaagagcctctaggctgagcgggcccctctctgaggagtaatatgtgttgtatgaacaacagggatagggacatggcagacccagtgtcaaagagcagaatgggaattgggaaggctgatgggagggtgagggagatagacggctctagatagtgaagtggcaaatgtctctgggcatttgtggctaaggcagtaagaggcatcaaggtaagttcctggtacttcatcttcccaagagatagcctgatcccagccccaggtgagacttgccccagcagtctcactcctctttcagaggagtggtggattgggatgaggaggttctaatctgtttctaaagagaatgaatagctccttatctacaagtgtaaattataaagagattttcttttgcaacttcagggaacaggaacttttgctgccaaatttagcaatgtgttttaagtccctcaaatcttctttgagtgctaccaaagctctgagctttgttgttatctcttgttgaaatacagcctggaaaggtcatatcaacagtgccaatttatgggcctgctgagcccagacaggcctagggcagaatagggagttcctaagagtagaggcttcacaaattttctctttgagtgagggtgtttacaatgtaaggttatttttgctttagaagaccaaactctagatgatggtcaaacatcctgttcttcagcttttttacttctgcaggcttccacaggcaggggctcagattcgacagtagctccttgtagaaccaggagaagcttagcctcgatggtgcatagagctcccaaaactgtgccccgtactccttagtggaggtaagtttccttgcagagttatgctggaatctccctcccatttagtttattagcaatttgtgacctaatatgtgttctgatggagtaattaaaagatggtaaaggccggacacaatgcaatggctcacacttataatcctaacactttgggaggccagggcaggaggattgtttgaggccaggagtttgaaaccagcctgggcaacataatgagacccccatctctacaaaataaatgaaattaaccaagcatggtaacacatgcctgtagtcccagctacttgggaggctgaggtggaatgattgcttgagccctggagttcagggttatagtgagctatgattgtgccactgcactctagcctgggtgacagagcaagatcctgtctctaaaataataataataataataataataataataataataataataataataaatacatggtgaagactgaggactgtagacactacacgtggaactttgtactcatttgcaaagaccttaggacaaaaaggtctgacttgtgtgtatatactttgccacttagcaaaaaggaatgccagtagggaaaggaaattaaggaacttgaatgaccccagcaactataaaggagtgtgctctggttttgggcacctgtagtcccatctgcttaggaagctgaggcaggaggactgcttgagcccatgagtttgaggctgtcctgcgcaatgatcacacctgtgaatacacactgcactccagcctgagcaacatagcaagacactgtctcttaaaaaaaaaaaaaaaaaaaaaagagaaaaaggaggatggtacatgagtgtgagaagaaaatagctaggacatgtgagacaagcttggcaatggcagtgaccttggtttgcagtctgtggcttggactctggctggtatgttctgagaattgaggcttttgaatctagaaaggaaagaaaatactgaagtttcttatgttctctgcctctctccaacctcctgattgacttatccctttgggttgaaacataaatggaacaggtagcactgtcctttccgagtccctgcctctctgcatttgagtcatcactgatgctcagggtttgctcttggcttggctgtgctgggagagccagttgtgaagatattggaggtaagaagggctattggttttgtcaactgaactctaataagtacccagggggaagtggcagggatccaggttaaaaagaaagcaaccagggcagggtgcaatggctcaggcctgtaatcccagcactttaggaggctgaagtgggtggattacttgaggtcaggagttcaagaccagcctggccaacatggtgaaaccttgtctctaaatacaaaattagccgggtgtggtggccggtgcctgtaatcccagctacttgggaggctgagacaggagaattacttgaacctgggaggcggagtttgcagtgagctgagattgtgctgtttcactccagcctgggcaacaagagtgaaactccgtctaaaaaaaaaaaaaaaaagcaaccggaaattgttgttttatttaaatctcattaagtggaaatagaaaagcctttttattttctttcctaccccctccagttgcaggacccacaactgtttggtaaacccaggtgggttttttttccctccatttagatgtaggtgcctattctgcttatgtgcccagatgggttttcaaagcagtgatatccagacttcttttcatctgaaaaacaccgaaggccagatgtctacatggccttgcaggaagaagctgagcttcttctggaaagctgtagaaacaaaaaaaggcggtggagactgcaacacctgtgccatcctcctgggtccctgatagcccttaatgttttgtcattgggggggttgggatggcttttattttttggtgttccccaaaagttaatcctcagtctgttctctttttaatttacaatctttccctgggattccatcttctactgtcaccagttagagaaagcgaaggagtgagggggaatctaactctgcctctcttgcttcggaaactgaatgtatttattcatccaataaatatttatggagcattccttctgttctaggttttgttctgtatgccgaggaggtagagataactaagacattgaagtccttgttgtcatggagcttgacgtgtagtgagtggggaagcatttcagtaaacaagtaaacaaatcaatagatgagatcaagatagtgctgtgagctcggaaggatataatggtgatgtaaaagagagagtaacagggacctgagaggttagagaaggcctctgagaatgacgtttgaactgtgagctcaaggatgagaagaagccgttaatgtgcagatttggggaaagttcctttctggaaaagggaacagctgtcaaagctcctgaggtaggaaagagcttgacatgcagaaaggacacctaggaagtcatcattgttagaatgtagggagcaagggggtgtcggggtggaggatggtggcacaacttgggataaggtatggaaatttgagagggagagagaggaacattgaatctgatggagaagaatcaggaaaaagagtagggtgctgggcatggtggctcatgcctgtaacccccacactttgggaggctgaagcgggaggatcgctggaacccaagagtttgaagcttcagtgagctatgatcatggcactccagcctgggcaacagagcaagactctttctcagagaaaagaatagaagagaagagacagagcaagactctgtctcagagaagagaagagaagaggaaagggggaaagggggaagggggaagagggaagtgggaagaagggggaagaaagaagagggaagaaggggaagaaaggggaagaaggaggaagaagggggaagaagggggaaggggataagaatatgaggaaacagaagggatctgaagtgggcatagacatacctgcttagctaaggaagtcgaattaatatagtctgcatacttcttgggatcaagcactatgtatttttaaattttctgcagattttaggttagcggtaagacattagtgtaatgtttactctgttctaagcattgtgttatactaggcatttttatttcattgttttagtaaatccttacaatgatctgtgagttaatttgttgatgttgtaacatctgcagggatgtggagtagctaacttgcttaaaatctaaatctaaggctgtttgattccaagcatgtgttcttgccacacttccactctggttggtatatcaaatgcagctcttctttggttatctagaacatctaatgagttttttcctttgtatcactatgtgttatttatggtcacattttgaatgtttgcagaattgaatgagttttttttagctttctctgaaaggggtacctggttaaatactgagaatgcgagtccatataaacaactggggagggtggggctgtggcaagacttggaagcagttaacctgacttacatctctccctctgggcaggaaaaaaatggcctttctccttaacgctccataagtagttagatgtcttagattgcaattccccctattgtataagaagatggaatttacttttggaaaaagtaagtaatttgtcagtaaactagtgtttgtaaataaaccctgatttcctagcgtacagatctcttctagagtcttcaagtttgttggaaatgtttgagaaaagaaatgtatcaggccacaaatttcacttcttggaaattgaacattgactagtttctatgggttgatacttctttttctttttcgagatggattctctgtcacccaagctggagtgcagtggcatggtcttggctcactgcaaccgttgcctgcctggttaaagccattctcctgcctcagcctcccatgtagctgggattacaggcacacgccaccatgcttggctaatttttgtatttttgtagagagggtttcaccatgttggccaggctggtcttgaactcctgacctcaggtgatctgcccaccttggcctcccaaagtgctgggattacaggcgtgagccactgtgtccggtccatacttctttttttttaaaggtttgatcctgtttggattctatcagtagtgaaggcccgggattctgaaatgaaaatgtatgcagtgtttataaactctcattccttggtgttcatgagatctgtggtcagcccaatcagcctgcttagatggaatagtttgtgaagggcagagcagggtgagactgaatttcagatttagcatagattgctagaaaacagaggaatttctttggtaagtcactggattttgctttcctgtctccccttcccagtctgtttcagtaacagacttgcttctgaaggaaagataatgtagttgggaaaggttcctttacagggtgttgttcagatggtcttcatcactgattcacaatgagcagacattgaatggtcatctgccatgagcagggacacacagatgggttggaagatgaggctggaaagactggctgaggtcagatctttaagggattgaaccatccagaaagcggggaatcactttccccaggaagcaggaaggaaacacatttgaatatgatttgtagaaaagaaacctaggagaccatgtagaagatggaaatggagtgggaggaaacttgcctattttattggctgtaactggaggatgatattccagtccctcaaaattcatttagagcagaaagtaagggaagtctcagggtgggcgggatcagaactccagattgcagagctttctagagcccgtagagcagtggttttcagacttgactgtgcaccaaactcacctggagagcttgttaaccaatttagtagaaattttttagtaaaaatttgcatttttaacaagtttggaagtgatgctgctactgttggctgggaaccccactttgagaaccactgcttaagaggcttggcagctgagatgccaataagggtatgagggccagatgttaattggcttgctttcttttactgacccagaatttcatgtctacaaagctttactttagatgttcttaggtggcttactctaaaacatcaacaaagcctggtaaaggtccatgctctcaatgactcttctcaccaaatccgtatcacttctggatgagatttccaggtatgtgctcgtctttaaacagatgcttgtctgatttttggaaaatgcccatcctgggcacttgatttcattaggattggtggcatttctgccaggaaaagcttccccccgccagtcagcactactactggctggcagggctgtttcagggacagccagcaggggctgcacagaatgtgttctgttgattagccaaatttacacaggacatgcctgggagattatctctttaggccaggagttgaatttcaagggcaaagtccacagttggcagccgaaaggctgagaacacctggaagaggggaaggatttcacttgactttcacttccccaggcctcagtgcctcttcccacagaggctgggttttctccttgttgctgcctgagcaggtgaccttgggatggttcccacagagcagtgtggctccaggcactgccctttgctgtctacttcagcacctgtggcttcaggtgagacacttgcattagtcaatgtcagctgccctgtcctccttggcatcatcatttcttgaattcttttctgggcttgcttctttctttgcggggaaggccttcattttccttcatagtccatgactcgcaggttttccccgagctctccttttcttaccttccttcattagttcagtacaactgtagaattctgtttcaatgtaggaagggagacggctacccatacatagcctgagacaacccacctggggctcctgtagcctcagtgctgtccccggggtggaaggaccacgtgggtgggtccacacagctgtcgtctattttgcggatgctcactgggaacttggattcagtcctaggtgcctgggagttgagaggtgagaatacagagtgctcagggtggcagagtggggactgggactcaggtcttctcacctctgcccatttagggccttgctgtgtatgtaacactgaaactgtgtttcacattagcaggcaggcatcaaaccgtctatctggctaacttttgtttaagacattttttaaaataacaaaagcaacaccaggtgttctaaaaacttttgcaaaatggggaatacgtaaggcagaatatgagcatcttctataaacccatgccccagaaaaatagttattgttaacagttgggtagcactgggttttttatttatttatattttttatttatatatttaaactaacatccttgagccataaagattctttaaatgatgcatttttatgtacatttagttttacacgaaaagtttatgctcttaatttaaaaaaatggaaagtaagaagtgttggtgagaatgtagagaagttagaatcctcatacattgttagtgggagtgttagcggtgcagctgctgtgggaaagtttgattattccccaaaaagccccaaattgccatatgacccagcaattccactcctaggtatatgcccaaaataattgaaaacaaggactcagattcttgcatgccagtgttcattgcagcattattcacagcagcgagaaggtggaaacaacccaaatgttcactgactgacgaataaacaaaatgtacaaacaatgtgcaaagaaaatgtataaacacagtaatacagactgtggactattcttcagctgtgaaaggaaggaagttctgatgcatactacaatgtagataaaccttgaaaatgctgccctaactgaaataagccgtatataaaagcacaaatattttgtgattctgcttatataaaatatctagaaaaggcaaattcatagagacaggaaaatagattagaggtaaaccaggagcttggggagaggggagaatggggagttattgcttaatcattgcggagttactgtttggagaagtttgggaaatagtggtaatggttgcacaacattgtgaacatagttaatgccactgaattgtacacttttaaatggggaattttatatactttactgcaattaaaaaatggaaagaaaagattatactgtactgaaaaacatatcacttgtaatttacctaggatatttttctacctcagtatgtgcttttaaggagcagcattgcatttcttcagagggatgtatcataatttatttaaccaagccccttttgacggacaattgaattgtttctcagttgttcctgttatatgcagtactgtaatgaacagcagtatccagctgtctttgcccatgtgtcctagtacttgtattttatttccttaggcagaattcctagaaggaaagatttgctgatcaaagggtgtgctcattataaatgttaaattgccaaactgccttccaaagaggttgcatcagtgtacttctcatcagcagggtatggaggtgcctctttccactgcgccctggcccaacacaggtgttatacatttttttactcttcgccaatctgataggtgaaaaaggatttcttattgttactttatttaggatgtcttcagttattaatgaaattagcatctttttatctttctggtagttgattttattcctttgtaaattttctgctcaaatacattgttaatttttctctttggtcactattttatcttgtagacttgtgagagcttttacatacatacggcattaggactctttgccatatgtgttgctgataatttttcccccaataaaaattttttttgactttgtttatgctaattatttgcctttcacatgttttacatttttatttaggcaaatattttccttcaaggtgcttcccctcatctcgcttctcggctgtggagttgaattttctgtcatacttggaaaaatcttcttcacttgtcagaatcacaaaaaaaaatttattcatgttttcttttagtgttttcttggttccagtttttacatttaaactgtaattaattttgctgtaaggagagaagtagtaactaaattttctttatttgtgtgtgtgtgtgtgagatagcgtctcactctgttgcccaggctggagtgcaatggtacgatctcagcttactgcaacctctgcctcccggattcaagcaattctcctgcctcagcctcccaagtagctgggattacaggcacccaccatcatgcccagctaatttttgtatttttgtagagacggggtttcaccatgtttgccaggctggtcttgaactccttgacctcaggtgatccacgcgccttggcctcccaaagtgctgggattacaggcatgagccaccatgcccagcaggaattacattttgttgataagaaaacctaagataacctttttttctattaaattttttctttactaaaaatttgtgaacttcttttcacttaaggatgtaccataacaattaaaaacattttctgtgacattaaagaaatattcctttttttttttgagatagggtcttgctctgtagcccaggctggagtgcagtggcatgatctcagctcatgcaacctcctcctcccaggttcaaatgattctcatgcctcagcctcccaagtaggtgggactacaggcacatgccaccatacccggctaattttttgtatttttagtagagatggggtttcactagttgcccaggctggtcttgaactcctgaccttgagcgatccgcctgcctcggcctcccaaattgctgggattacaaggtgtgagccactgtgcctggcttaaaagaatatttctgattaagtttacaaaaaaaaagcctttagtgagagaggcagattaaaaatttcacccaagtcttctgattcctaatcctgttttttgtttgttttctcttatcctatatacgatacaaccagatttcttttgttaatgtttggggatagttgcatgaatcccctttgcaaaactttccagtgcttcctatgtgcaattgtattgacatgctggacctagatcttgtgacgtagaagcttctcccttaaaaattttacctgctttgatgagctcaccctggctgaggtggcagcaggtgggcagctggtactgaggagaggcagtaggccaaagtctaagcaggtattaagacccagaaagggtgtggcttttggagaagagcagcttgaaaggtgtgaggaaatggagctgctttgggaacagattcaggaaggtttttgaagtgagagaaggaaaagaaataatgtttatttagtacctacttatgtcccagacactaagctagtcaggtcccacctaactgtattttaaaaggcagcttttagtgctggatcaacctggggttgtttttccaagggttgtgaacttgcgaactcagaaaagaaaagttagagtttaggagaccgagaaaagcaggatttagcgagcatcatttctgctccatcagccaggggcttaaacagaatttttctttgagactgctctctttctttgctctgttgcacgggctggagtgcagtgatgctatcacacctcactgcagcctctacctcctggactcaagtgatcctcccactgcagcctctggagaagctgagatcatgggcacgaaccaccatgcttggctaatttttaaaaattttgtagagatggggccttgccgtgttgccgaggttggtctcgaactcttgggctcaagtgatcctcttacctcagcctcccaaagtgctgggattacaggtgtgagccactgtgcctggcccagaaatgtttttagtagaaataggctaagtaaggaagcaggagaaaccacttccaatcagcatacattcgttaggcccctgcaggaccagcgcacagacatatagcacttaccttcttggaacttaatagtttaatggacaagacatatgaaaagccagtatactgcattgcagtttatgccaccctagatgtttcactgggaggaaaggattaattgagttactggtgggaggagagtggggaaaaggagggcatggtttcacagaggaaatggtgctggtacagattttgaaggaggcatagttcctttataaggagacagggcagggaggggcattccaggtagaaggatttgcatgcacaaagacaggagtgaagctgtaagtgtagagtgtgcagggaagtcccagttggtcgtgtttgttgtccttggcagggtagattgaggagtgtcaagataagactccagagacaggtctcagggctggctcttgaaaggctggatttaccagtgtcctgcctaccagaccaccccaaaacatagtggcttaaaaccacaatacttgcctggttctggggttgttgctcggggtcttcttggatagttttagttagatggtgggggcctcagcctcctgagtagctgggactacaggcatgtgccaccacactctgctaaatctgctatttttttatttttttattttttgtagagatggggctcttgttgtgttgcccaggctgggagttcagttttagacacttcttatttcttaacatgaattcacttttcacattatggatttgtctgattgtttctttggggtattgttcaggttcttcctctctgccctgtgtattctataaactgtaacttagatctagagacctgattagatttaggttaagcattttagggagaaaacaaccctttatgaatgatgcagcagatcagaggcacatgatgtttggctggcccattattattgatgctaagtttgattactggttaaggtaggatcagctaaatttctccatcgtgaaattatagttttcattttgtgactagcaggtaatctgtgtgtgacctttggcattgttccccattaatcttgcacgtaagttgttttattgttaaactttttgttatggaaaataccaagcataaccaaagtagagagaatagatgactactgctgtgtccaccatccagcttcaaccattatctgtaactattaactaataactatgactattaacacatgaactagcttgttttatttctattcttgtccagtactcttccttttttaccactgaattttgtgaagcaaactccaggcatcataccatttcctccataaatgcttcagaatgtatctccaaaaggcctttcagaagtgtattggatgtgtggtatctgactagcaatttttaggtgtgcttacaaaggaatggagaataccatagttagagctttttaggtaggtacagtggaaagagaaaggagctgtggatttgagatggatccatttgtgatgaatcatggatttcagcctggattggcagaaggaaaggccaagaggtggctgatatactctaggaaaaaggcctaagggaacagaggcctggccaagttcagagagcagctgtcaggtagtgaatggtcaaaagatagacaggaagggaaattgtggtcagacagtagagggcaaggttttgagatgggtacgccaggttcagggtttgtgcaaaagtgtgggtgactcaagtggaagtggaattgatgtcagggaatcagttgtgagctaagagttttgagtggatccatccacatagctattgaagttgccagggtggagagagcgccctcagggagagcctggtgtgtgtgagggcaggagatggtgcacaattctgtgaagagtttgaagatgtggggtagttgctttactgcagagctggggcactgtggaatcggttgaaagcttagccagtggtggaagaagacaaggtgagaaaagtgcaagacaaccattctaaacagttttaaatgtattgtgctctgttggacattgctgcccactggttggagtggaggaaattaatgaggtagggggttaatactgaagaggaaaagaattgtgatacataggtggggttgaagcaggagcccttgagaggaaatgcagtgagcccctcttcctgttttatccctgagggatccctttgcatagtaaccccaatgcttttctggttggggtttgttttggtaggtagtctttgtgaagatctgtgttgcattctttacacttcacttacagggtttggatgggttgagtagagaaggggtggccgtccctgagtgaagcagtggtccagagaacccaccccagcattttcttgctgctggcgaccacttccctcttaaacatctagaaagcccttgatgcccaggactaaaggtagagtgaccccttttctgagcacatcatattccaaactttgtctctaaactaccagggaaggcatgcatgtctcctaggtaatagccatcaaacttagaggaaagaagcacattgtaggtgtcagagttttggagagctttgatttcaaaaagtcgtggatttgtagatgagctagaaattaaaacttgaaataattcttcttctcaaagatagtgtctcttgaaataattctttgagaatgatcatcactgaaggagatgagattaaaagggagttgagagaaaagaaggcctacctggccaaatgccagcatctcctggattctgaagcaaacaggagtctgtgcccatggacgttagacgtgggatgatttctcactatcttgccagacacctgtgtttaagggagtgactgaccgacacacttgcttacgtgtttttatgagttttagtgttgagagaaaagttctcctcttaggctatgtttagagttcacttcctgctgagtttactggtgtgtgtgcagcagaaatgccagttctggcctggcatgatggcatgtgcctgtagtcccagctactcagcaggctgaggcgggaggatcgcttggcccaggagttcaagtccagcctaggctgggaaacgtgtccctgtctcttaaaaaaaaaaatgaaaaagaaaactgtcagctctgctttatgcatcttctccttgaggatgatgatacttacttacatataaatcttgccttatagcatagagcatattttcatatacattgtttcttcagatttatatcctgtcctctcagaggagaaaattgatgtgtctggctgcagttgacataaaaacaccctactgtactttccatggcatagtggaaggaatgcgaattttgaaatcagtcctggtttgaattgtggctcctccttttactagctgtatgacttgggccttggttttcctgtttggtaaaatagaattggtaacatttacctcataggattgtgttacagtattaaatgaattaacataattaacacctgggaacaatgcttggcacacagtagataactggtaaagagaggccatagtcatgttaataacatagaaacagaaataacatcagcaccgaagaaaaggagagcatgcagctgttctaatcttgtttttttttgttgtttgtttgtttgttttctttgagacattgtcttggtctgtcgcccaggctggagtgcagtggcgcagtcaagatcactgcagccttgaagcctcgacctcctgggctcaagtgatccttccgcctcagcctcctgagtagctaggactccagaggtgcaccaccatgcccagctaatttttaaactttttgtagagatgggttcttgccatgttgcccagcctgatgtcaaagtcctggtttcaagagacctcccgccttggcctcccaaagtgctgggattacaggcatgagccaccatgcctggccttcctaatcctgttcattaacgtgattgctgtgaatggccttctccttggcagtcaacataccactttctcaaaggacaaagttatttaaatgagtttcatgttttaatgaaatttatatggatatgtaaggcaatattgaatgatataatagtaatttttactttttttaaaccaagaagtatgttttatttatttatttttttcttgtttttaccactacagcgacagtttccttgctatttttataaccagtgcttatgcagtcttggttttctatagctctcacagagactgcagacaaaatgcagatgttttacatgaaattgcaacttagtgaaaaccactctgtgaggagctgagctaatgacatctgtgtagctttcaggtgatctgctagaaaatggagcctaaaatatgcaggggcatggatttatatcataccccttagacagtcttccttaaatatcacttctttcagatggaattttgtgaagagttggacagtaattcaagaccccgagttctgtaatagcttctatattctgtatttccaactaaaggcagacccatagactttggaaaacaggtaaaaggattgacttcctaccagctagaaattggagccaagttagagccatgtaacttgtattcttgcttctattagaacattattttgtttaatccttatactagcctgggagggaagggggctgacctaacagttaattctttcttaagtatcaggtattggcctttccttccatgtacaaatgggaggctggctcagtgctgagggaccaggtgaaggagtgcattcctcccttctcttctctgtcatctcttgggtcacacatgctaggcaggagttgccctttgccttatctgtgcgactgctcatgatctggaaatgactgccatcactcctagataacaccagccctgggcttttgcggaatgaagcccacattacaaatcatgggattatagtgaccagggagaggtcctacttgggagggagtgattcttcctgaaggtgaaaaacagcagggcagggaggcgactaccttcatgaagtgctccttggtctgtatcctccttttcggttagaggcaggaagagtgaggggaatttcagccacagaagagtttgcgtgtgtgtcattttatcctctggtgacttttcctcttcgcagcagtgatcccagaaaacaggaaaaactgctatgatcacaatcagtttttaatgtaaagaaaagctgatgatggtttttcattgacacggcaaattcaggatttggggcctggggatgaagctgacggtctgtgaaagtgcaggcagccagctccttggatgaggtccaagtccaaaagcctaggggtaaaagtaaaaggatggcttaatttcaatggacacccgtggcatcttagatgttgtaccttcctgtggcttcttagcaactactctaccatgtggcggctgtgttagagggggtactacatccagaaagaagacacgtgccagtagaacttccatgctgcatcataggtggccacagagccattacttccctgtttagtttcaagttgtagatgtttcgtatttgcctaaacacaagatcggcttatgattacccgctggcttaccagcccactttttttctcactctgtttcttttctttttttttttttgagaaggagtcttactttgtcacccaggctgaagtgcagtggcacaatctcggctcactgcagcctccacctcccaggttcaagccattctcctgcctcagtctcccaagtagctgggattacaggcgtgcgccaccacgcccagctaatttttgtatttttagtagaaacagggtttcaccatgttggccaggctggtctcgaactcctgacctcaggtgacccacccgcctcggcctccgtaagtgctgggattacaggcatgagccactgcacctacccatctgtttcttcagcttctcattatctcaccaattctagagaaacagagttgctggttgtgtaggctaaactaaggccactgtgatgtcattgcttttgtctcctttgacaccctttttttttttttttgttactgggtcttgttctattgccaaggctggagtacagtggcacagtcaccactcactgcagcctcgacctcttgggctcaagtgatcctcctacctcagactcccaaatagcagggaccacaggcatgcacctccctgtccatgcctggctaatgtttttttttttttttttcggtagagatggggtctccctgtgttgtccaggctattggttaccttctttatcatagttcaatcctgagggtgtttccttggccttctgaatgtgtatgagggatgggatctgaaaagtctcctcctctggggctgatcttatgacagactttatgaagttctacccaagaatctttccttcgctcacacacttcgctcaccaaaggagctggtcctgtggcaggttcagaatctgtgaagtgaaaaacgtattaaaattttgtatggaatttgagaactgtgtagttctgtctgtactctctgctcttcagtcacaaacagctctcccagctgtcctcctcactcttgccttctttgttcttgttgctgaaaatgcccaacctggatgaaaacctctaagccttgctcttcctcctggctcttcgtttcggtagagcttttgttatacttctgtctatgatatctccctctttttctgcttaccttttccgttatttcaagtaaaactcatctgctattaccagattgtccttattttctttttgcgtgaaattaactagctttattgatttttctaataaaagaaatacatgctcattgaggaatatttggacaataacaaaaaatattaggaagaaagtaaaagtcacataatcccctatagcataattattgttaatttgtggtgtatcttgtcctttgggatcttcttcatatgtgttaacatatattgctttttcccccaaagtgccatcatttttcacttatattttgtaacctacttttctgactaatattacttggatatattccacagacagtacatacagagctactctataatgtttaatgctgcatagaattacattgtatggatgaattgttatttagttaacctgacgatggacttttgggttgtttctgttattaatagctatgtgggccaaagcaggaggattgcttgaggctaagagtttgagaccagcctgggcaacgtagtgagatgctatttctagaaaaaagtaaaaaattagctggtgtggtgctacatgcctgtagtcccagcttttcaagaggctaaggtgggaggatcacttgaacccaggagttggaggctatgttgagctgtgattgtgccactgcactccaatctgggcaatagagcgagaccccatctctttgggaaaaaaaaaaaaaaaaaaaaggtaagtggtggcaaatatctacatatctgtatagctgtgcctacttgtataacttcaggatagttattgctagaagtttctaaaaatggaattactggttcgaaagctatgtaatatacttaaattatttaacaatatcttttttttttttttttttttgagacagagtctcacactgttgcccaggctggagtgcagtggcgtgatctcggctcactgcaagctctgcttcctgggttcatgccattctcctgcctcagcctcccgagtagctgggactacaggcacccacccccacgcccgcctaatttttttgtatttttagtagacatggggtttcaccgtgttagccaggatgatcttgatctcctgacctcgtgatctgcctgccttggcctcccaaagtgctgggattacaggcgtgagccactgcgcccggccaacaatatcttttaaaacttggaaaagtatatggaaaagtgaaaggttaatataataaaaatctatgtacccatcatccaaatttcataaatgtaacactgtaccatattggcttcagatctgttaacataaattttttttaagtttgacaaatatgtactcatgcttggaggctcaggaaaaaaaattggacaaatatgactaaagctttctgcagtcctttcctcctcctgatactgataaaagcctcattactgtgcatatcttatccttttacatacatgtgtccataaataatgtatagtattgtgttttaaaatgttatacacatgatactattcttgcaggcaaaccttttgcaggttgattttttttcattcaaagtcatttctaaaaagttttcatgtgtaaaatcatttggtttaattggtgtataatgcaccattatatggcagtgagaaatggttaaagtctaatttttgtgtattacagacactattgtaatgactgtgcaagagtttgtgtacgccagctacctaggaatggaagtgatgtggtggggagtatgattctttagctttactaggtaattccagattgttctctatagtagttgttatgtgtttaccaccaatgtatataagtgttcatttccccttatttttgctaacacttggagatcccatgcttctcagtattttccagtctaagtatgatataatatctcatcactttaatttgcattttcccaatttatcaaagagattgagcaatattttattttctttgaattctctgttcatatcttttacttatttttcagttgggttttcgtctttttcctttagaagttcttaatatgttctgatttttaatcacttgtcagttatgtgctctgtaattattttcttcctgtctgtggcttatcttttaactttgtataggttatccttgtgaggttatgtgtgtgtgtgtgtgtgtgtgtgtgtattcctaaattgttttccagaaaaattatactggtttacagaacatccaacagtatatgagagtgcccagcttgccacaccctgcctgactctgggaatagttttatcatcttgcccagtgtaatagacaaaaagtggtattgccccttctttggtggcttttcctagaacattcctacctctttgttatagccaaaagctggcttttccctgaagatcttactttccttgtgaccctctccaatgaagccacctcacctcctcccaactctcgctctgaactccccacgttgcttccaagcccgggctggcaacctttcccatgagaagttagtccctcctctgctcactcttggtgcccttacctgcctattgacttcaggctaactgttaacaaccttcttcatatgtcctctttttggcataattaggatttgaggattcatactgagaatccatcaatgctccggcctcacagtccctccatccttccaactctaaggacttcgtctttattcctcttcgggtacctttggctttatcacttggagcagtttcacttttaggatgctgaactcggagattcccttcccttccctggtctcctgtctgtttccacctcccactccttcgctgtcccctcccaagagctggctctccagctcttctctgcctgtgtagcctcttagccaccctggccactgcctactgatttttctgttcagcctgagcttcaaaggtagaaattctcatcctgcacttgctgcttacctcagttctctctctcccttgtccctcctgtgatcattagccctcgtggaccacttgaacagatttttctgccgtagcccctagacctctgagtattgcttcatctttcagaagcataatctctgacccatcattcttttctcagaaaacttctgtgattccccagagaaaaactaagatccctgatttggctctcagaggcctctaagagccgacatgtctctgtctttccaactctctttctccctggtctactttcaattaaactcccatcagactgacaaacactttgttgtccttcatacgtcttctgctttcctgcttccaagcccttgtgcatgtagttctatctgtgtaggaatacccctgtattcttttgccatttgatcttccaggcctagcacaagggtcaccctctctgtaaagtgttcttgatcctttatttggaagtaatctccttctacctaagcttcaacattgtatctctctaatggcatctctctagtggcacttaatttcatctttctaatggcacttaaaatagtcttcctggtatttatgagatttatatgtctattgtattcaccctacagagtggaagctccttgaggatggacccatacctgatgcatttggtgtccaaacagcactaaacatattggcttatgcatggttggtgtttggtgtatattagctgaatggatgcatgactgtaagtatgaatggaaggaggaaagatggttgtcctggcttccaggaaccatagttacaatttcatactgccccccttctcctgctctagcgagaaaagaatcagactcacagcttgacccaggccaacacaggaatagttcaagctcctggcccacactgcacctgggggagcctgaagcttgtcctaccgtgggagcaggagccttgagtaccaggaatttcaatgggatgtttttgagtttaggaagttaggctggctgcattccatgacatgcaagggagaggattttggagtagcacagaaaatggaaaccttggccgggcgtggtggctcacgcctgtaatccgagcacttcgggaggctgaggcggggcggatcacctgaggtcaggagttcgagaccagcctgaccaacatggagaaaccctgtctctactgaaaatacaaaatattagccggtgtggtggtgcatgcttataatcccagctactcaggaggctgaggcaagaaaatcacttgaacccgggaggtaagaggttgtggtgagccgagattccaccattgtactgcagcctgggcaacaagaatgaaacttcgtctcaaaaaaaaaaaaaaagaaagaaagaaagaaagaaaagaaagaaaaaggaaaccccgagcatgcttttggcagaggtaggtgcagagaggctggagagcatggtaacccagaggggagggttctgtttttaccaagtcacaccactttccttcctccatacctgctagggctgagcctcagttgaatgtgagaaaaacgctatgggtgtgatatttgccactctctctgccttgggaccttgagtcatagtctcattcttcatctcaaacagtcttctgtctcattctgtccagctactgtttgtcctttacagtctggctcacatttcctctcccacagaagccccgtccagagctgctctgtcccctccaccactccattgtcctgtctttctagtttgtgtcccacacttgcatcgtttgctgttgtgtctcagtgccctacattcgtctgtgagctccccacatgtaagaatcacatctcatgttttgttctctcagctaaaacaaagtggtgatcaataattactgtcaatgttattagggagcctgctattggaacttggaagattatcagtagcagaaaaactgaagtgggaatggaaagacgtgaaagtagaacttagcctgggctagttctccagagtcttgagtctggggaggaactgccctttcatctttaccatgggtttcttgaattctggcttctgaagctctgcctttcgacagtaatcagcatttaggcaggtgacagaatcaggtgttcagggtgtgccctccagggaagaagagagagaggtgatggccggcaccccatgcagcagtgactaatgtgggccaaactggcaccatgcctcccagcccccgggtacgtgggagctgtaggcacacatggtagattggagctggagggatcatttaccagcccttccctgagctggaagcaggcggggagcagcaagccaattggcagacttgccttttctgccttaaagtactttgtttctgttgctaacaacagacatgggtagtataaataaaacacagacacacaggcacatagacacatgtggagactgaatatttgagctgtcaggggcagggggagggtggatgtggacggggactgaaatgtgtggctaagcctctcaagatagtgtgcactaggtcttctcttcagccttggagatgggtgtagtgtaaggggtggctgtgtggaaggccccctgaaagcagtcaagtaggaagtgatactgtctggatgccacaggcttcaaagactaggtgctcgttatggctggatgcagtcctcattaggcagactctttcgagctagttgctggtgatccaagggccaatggtaacttctttccttctgttctgccctttcaaggcttgactcattgatccccgttagtgctcacatgtggtataatggtcagcagctgctgtggcctttctggctgacctgagctgtacaagccagcatgcctaaatatgtgactgttgttttgggtaagctcctgaaggatgtgagcttccttagtagagactgagacccattcagcctctctggaaaagatggtcttagtaggaggctgaatagttcatgctataaaaagcaacagctaagtcacatgtgagataagcttattcagagacttgaggttcaggtagattacagggaggatggatgatgaggaagactgtgagtctccactgctggaaatataagtagggatgggttaggtgttctctcttttttttccctgggttgaacattatattccctggtatctaagattacatcaagagagcctcttctggttctgggaaaaagaataactgtattgataggaattttagagcactcccaatgtgtgtagctttgagcacttgattcacagatatctctgacacttgggatgatcatctgatggtgtgggcatttggagtagctcttagctggtctctcttttccatcttactgctttcttggaccatatgtgacaggcctaaggaatgtccaacaggaggtacctttggtccatatgaataccaagtcagtaatagttccaatcttctagaagcagtgagacgccactccagtctgagggtgagacatgaaaaatatgtgggccttttccccagtcattgatatagcaacatttgtctcccctgggcagggggaaatgaattaggattaccctctgggttgagcttacaagtctgtcttaggatctcttttttaccgaggtagccctcttggctatccaaggtggggtgcctgggtgggggtggcacactggaagctcatagcagctgcttctctccaggcactgtaactcactagcagcttaggactagatgtgaggcatgtatcacgtggcatttgttactacaggagttaaaggaccaaagtaatcttaaatgggttacctattcttataatttagaaggtatgcaagattatacctataataatagcaagcccattcactctctcataagctttcttaaataagagagggaagggtggagttactcctatggtcagaattgcagattaccctttttccctaaagaggcctaagggttggctcccatgtgacccccatcatctctgtagtcaagtagcatcaggcctaggaacccctaaggagatcattctctctctgttccctggcttagggcagggatgtgaggcttttgcctggcactaaggagaggtagttgaccatggctattattgaatgaggttggacccagcctagctgataaaattctaaagcaagatggggcagtgctacccaaggtggtcacagagaatgaaggttcttataatagaatatattctaagccactaggccgtggtggcttctttgaaaggttgaagtcttgaaaggtaagaagaccccatctagctgggtttcatgtgctgccctcaccttacccctacaagtggcacagcaagctgcctgcgatgtctggtggttgactctgctgcctgcatggttcaggtgagcagagcagttcatgttgaagcccctcccaccggtcaggagcctgtaggactgtgttgttttccttcctgtgtcctcagtgactgggctagtgtcttgcacaaggcaggtgcttggtcattgtttgtggattgaatggcttctcagcctgagcttcaggggaccttggcctgggccttggagcatactaggagttggataagcagagaggaagaaggagagcactccaggctgccagtgatttgagcccagaaacatggggcagaaatggacacgtggacatgtttggagcagaaggtgtcctgcctggagagaggtaggtgtgtgtgtgtgtgtgtgtgtgtgtgcgcgcgcgcgcgtgcgcgcacgtgcgtgtctgtgtgcatgtgcaagtctgtgtatctctgtgtgggcaggtctggggagggtggtagggccagggctggctgaagagggaaggaagaattggaaagtgagattggttggaaccaattaagggaacctgagtctggtgtgattggcggttaaggagcccagaagaatgacatgatgatactgacattccaggatgcttagtctgtcacttatgagcagagaggactggaggtagaagaataaaggggagcttgtcatacaataatactgtttaacatttatttagtgcctcctatgggctggcactggataaagtgctctctgtataaccagagaccattgcagtaaactaggtatgaggtgataaagtggagaaaaatttcaaagaagatgacattgtttcttcatatttggctatatttggctcttatttggttaaagaagaaatggctccaaggacgtcttcctcctgggtcctgcttccggcagcgtgtccttgagcatggggctgttaatctggcctggttggagctgctgagattttgcatgctccctgccaggaaccagtgtccttgggtctcagctggggtgtgtccccaccccagccatctggaaggtcagaggaattagccactagaatgtgcccattagtggctttgaggggttacaacctgtcagtggaatctgaagcccgggaactgcctctctcccagggctttttggagttggaacagcctgactgttctagcactgactgctcccttatttggacagtaaattttcagggtgagattggacttctcttttgtcttgggagagttttttgtttttttaagtatttgacattcttgtgagtgattttcaaggagataacacgacatcagagctatacctttcttcacctgattctttccttggtctctagtccatccacttataagacccagatgggggccaggcacagtggcccacgtctgtaatctcagccctttgggaggtcaaggcgggcgggtcacttgaggtcaggagttcgagaccaccctggccaacatggtgaaaccccgtctctattgaaaatacaaaaattagccaggtgtgttggtgggcccctgtaatcccggctactcaggaggctgaggtgggagaatctcatgaacctgggaggtggaagttgcagtgagccaagatcacgccattgcactgcagcctaggcaacagagagagactctgtctcaaaaaaaagtgaaaataataattaaaaaaaaaaaacgaaaaaaataagaagacctagatagggttcctagactgcccactcatctcagtctccccaggggagaagcaagtaacatcatcctatagacaagaggcaaggtgtctgaggccccggggttgggcttcagggcctgggggcaacttcctgcccagccttgagacatatgtcttggttttggggaacttgctgtgccccttgacttgtggatttgtagtttatcagcccagcttcatgtggggccaggatgggagcagggcacagccaggagttggggtggtggtgatgagatggtggatggtagtggtgctactgaaggggaagaatcttctgtggcgattttgagagcacacttcctctctgtcagaagcgcaactctgtcagcttctggctttccttctgatggatccctgtaacccttaggaaagtcattcagctaatggcagtgacactagattctaatggaggaagggaaagcaggaaggagaacatgtttctgtcaacaaaggtgtgctttcactagtcagaacttgctataaggcagccttcagcctttcaggtgattactgtgctttgggattaaagtgtcctgccgtttctggaagagactgctagtcataaagacaggtagggctgaagggtggaggtagggtctccagctgcagttgtcaagaacccaacgtgaaggctgactgagcagagaaactgctgctgcccagaaagaaagcacttttagcagtggtaagtcctttgcatgcactatcttactcaatctgtacaacagcacttcgtggttggaactgttctctccattttacagatgagaaaactgaagcttacagagggtaggcaacacatccaaagcttcatagctggtagaggcagagtttcatacccaaagatcacccttttcccattgtttcttacagaggaaactgtgataagccattattttttataaatgttacattttagaatagtttcagatttacagaacagttgcaaagatagtacagagagacagagagttcccatagaccctgcaagccattaattttttttttcctccttttctggtccattttatgagaattcattgggggtggggaacagatttggaatgaggacattttttccagagattccaacttggtaatttttttcagtaggattttttgagcgtccatcagactacattatttcttccccagttctgctctgcctcagctctgctggactgggctgggcctggctttgacatctagtttcagagtcaaatgccccactttctgactctgtctcaatagggtcagatggtaattgggtttccgagagttaggaaggcaggtaggtgtggggaggatctttagcagctgggcttctggatactcttctgtctctgatggggctatgacaggggagtgttaatattttcagctcatgtttgatggcatggagccagagccctcccgagggtcagaggcagcgtctctggggtgaggcctgtttgcttggatgccctcgagtctgtccttgtatggtgccagagtggctcatggtggtcgctgctgtgggccctggccgtggtctgcaggcaggcaggctggctggctgtaggcaggagaatatccctaggtagctggtgtgctttgctttgggtcccaggcacattctccatttaagggaaaggggtctgcagtcttcttggctctgggtgtgaatgggctggcctgaagtctgctcatggcctttgctggatgtgctttttcaatgagatcattccagaattacattcctatgaaattatatttcactcaagatgtaaagctggatttgtgtaaaagcactggcactaaaactcagggctcagagcggggcagaaatgagaagagggataaacagctcttctttaggaggaggggaaggaaagacagaaagagagagaaaacagttgttaaaggattttgcattgaaaattggtgcgctgtaagcatacccaaggagttgggattgccactcacccctggaaaggcaggcttgatgtttgttgtcccagctgcctgccacccccaggcagtttggagggagatgcccttgaggcttcagtgtgtaaggttgctggaacgctggagccgcccaggtgtcccctggtcatggcactctaggcctatccctgcctttctagcctcattttgcaccatcccatatctaatttctttccctgtctctgtttccttctctctcacacacacccacactctcacactcactctactattagtatgatatattgctactcacaacactcctgacaccaaatgtgtggggttttttctctcacatttgccaatttgccaaactttctggacaccaactggggtttcttacaatttaattcaattttgacactacctggagctagcataatctccatagattaagtggggacaagactgtccccacttcagatgctaatcacaagtcagggccacccatacttttgaccaactcactataaagttggagggatcggttcccacaaccccctcctcaggtttggtaatttgctagaatggctcacagaactcagaaaaacagttgacttactattaaccctactattagtattatattactattagtttattaaggatacaactcaggaacagccaaatggaagagatgcatagggcaaaattttggtgtgtgtgtgtgtgtgtgtgtgtgtgtgtgtagagcttccattccctctcagggtgcaccaccctcccggcaccttgatgtgttcaccaacccgggagctctctgaactcagaagttttgggtttttatggaagtttcactatgtcggcatgccatattttgaatgtcccctccaagactcatgttgaaatctgattgtcattgtgatggtattaagaggtaggacccttcagagtgattgggccatgagggctccaccctcatgaatggattaatgctgtcattgctagagtttgtttctgataaaaacaagtccggccccctcctgccctctctctcttttgtgtgtactgttgtgcccttctgcctttctgctatgggatgatgcaggaagaaggcccgcaccagattcagccatcaatcttaagacttccaagcctctggaaccgtaagaaataaatcctcacttcattagcataaattcaggtatggtagagggacttgttatgaatcacaaagtaggctcctctcacccccatccctcaggaaatgccaagggtttttgaagctgtgcccagaactgggaagaaggctctctctctctctctctctctctctctctctctctctgtatatatatacacatatatatattccttattatatgtagagagatatctatatatattcattattttatatatggaatacatagatatatttatctcacagtaacacacatgtgcacacacgcacacacacacacactcacagcccctgcatgctggtagtgtgagattgtataccccatactctatatgattctgctttgtattcctttgtatatactgttccccatagcgtggaatgtccttttctccccttgtctgctgagagcactctagttgctctaaaacccattttagctttgcctcctctgaaatcttttgtgctgcctgctgacggttactttctggcgtctttgtgctgccacagctccttgtgcatcccgctgctcttgcacatttcatttgatatgttttcgaggaaaagcctctagtatggggcttagtaaagggtaggtgcttgtgaaatgattgttgaagaaagaaactaaatgaatgaagaattggatctaagtgaaggtcatgtactgcaggcagggcaaaccacagaaaggtgtctaacatggcataagtgctatcagagaggctaggagatgagtgtcagactggcagaaaaggtggggtgtgcgtacttccctgtgcacacaagtatggagtcgttcgtggagtggcaagatagagtctgtgcagtggtgcacacctatcatcccagctacttgggaaggctgaggcaggaggatcattttagccaggagttcagggctgcagtagctataatgatgcccctgcacttcagcctgggtgacagagcaagaccctgctcataaaaagattttttaaataaattagaaaaaagaaaaaaagcccagtgagttctgggttccatagactgactatagggattaggtctggactcactcaaggtgagatgaaactattttctgagcaaaatgcagcaggatagaaggaaaagagctgtagctttggaattgaggattctgggtggtggtgattatactgttaataatgataacatagtcctaactatgagccagacactattccaggcactttacatatgttaattcatttatccttataatgtctctatgaagtagtgactactaattgttgatttatgaagattgcagagcaattctggacttggttctactcttactaattgagtgaaccgagggcaagatgcttagccttcctgagccccagcctcctcctttgtgaaatggagaagataccttttgcatttaatcctattgggcttattggtagactcaaatgagataatacgtgaaagtgtttttgaaaagtataaagtactctaaagtactttgcattggggaagaagggaaacttgcaaagtaattgtagtttagatactgggctcatacttaatgcagatgctgctctgagcatgggccacagttgcccttcacagctacacaaggtgggctactggcagtctctttgattaaatgccaggatttgagctgctgttaaaaaaatcaagaaatctttttttgcccctttctttcttttttatgttttgtagagatggagcctcactatgttacccaggctggtcttgaactcctgggttcaggtgatctgcctgccttggcctcccacagtgctgagactacagtcatgagccaccgcacttggcccaagaaatgagttttattggggccaaatgtatatgtgaaatgtcataagggacagattttttgtgctaaaccagtccttctttcccagccaggggaacagtggtaaagctgggtggtaggcatttgcatgggggaggattaggatcagtgtggccactgcaacaggtggcaaaaaggctggctcagagcggaggcacagcagctgactgcagggtcccatgagcagcaggtgtgtgaccccttttttctaagacgagacgcttatgggagtttttagaagttgctttatgaccaggcgcagtggttcacacctgtaatcccagcactttgggaggccgaggcgggtggatcagttgaggtcaggagttcgataccagcctggccaacatagtgaaactccgtctctactaaaaatacaaaaattgtctgggagtggtggtatgcctcccatacctgaggcatgggagcctgtcatcccagctactcaggaggctgaggcacgagaatcacttgaacctgggaagcagaggttgcggggagctgagatcgcaccactgcactccagcctaggtgacaaagtgagactcttgtctcaaaaaaaaaaaaaaagaagttgctttacgttgctgttaccttggcagtggagactgtgtccctcaaagtggttctctgctggcactagatacacaaatgtgtcagcacttgggcttggcaggcattgctgagtcaggcagtgagtgataagggagatgaaggggacatagggggagtgcctccaagagcagcaaggaggggcagtgtggcccttctaagccacattactacagtattctctggagcttcttagagccaagtggcttcttccatgaggttcctgcaggcctgagagttgcctggattgaccatgatgcctgagtgtataattataggtcactgaacagaacccctagtcagctacatccctcaaaaatgcctaattgtaggctacaaatatgaaaatatacaagagcttagaaacatgtcatacctcattacaaagagcaatggcatgagtcagctgtgacttgggtggctttagtgtgcttggtgagcatgctgactagtccagaagagggcaggaggcacattccccaagcttcctacagggagattgaggactttgggaaaagggagaaagtataagctgtgaccatagcctgctagtcacatctactaaaggggtctgctcacctgatggtagatttgattcctctttgggaattgtttcctgaccagtttacaaaccacattagaaaatagcacatttggccaggcacggttgctcatacctgtaatgccagtgttttgggaggcaggaggatcacttaaggccaggagtttgagaccagcctgggcaaaatagcaaaacccgtatctctacaaaaaatttaaaaacttagctggctatggttacatgcacctgtagtcccagccactctggaggctgaggcaagaggatcacttgagcccaagttttaggctgcagtgagctattactatatcactgtactccagcctgggagacagagcaagacctaatctctaaataataaataaataaataaattaaagatccttgagggaagtgaggtcatatgtaataccttatattacctaactgggccatacagattttattgctgggttgagggagcccactctgtctcagggtggggaggggtacttggataagtgcccagcctggttgctctcgtccggtctggcagtgctttctcaccgagaggcctctcccagctcagaaagaaggaacagctcgatctagatctctttcttttgtccctccctgttctcccaactccccttggtatagatgagtctatacacacccttgctgccagtggcttgccattccttttctgagtcactgcccttcattaccagatctctagtggtgatagtagaagggagggttaatctgtggcccttggggtactctttcctctcagttttaaactttttagtcaactctaagaatctaggaatctcagtattgaaagcgaccttaggtgccacccatgcccatctcaaaggcgagggggtagactaatcttatctacctttactgtggtattcccagcatgtaactgagtggagtgtggtaggaggtgcaaaaaatacttgcggaatgagtgagtccctgtaaatagcagcagcttcacaagaccactgtcattgcctcatttgttcatttttttgacgaatattagtaagctccaattatgtgccagttccttttaagttctggaatactgtgatgaacaacacagtccttgtcctctggaacgtattctgtaattgagaaataaggaattaaaaagaattgatagtctccaaatggaatttaagaattaaaacttcttcttcattttggcctctcagggtctctcattttctgaggtctccttgggggaccctagaaaacacatctaatccctttttcacacgagagcctttccgaattcccaagccaatgatcaccctccccgctccacagccttctcttctccagggtaaacattctcagttccttccgtcatttctcctgtgacatgcttctgagtgccctctccatcctggtcactgtccttaggactcagtccaaactgatagtctgtccctctgccagttgggagtccacaacagaataccacctcccacgcattaatttccagggagtgttccagcctggagcctctccttactctgggctcaggcgataggtgagggaaagagaaggtcctggacttggccagactgagatcatcttcatatttggccaatcctggaattcgaaattcttttcttttgtctcctccctgcctccccaccatccttcccttggtatagacgaatctacacacagccttgctgccagaggcttgcctttccttttctgagtcactgcccttcattaccagggaaattagcatgaaaaagcgaattccagttctataactgtattctattcttgtcctctgtcacattctccaacccagcacccccacctaaaatgacaaaagttgagtcctgtgacatcacaacagttgactattgtatcaacagctgtgatgtcaccaacagaggattatgacttcaaggaagaatggaggtggggcgcatagctggcaagaaaccccgtgggaacaaagaaggtattttcgtgcagatcttcacccagaaagcctgagttggcctttcagtggatggtctgtcagtggaagccctctccttggttcccattgctccctgtctctttggattaatgatttggcttgtggacattgcccaagtctgagcgtgtgtggaagacccctgctggccggcaggcttctgggctgtctttgggttttattcatgaggttggagctgaatagagcttttcagggagggagttcagaggggtgcctgggagcctagggtgaggctgatgtggatgtgcaggcgcctgggctgagggataactggtgtgcaggcacttctgttcaggcagaggggttattctaccagccactctgggaagcctgagtgtgctgccacaggcctgaatgttgactcctgcccacttctggggctgggttgggcctgccctgggaactcctcttggctccatgaacagagacttaaaaacacctgctgcagagactcccaaactttcttagttcatgggccttagtgtttcagtaatttttttttttacagtgtccatagcccaaaataaatacctaagttttcttttataagtaggttttttgtttgtttttatatgaagtctcactctgtcacccaggctggagtgcagttgtgtcactgtatcctccgcctcccaggttcaagtgatcctcctgcctcagcctccctagtagctgggactacaggcaggcaccaccacttctggctaattttttgtatttttagtaaaattagggtttcaccatgttggccaggctggtctcgaactcctgacctcaggtaatctacccgccttggcctcccaaagtactaggattacaggggtgagccactgtgcctggccttaagtaggtttaaacaattgagtatttatatcctaacaactgagtagccatctgaaaaaaaaatgatacaagaaattgaaaggaaaaatatttatattccattcttaaccacacttactaatgggatgtactaggtactgcatagcatatcagaccttggaaccagattgattagtgccatgcttatttcctgttccacattgcttttcacatggtatttgctttttatcacagcaactgctgaaaacccagcctcagaaagaaatgacatcatcgaaaagaatgtaatgcagtctgttgttgaagctgtgaactcatggggtgttcaacaaatgttgagtgttgctctgtttccctcaaagatttaaaatatttagcagtatccctgtgagttcatcatggggctttggggcacctcagcacacagtctgagaagcacagacctgaaactgccaagtagcacttgctctgtttaaaggaggaagaagaggcaagttcggtcatcatcatggcccttaaaggagttgggcaggtggatggacagactctttctctgcagtctcagctccagcagactgcattgttagggggaaggtctttgtttgaccagggtctgtgtgtgtgagcccctttccctagatggggaagaatgatgataggcatctcttacgcttatttgttgttgactcagagccttctgaactagatggcttaaagaaaaatgggattttgacaaccagaatttaggggccaggcgttggaccttctgctaatatccttttctaattctttttttttttttttttttttttgagacagtctcactctgtcacccaggctggagtgcaatggcgcgatctcagctcactgcaacctctgcctcccgggttcaagcgattctcctgcctcagcctccagagtagctgggattacaggcacccaccacaacgcccagctaatttttgtatttttagtagagacaggacttcaccatgttggtcaggctggtcttgaactcctgacctcccaaagtgctggaattacaggcgtgagccaccatgcccagccccttttctaattctttatccagatagagtggggctgcaggggtgtacttgggatggagggtggcttcctgccacaagatatgacagagaccaaaggactaatgtgctctggtatcacttctagagcctcatgccaacctctccagactctggggtctgctgcttatgaaacgctaggcaaattacttaacctttcagcctcagcttcttcatccataaaatggagataatggcatctatttcacatagttgtaactaagattacacaagctaaatataaatacatgcatagaaccagcagagcctggctatataggtgtgctttcttctcctacttccaaatttgaggaaaaaagggttttcctccaaagggaaattgagccctaatgatctaagatctgtagttccagtgttaccctctaccctctactgcttcttttttcttttcttttcttttgttttttttttgagattgattctcgctctattgcccaggctggagtgcagtggcgcgatcttggctcactgcaacctccgcctcccgggttcaagtgattctcatgccccagcctcctgagtaggattacaggcacctgccttcatgcctagctaatttttgtatttttagtagagacggggtttcaccatgttggccaggctggtctcaaactcctgacctcaagtgatccacccacctcggcctcccaaagtgctgggattccaggcttgagccaccacacctggcctctctactgcttcttaataactttgctctgtggatccagtgttcccaaatctgctgagctctgtatcctgcttgctatattaaactttttaatgaagtatatcatacaacatgaatgtatatatgtatccaagtcaacaaatttttacaactgaacccatgtaaccaacactcagatcaagaaacagtctattatcaatatcccagaatctccctctagtcttcctatgggtaaccactctcctgacttctaatagcattgatttatttttgggttttattgttttctataaataggctcatctagtatgtattcttggtttctggctcttttattcagaataatggagagatttatccatgttgtgtgtagctgcagatgttcattctcattgctgtatagtaatcattatgtaaaataccaaaatttgccttctcttcttctgattatgagcatttgaatttttagtttatagccattatgaatagtgttgttatgcacattctcatacttgtcttttagtatgcatgtgtatgcatttctgatgggtataaaactaagaaaggaattgctgggtcatgggttatacctatatttagctttagtatataatacccaacgttattccaaagtggtagtattgatttacacttcctctgtcagtgtttgagaattccagttgcttcacatccttgccaacagtaggtattttctttttcattttatccattccagtgggtatgttaatgggtatcacatctcagttataatttgcattttgttgatgactaataaagttggataccttttcatatatctcttcactgtttgggtatcctctctggtgaagtatctgttctacttgtgccattcttcttttgagttgttttttatttatttgtagaagttcctcatatattctggatatgagttcttggttggatggtctactgagtacattgtcttatactctgttggtttgcttttcactgtctgtatggcatttgttaaatgaacaaagttcttatttaatgtagtctaatttgtcagtgtttttcattatggttatcactttttgtttgagatgcagtttcgctcttgttgcccaggctggagtgtaatggcgcgatcttggctcaccgcaacctctgcctcccgggttcaagcgattctcctgcctcagcctcccgagtagttaggattacaggcatgcgccaccacgcctggctaattttgtatttttagtagagatgagatttctccatgttggtcaggctggtctcaaactcccgacctcaggtgatccacctgcctcggcctcccaaagtgctgggattacaggcatgagccactgggcctggtcttataagcttttcagagagcaattttagttgagttcttgggctgaagctactcctgcccagaatcgtttgggttttcacagggggaggcccccttttgaattttctgagtggttgtggttgctgtaagtgggtcagacccttcactgggaaggccagaggtaactagagatgggcctggactgtggagcccaactgctgttcaccctatctagggagggcagttctacttacagggtacagcaggtgtgaaggccctggggtaggaacacacctggtgtgtttgagcacatggtatcggacagtgtggctggagtggagacagtgaaggagaaagagtagttgaaatggggccagagttataaaagggacccagacaatggagggccttataagtcattgtaaagattttggtttttactttgagtaatgggagctatggttttgagagttttgaatagatggggtgacaggagccatgatgctggtggggagtacatgtgatgagtgtagctcattgaggatctgttcttagtggaatcggaagcagaggcagctaaaagagtgaggatgagggaggaggtgttgaagttgagagctggagggaaagctaaaccccagcccggagacttccagtagcactgggctctgagtacccactgttctttgtagatggcttctcattgttctttgtgttctcattatagaggtggagtagtctccgtaagctatctgtggtaaaacggaggtattaggattttgcccagtccctttagcctttattatttcctagtcttactcggagaaggtgcagcttgtggatgataagtttcttctagagcagaggaggcagcttgccatcagtcaggttgagctcagctagaccagagagcgtgggaagggtgagaaggaggtcaggacttagagtcaggaagaagttgacacttgaactggatatttaagaaagaatggggggcaagggacactgaaaatcaaaggaattggttgaacaaaagcttggcggcatgaacattcctggcatgtgcaggaaatgtcatccagtgagatgtggctggccagagtgaaggtgctgctctaagataggactatggcctctggatcatcgaaattgcaggacccaccatgttctccttgccagagcgaaagagggcagtggttggtccccaggagcagggttttttatggatcaggcttccaatctgcctcctttttccaagtggtgacaagatattgggcagagtaggtgccatagtcttgacagagctaggataagccacttgctgagaggctgagtttccagaatggcagaaacagccatgtctaggtttttaaaactatgtgagaaacaactagatttcctttggcctgaaattgcctaacaagacctcactccaattcaggctttcaggaagtgtgtaaacccagctttaaacctctgcaggatctgcactgaagtggagaaggaccatctggcaggaaaagggattgaaaaatggttgaggttgaaaaagcagacttaaagggctttctttgaggaggagggttgggaaggaggatgtgggaatgataagtggacagtgaagagatggaaaaagttcttacttttttttctgattattatgcaacaacaaaaaaattgtctttcctgtggctgattgagggagatttcagcctcacgggggcctgtaaaaacacccacctatcctctgacctcccagcaaaacaaatgttggttcctctccacttgaccaggctcactatccccattacatttttccttgaagggctttctggacctggggctggaatggagaagatctaagatttacaatgtgtatagaagtagtgaaggagaaaagggtttactgttttgtagggaatgggacagtcttgagaaaatccttcctggtatttcttttctcttctcttctctttttttcttctcacagggtctgactctgtcacccaggctggagtgcagtgtcatgattatagctcactgcagccttggacttctgggctcaagtgatcctcccacctcaggctcccaagtagctggggctacaggtgtgcatcaccaacctcctgctaattttttatttttagtaaagacagggtctcgctctgttgcctaggctggtctcaaactcctgggctcaaacaatcctcctgcctctgcctcccaaagtgctgggattacaggcgaaagctcacatttttgagaatcttggtttgggtacttacaaggaacttaatctaaggttactgaagcttgcagcggctctgggttgtgtgggcaggtcaggggaagggaggtatggcagggagagaatggaggcagcactgagaagatagaaggaaaggggctcaggttcttagtatgtttctaggagcccttttatcccttagagaaccaggcaagtcgtcgatctgtcgggaggttaggcagagaggggctgtgccttttgcttatagcattggtgagcttagctctttctaggaagcaggggagcttttccacaggaatttagcaggaggccttgctgcttcaggaagaacaggggctgatgggaggatccagaagacacaagtgctgagggtgaggttgaagtcccatgcggagaaggatcatcctgatttagttgcatttgttaagctccttagaatctgagggccagtattggttgctgagactcttggcagccctcctctggggagctgccagtctgttcctcatgtccttggccagggcccatggatgaggagaggtgcaggaaggagttggcaagaaggtaaagagggtctgaggagatgtttgctgggcaggatgagtaggcaggttggtcccagggcaatcaggccacagctgcacactgttgggtcactatactgtcactgtattgctggccctttcctggctctcaccatgttctcagaacacacacaagagctctgttcccattcccaccttctctgtccctttaggctgctgcctaaactttgacttccacgtgagcagaattgcttaggagagtagtggaacatagatgtagcagaaattctctcatgtggttgagaggtttcctattttcgggcatcttgacttcttacctcggctataaagcagagtgctgggcaatgtttacgtttcctctcagtggtgacattaacctcagcagaatgggaggctttcctccaaatgcttgcatttcttcctcttcactcagggctcagctgtctcctgcttcaagagcaaggcatactgtcacatccacatttatgcctgcagaaaagtatcagacagacatttagaaatgtcacctaaacaaggacagacaggttttttgctctaggataggaaggtccattcttagaggtggggcacccctcagaaagagctcccttcagagactgacctctcatcggtcccttcttggacctttgagagagcctctgtggatcaggtgatgggatcgggtcagagggagaaagggcactcaggatggtagagagttgtctggtgaaggctggactgagcaaaagctgtcagccttccgggaggtctgtcctcctgtggcagtgaggggaattgatgggggtttcaagcagccaggaggctgtgccctgcactgctcctgcccagccgtccaggaggttttgtgtggctgttgccaatgccgtgcctcctaacccttcctgctgggatgcaggctagagagctgcgacacttacctgctggttgggaggtcaggttagagccgagtggaccaggtggaggccatggatgaggaggcacagcgctgcggtggagggagccgcggcatctaactgggccacttgtgctcagctctggcccactgttgtcatataggagtgcacacagtgatggtaaattttctcatttttcaaaagaagctagaatctgaatttttctttctattcacctgctttcttaagcttgacaactaattcaaattatttaaaaataaaaggaaggccaagtgagacatgtttttgcttctgcagaccaccagtgtatgactgatataaactctttttcccaggagcttagaaatgaggagaaagcaagcaaagggatcagggtgggtggcaggaagagtaatttcaaaatacaggaagacggagcacacctggagactgacgaaatggcttagatgagccattggtaatgctttcactggatcccgtggtgtgtgcgttcctttgtggttgagggccagtggttctctgtgtggtggaagaagctaatgggatgggggtaggaggaagaggggctgagtgccatcttttagttgcacatagctaggcagattcttgggaagatggtgagtcgtgactccattaagtccctagagaacatgctgtgggacacaagtttttgcacttaagggcatataagcttgatttaaagcgcttactaaaatgcagattcctaggccccatccccacagattcccgttcagtaggtggggcctgggactctgcattttaaagcaccccatcaatgttaaagaaaataagtggacaatggagtgagacagagctgggtctacattcctgctctgttccttcactaggtgagtgatcttggtccagtcatttaatttctctgaatttaaatttcctaatcagaaaaaaggagactgtattatcactaccttgtagaatggtgagaactaaattagaagacagttggaggcagtacagggtcctggcccagagctggtgcaggccacctggtcataaatccctgcccctttctagccgtgtgacttggagcaagctaattaactgctctctatcttggtttccttggtaaagtgtaactaaccctgtgaaatattaatagtacccacctcacagggttgttaaagggttaaatgacttaatacacatgaagtgcttgtaactttagctgttataattacatgtttaaaagtctagcagcgtgtctcataataaatgctcctttgcttttccttaggtccccttactgtgggtaacagattaaagcttaatccaaatgtcaccttctgatgaggccttcctggagtccactttttactttcttgtctcccttcacagttagcttctccagggcagggactgtgtcttccatgttaatatcctagcaccttgcacagtgcctcacatagggtcagtgaatggaatgatagtactagggagtctgaaagatgactcagacttgggaatggagaggttgtcttccaaatacctagggaagtgtgatctggaagaacaaacattttttaagcttctattgccagacagggcaatcatgggaggtaggtcatattgctattatggctgttatagtgacaaagtgagtctttgacactcactggagcaaggtcacataactagcagttgtcagaggcagggctggactcaaggcaggtgtttttccactgcccctcggggcctgcgactgtgcctgtttgtctggatgcagtttgtagaaaagttccagaggtaccttattctattcctttctctggattgttactcttcagatagttgtctataatttgtcagagctgtgtttttgaggaactttggatggatggtatatgctaattgaacaatttccttttctaaacatgcagtttctgcctagactttgccattgagggcctgggaactagcaaagaagcctctcatcatgcttgagtctctgctccattcccatgggcatttcctctgctttaggagtgtcttctctccctgcagtctgactagccaggatatcaggctaaaagcatagatgagggcctggggctgcttgtaggaggtggggagaaatggtgtagcccaggaagccagaatgctgagagtcctcaagcctgagcttcaggtgtaaagggttaacctggccttcagctcctcaagtcccaaattattctctgatcctgatagacctggcccagagagagcagttggtggggaggctggtgagtaggcatctgtgtttctaacctagtgcgcccctgtgaggttctcagcagtgccagctcaagatgcctgaattcccaggccacttctgagaatggcagctgcactcttggagaaatgtgactaagggtccctgtcatgggcctggaagcaattttgttctgcttctttcttggttacatcttcacaggatttttcttcttagccacccagatgtcagagtcaactacatttctctttcttagtaagttggctctgtgttctcatatacaactgcatgatagcatttcagagcagtgagtctaccctcctgaaagcagaaattcagggaaagaaagaatatgtttttcatcatgtttttttaacatgtttcagtttctggtcatgccacaaatcttttgccttttctccaagggcctgccctggaactgatagagcaggtcaaatgttgttttcatggatggtgatggttactgtgatcattgctacagttgaaaactgatgcttagcaagttgattcctatagcactgtgcttcctgaggaccctgaaaactggcctgagaaaatgtccagaggttgccttttctctcccttctctgttgtacatatagcaatatgatatgccaagcactttacttggcactgggctgatacaggtagagagtatctcactagagccagtgtgcgtagatgccctgggggcaagattgactttatcatcatcatcatcatcaccatcactaatgttatgctattaatatagacttaaatttatagggccaagcatggtggctcatgcctgtaatcccagcactttgggaggctgaggcgggaggatcacttgagaccagcagttcgagaccagcctgggcaacataaagaaaccccatctctaccaaaaagaaaaaagttagctggaccaactccattttatgaagggtaaaagtgaggcttagagttggtttcctttttccagaagcatctgccgtattcaccttggagggatgtttcattgctgtcaccatcagctaatcatcccctgcctactggctgcttcctctctttccagttaacataccactccctatcaccatcactaaaaccacaaccctgagagcttatgcgaagttaaaattagagctagtacatttcatcttgagattaggaaggaagtataaatgctatcaagaattaggacttgacttatttttatcatcaaaaccaatcacttatttgcaccaaagtaataagtaagatggtctccaggattaaggtcatcagtggccataaataaatatgtttaactttcacatccagatatacttcattttggccaatgtgatggaggataccaatcagagggagagaactactgtttgtaaactgttcagcttccgtgatggtggtgttcgcctaggctgtggtgcaccttgacattggaaatatgcttgatgtgtcgtttgtgttgtcactcacacccactctccaaggcacttaaaaagatttatttagctcttaagttttaacgtctatattgagatgtaattaacatgctgtaaaattcattgatataatgtaatgatttctaatatattcacaagagttgtacaaccattaccactatctaattctagaacatttttgtcaccccaaaaagaaaccccgtactcctatcagccatgtcccattctgccaccctcaaccagtgctaggcagctcctagtttactttctgtctctgtaggtttgcctgttctggacatttcacaaaagtggaatcaaggtttattcatgttgtagaatgtatcagtactttactcctttttatgtctgaataatattccattgtgttgatatataccacattttgtttatcatcagttgatggacatttgggttagttccactttttggctactatgagtaattctgttatgaacatttatgtacaagtgattgtgtggacatatattttcatttcttctgaacagatacctaggagtgggtcatcctggtttatatggtaactctgagtataactttttgaggaactaccaaattgttttccagagtggctgtgccattttacatttctaccagcagggaatgaaagttccaatttctctacagtctcactagcatttgtttttatctgtctttttttgttatagaaatcctagtggatgtgaagtaatatctcatgtggttttgatttgtatttccctaatgactaatgatattgagcattgtttcgtatgcttattggccaagtttatacctttggagaatttctgttccaaatcctttgtctaatttttaattgggttacttttttattattgagttgaaagaattctttatatattctggatacaattttcttaggagatacatgatttgcaaaaaatttctcccattatttaggctgtcttttcactttcttgatggtattgcttacagcacaaaagttcttttctttgacatagtacaattcatgtcctttgtgtgtgtgtgtgtgtgtgtgtgtgtgtgtgtgcgcgcttttggtgttatatctaagaaaccattgcctaatccaatgtcataaagatttacttctgttttcttccagcgttgcttttgtaattgtagctcttacatttagggctatactacattttttactttatttttaaatatggtatgaggtggggccctactttattcttttgtatatggatatccagttttctcagcacagtttgttgaaaagactcttctttccccatgaattgtcttggcatccttattgaaaatctgttgaccataaatgtaagggattatttctggactctggattctgttgtgttgatctctgtttctgttcttatgtcagtactgcactgtcttggttactttttagtatttttttttaattggcaactcagagtcttctaactttgttcatctttttcaagattgttttggctgtcctgtatcccttgcatttccataaaattttaggatcagcttgtcaatttctgaaaagaagctagctggcattttgatgggtattctgttgagtctgtaaatcaatttagggagaattgccatcttaacaatattaaattttctgatccatgaatatggtatgtcttttcattttttatgtctaatttctttcaatgatgttttataatttacagtatacatgtcttgcattccttttatttatttctaagtgatttattatttttgctgctattgttaatagaattattttcttaatttcattttcagattgttcgttgttagtatatagaaataaaattgatttttttttctttttggaggcagagtcttgctctgttacccaggctggagtgcagtggtgcaatcttggcttgctgcaacctctgcctcccaggttcaagttactttcatgcctcagcctcctgagtaactgggattacaggcatgcaccaccacacttggctaatttttgtatctttagtagagatggggttttgccatgttggccaggctggtcttgaactcctgggctcaagggatctgcctgccttggcttcccaaagtgctggaattacaagtgtgagccaccacacctggcccaaaattgatctttaatattgattttgtatcctgcacatttacttgaagtcactcagcagtttaataggttttttagtggaatccttaggattttctacatacaaaatcatgccatttgcaaatggaaataattttacttccttctttccaacccaaatgtacccttaaattttaatcttcatattccttttattacttggcataaaatagtgttcctgaaagggtagtgcatttaccatggtgatatattagctaagaatatatggtacatgaacagacattttttacttttaaatatttaaataccttaatgtatattacttttattttaatgggtattagaaaaaatgatgagcacttctagctctcaatttcatgatgtgtactcaaatgttactttatcgtaatggttttccctgaacatcttatttaaaataagataccctcttcaccactctctttccctctaccttgcttaagtttttttctctcttttttttttgagacagaatcttgccctgtcacccaggctggagtgcagtggtgcaatcttggctcactgcaacctcctcctcccaggttcaagcaattctcctgcctcagcctcccaagtagctgagattacagctgcctgccaccacacctggctgatttttgtatttttagtagagaaggggtttcaccatgttgcccaggctggtctgaactcctgacctcaagtgaactgcctgccttggcctcccaaagtgctgggattacaggcgtgagccaccacgcccggctcaaccttgcttaatttttttttattccacttaccatcaccttacatattatacacgaaggtacacttattatcacacacgtgataattcatgtgtgctcattgtctgtttttccccactgggatgtaagctgcatgaggtcagagactttgtattactcttcactggatcacatttgccgtggacatgggtgctcagtaaatatttgttgaatgaatagtttattgtttagaatgaggtgacttttttctttttaagaaaaggaagtcagtttcaagtatattcaagaaaaatattgaataaatagtatgtcaggagatatgcaaatatggcaaaaaccatggactgtatagaatgatagaagtttaaggaaactctaacttaaggaatgaggagagatggatggagatggagtttcttgggcttctttgtttattttgttttctgtgaaattgtgtccggaattggtgggttcttggtctcactgacttcaagaatgaagccgtggaccctcgcagtgagtgttacagttcttaaaggccgcatgtctgtagtttgttccttctgatgttcggatgtgttcggagttttttccttctggtaggttcgtggtctcgctggctcaggagtgaagctgcagaccttcgcagtgagtgttacagctcataaaggcagtgtggacccaaagagtgagcagtagcaagatttattgcagggcgaaaggacaaagcttccacagtgtggaaggggacccgagtgggttgccactgctggcttgggcagcctgcttttattcccttatctggccccacccacatcatgctgattggtccattttacggagagtcgattggtctgttttacagagagctgattggtcctttttgacagggtgctgattggtgcatttacaaaccctgagctagacagaaaagttctccacctccccactagattagctagatacagcctgtggactgatgtatttacaaaccctgagctagacacagagtgctgattggtgcgtttacaaaccttgagctagatgcagagtgctgattggtgtatttacaatcccttagctagacataaagattctccaagtccccagcagattagctagatacagagtgccgattggtgcatccacaaaccctgagctagacatagggtgctgattggtgtgttcacaaaccttgagctagacacagagtgctgattggtgcactcacaatcaaattagctcacactcctccgtattccaggccaggggtttcttggggtctcttaagctgtaacacatggagttaaacattaagtgggaaagcagtttctactacctgccacagacaccctcttggcacttttggaggtcatctggaagatgttcaaggtgcttttggctgcctatagaaacttggcttaccggcattgtcgtctttgcagggctctgggtttgcagagagccgaaatgaccatgactgccaacaagaattccagcatcacccacggagctggtggcactaaagcccctcgggggactctgagcaggtgggtaagggagcacttgtgggaggtggcatcaagggacctaggtcctgggtgggatccctccaaaatgtaaatagtcatcatcttgactgacagtcatccaggtgactggtctaggccagctcatgctgaccattaggcagaagatattttctagttctgtaagtttctatgtgatatagcaaacagtaaccctaaaacaagccttgctttgtgtctagcattctaaggatggggccagcaagaagcagctgatgttcttctggcttgtaaccttttcccatggtggggagagcttggggcctgtgcctgagctaagctgcactgtagtgagggaggctgaccacattgggctaagggtagagaggcagttacgcatattagcacaaactccaagcagcagcctaggctttataggagtttagagaaaccgtggattttggaatcatggatttggttcaaatccaggttctaaccacttaccaaatagcgagctctcagaacgtttccctgtgccctataaaatcttcattatttcatctataaaataataatagtagttatcttacagagtttctctgaggactaaatgagataatatatgtcagtgcttagcattatggctgacataaagctactcaataaattttaacccccttttgaggatgagatcaaagcttccagaactcacagatgcacagatagatgcacagtactctcaccagggcttctctggtcttggccaaggctggacactgatatcttaaaagaacctttagtcttttttattaaagctgtgtacctctcatagccctttctgctgaatgtcaggtggacaaatttggcttttggggcctctgcctctaagatggatagctatgagaaggatgcttagctttggtttggatagggctagttcattcctggatatctggctgtgcagtgctaggctgagtccaatagggtctggtcagagttggtggtaaacatttggttcattcagaactggagtccagatatagttggtagaatagtgcacgggatgtagcccctggggagtgactgtcatgaaggaggcaggggttccccacaccatacatacaggactttgtcccaatagaaacagtctggatggactatgccaaacagggtttgatggactctgacttgttaagtacgtaagatcctgggacttagccaagcaaactgactatccacttgcagcagcaagactgataggaacaccccttgcccaggcaatccctctcatttagactgggcttggtggcataccagcttccctgtactgagtgaggctgggagtggcaaggaacagcttcttgggcaaagcaggtggagaaactgacctcctccagaacatgttggtgtccaaggtagaaacaagtcaaggtctcagagtctttatctcccattgcctgctcctgggaaccatgttgttgggctcttgtcagcctagtggcattcttaccatgattgagctggcagatggggctgaaaactaaggttccagttttttagaatatcacactactgtaggagtgaaacaaatatatgtgattgtgtcattttatttgtaattttaaagaaattgtatatttaggacctgaaatggagattaccattcccagcaaccctcaactcctttaaatattctttttttttccttctaatttccaccatacaggaatggggtagaggggtgggaggggcagtatttacatcaagtttcaaagcagactcgagactgctgacaggtgctgcagtttctatttggagtaaatgcctacttacttctaagtgttttcagaaattgctcttcctttagcttctcagcatgcttgccatcataacatgctagatggtgtttgtaaatatctgagcctcagatgtgcctaaaaaaagcacctttcctgcctcccttctaagtcttctcttccttcctaccacatttccgcttctctccttccttccctcccccctttctttcctgggagcctggcttttggtgtgaagttgcaggcctctgtggctagtgacacccttctctcagagactacccctggggtgtaggtattatttagacattgtgatctggtggtttctttggctgccttcacccctggccacatctgggtgtgttctttgggctaaggcagtaaatcaccagttcatttaggaaggcattgtcggtgaactcagagggttctcctgggtgccaggctctgtgctgggcactggagggcaaagagggatgatccattctctttctccaaggtatttacaacttggattgatgatcttggcacctgagtttcttagtttgacctttcaataggtgtttggtagtgacctggggcccttttatcattgccagcacatgaatccaaggaggagactcctcggtgtgaccagagctttagttggggaggggagggtgttggggccttggaaagctgggcctttgacactttggctacgtcggggacttccacatcatccacatgaaggcagaggaacccagtggttctaagacgcatttgtatccagctttggtggaagagggaggtctggtcaaggaaaactggcgggggtgggcagatgggaccctgtgtaactgtcaaggtgtgtatttgaaggactgtacccttaatttgtgtaagacttcacctggtgctaccaccaagcctgtctgggttaaagaccctggattccagtccctaggttttcacaggtgtgttgctaatttattcccttccttttcctttgcagcttagtcttgatttggcaggaatgtgtaggaggggaaaatctaagcctttcatgtgactgcctcagttttgttctttgctgtatcttggtctcctggagcaggtttccttgtcttcgcttttgttgatgaggccgaatgagcatactgttcatccttacctgccagatacactctccccacaggctgttcccatttcagctcacaagatatggctgcatcccactctgggggtctggggtgggattctcaaacctcttctgaattctagaggtcagcctttactgtgttggtgttgatgacctggggtgggactggaagcaggttggtaacttgcaaaaaaggaagtattatgtttagagctaattcagctgtgtagatagggtgaactttgccacttactgctctcaggagatttcacttttgcagtaagacctggcaggcagcaggggctcttctctgaagacctgctgatttcctccacagcttcttcactatgaaactccagcacctgggtcattgcaacttggaaataacagactgtatcagccttgagtttgagaacttttgcttgtggtgggtgctgaaaatctgagtgtgtgagaatatataattcttgagggcaaggactttgatgtctttctgtgtgcctagagcctggaacaatgcctggcacgtagaagccattagctatttgttgattagtcaactagatagatgggagagcagcctcttagagcataggctgttgtactacttgagtccttatagtaccttcctaatgggtcatcttagctttggactctgttttcatctagtctgtagtttcttagaaaggtagagctgaaagggggctttgtagctcattcagtccaacccatttgatttacagattgggaaactgaggcacagaaaagaggaggtactccttaaggatacaaaactagtaggaagaggtactcaagcctgcctctcttcatccttctgttattttattatcccaacacattcccttcctatgagcactcctgggatcttcctgcccccaaagtactgctatccatgataaagtcaaacttagcctggtttgcagggcttttcatgatctggccctggtctttctttctgccctaatagttcactgttctctaatgcaaaccttacatttctgccaatctggatacaattattcacttctctcccagtgtttttcttgaccacccaactaagacaaatccctccctcctctgcattcactcagaatctttggttcaaaacggccaaatggcacttatcatatagtatctcataaagtggatatttgtgtgggtcttatttcccctactcagctggaactctttggaggcccgatacattctctgttgggatgttagagttggaagggatcttgagatatatctggctcagtaacttacattacaaatgaggaacctgtaagcccacacagctaattggcagtggagccctaatttcaactcatatttgcaggtttttatgcagagggtggcctcagtttgtgatacagtgaaatccagagatgtcttgaggttccatggccaatgtaggcacagatttggaccctgtgccttagatcgggggaagctaagagcctaaagagaagaaaaatctcctgagtagctgtgggtaaaagatagtgctgcagggcctgtcctggccgtggcaggccccccttaggaggccctgtggcctcagcccctgttactcgagatgcttcctagaatccaaccatgatgctgtcagtactggtctggttatttattgctacataacaaatgaccccaaacttagtggcttagaataatatttattttgcccaccaattgcaatttgggtagggctcagcaaggaaagcttgtgtctgttccttgcagcatcagctgggggtagcttgaaagttatgggtgactcaatggctaggggctgaaatcatctgaaggcttacatgtatgacagttgatgctggcggtcagttgggactaaagctagggaacacctgcacgtcacctccacacttggcagcatgccttcatagcatgatatctgggttccaagagtaagaatcccaagagaacaaggcaaaaatgcgtggcattttaatgagctagcctcaaaagtcagatagtttgtcttctattgtgctgtattgattaagacagtaacaaagggctgcccaagttcaagagaaaggaagataatttccaccacctgctgagaggaatctcaacatctctttataagaaggtatgtggaatgggataggttgtggttcctgtctttggaaaatacagtctgccctctgattgcaacaattcacatctttcccagatgcaaaatacactcactctctcccctaaaatctcaggtcttctcttattcatggcatcagcttgaagtctattacaatggaatcttgtcaccaaaatcaggtacagatagggccgggtgcggtggctcatgcctctaatgccagcacttggggaggctgaggcaggcagatcgcttgagcccaggagtttgagaccagcctgggcaacatggaaaaaacccatctctacaaaaagtacaaaaattagctggatgtggtggtgcacacctgtagtcccagctactctggagattggggtgggaggatcacttgagcctgggaattcaagaccagcctgggcaacaacatagtgaaaccccctctctaccaaaaataaaaaagttggctgggtgtggtggtgcatgcctgtagccccagctcctctagaagctaaggcaggaggattcttgagcctgggagatggaggtagcagtgagccaagattgtactgcacttcagcttgggcatagactgaaaccctgtcttaaaaaaaaaaaaaaatcaggtctggatgtagatgagacttttggggcgcaggttcattccttgtgtgcagctccttaagtactgtttctcttgctgtgaagacctgtaacttaaagagaatgtatatctgctacccaaaagacactggtgggacaggcttagggtaaccactgaataggcttcttttcaaaaaggggaaaataagaggtacccagcagtcactggtttgatgtatttcttatattcagtgggacagctgttgctaattctttgactaggtgttgactcatttaccttgtctctagctgcaccctctgggcttttggttctgctctctgactcatcttttcttttccatagaagtagctcattattgcaggtgagtagtttctccatctgcttcatgcccataatatgttaagggcccaaagtcttttcttcattttgtactatctctgctctttttactccaagctgatacatttcctttaaaaacttcatgggttggctgggtgcggtggctgatgcctgtaatcccagcactttgggaggccgaggcgggtggatcacctgagatcaggagttcgagaccagcctgaccaacatggagaaaccccatctctactaaaaatacaaaaattagccgggcatggtggtgcacacctgtaatcccagctacttgggagcctgaggcaggagaatcccttgaacccaggaggcggaggttgtggtgagccgagatcacgccattgcactccagcctgggcaacaagagcaaaactctgtcccccaaaaaaaaaaaaaaaacttcatgggtttcttatgaatcattttataatccattataatagcaaaaggcacacatacaaatcacttcaagataagccccttggccaggtgcagtagctcatacctgtaatgcaagcactttgggaggctgaggtgggaggattgcttgcactcaggagttcgataccagcctgggcgacatagtgagaccccgcccccatctctacaaaaaaaaaattaatcaggcatggtagtgcatacctgtagtcccagctcctctggaggctgaggtgggaggatcgcttgagcctgggaggtcaaggctgcagtgagccatgatggagccactacactccagcctgggggccagactttgtttcaaagaaaaaaaaaaaaaggaagagataagcccctctccacttcgatttggatttcttgggagattgctatgggacaaaggtttttaagattcttaggagccttactgtcttcagagaggatttacaggacccactcataagattcttaggaggccttttgtctgtctgtctgttctatgaggcaacactttaagtaatttaaaaaaaaaatttttttttttgagacagggtctcactctgtcacccaggctggagtgcagtggtgtgatctcggctcactgcagcctctgccaaccaggttcaagtgattctcctgcctcagcctcccaagtagctgggattacaggcataagccactacatctggctaatttttgcatttttagtagagacggggttttgccatgttgaccaggctggtctcaaactcctgacctcaggtgatccacccgcctcagcctcccaaagtgctggaattataggcatgagccaccgtacctggccagtttttgggggcttaacaaagggtttttcagtctcactttagattttttttaaacagatttattgagggacaattaaagtacaataaattatataatttaaagtatacagtttgagttttcacacacacactcacacacacacacatactcaataaaaccatcaccacaatctggaagccatttctcttcttttctttttctgagatggagtttcgctcttgttgcccaggctggagcgcaatggcgcgatctcatctcactgcaacctccgcctcccgggttcaagtgattctcctgcctcagcctcccaagtagctgggattacagccatgcaccaccatgcctggctaattttgtatttttagtagagacagggtttctccatgttggtcaggctggtctcaaactcctgacctcaggtgatccgcccatctcagcctcccaaagtgctgggattacaggcgtgagccaccgtgcccagccaccacaatctggaagccatttcttaatttgagaatgttttcctgcctagaggtactggaagtgaaaaccagcaagccctttctcatttgtgattcctttaaattttaacaacgaaacagctccttcttagtttacctcttttctcttttttactgtaggcagctagagcaagtcagatggcaccttcagcactttgcctgcaaatctccttaggtagttcatcagatttattagctgtatttcctattatctatgttaccacagctgacaagcttttcaacactataagggttccttcttttctagcttctaatagcatttccttactctcctttatgcccctactgacagcccaaaagtcactgttttaagattttgtttcagtagcacctctcttgcaggcgccaaaatatattccagacatctactgccaaccacccacctcaaaaaaaaaatttaatggcataaaacaacatgttcttatgctcccagactccatggattaggaattcagacagagcactgcagggatggcttgcccctgctccatgatgtctgccttggctaaaaagacttcaaggctggctgggcgcagtggctcacgcttgtaatcccagcactttgggaggctgaggcataaggatcacttgagcccaggagttcaagaccaggctgggcaacatagcaagaccctgtctctacaaaaactagtaataataataaaattagcccagtgtgctggaatgcacctgtgctcccagctactcacgaggctgaggcgggaggctcgcttgagcccaagaattccaggcttcagtgagctgagatcttgccactgcactgcagcctggcaacagagtgagacactgtctctcaaaaagaaaaaagtaaaagacttcaaggcttgtggtggggctcagtagctaggggctggtatcacctggagatgtcttaaccccacgtctgggggattctagctgttgctggggctttacctgggactggcagccagaacacctacatgtaccctttccacgtggcctgggcttgctcctagcatggtagacaggaattaggagctgctgatttttttaggcctgggcctgaaaagtagcaccacatcacttgtattgtatgctatcaatcaagcagtaacagagcccagatttaagaggaggggttattttgactggaggcatgtcaaagaatttggggaccacgttttaaaactaccacaagtgccattggcatggtttcctggaatcggatttgcctccctcttggctttgtctaatgcctggctctgctttatacagcagcccagtctttactggactagggcactggggatgttcctgtcagggatcagtaacctcagagggggcttctgcagtgtcagtattctctctgtgttcacttgccactgctccttagagagttcatcattccctcccggagaagagctcagcggtccacttggtgcttccttagaaatcagcttgggggcagacaggtgtggcttccatagattcttagatgtgctttctggaattgaaaaggcaactcaatttatgctgtgactctcactacctttcacgtaactctgacaagctgtagggacctggaaaatctctatagatggtggcctagatatagccccagttgggggctgaggctgccctggaccctgttgagggctcacaactgtttgagatgcttgctttgggagcaagaaagccaagttgtgagtatcaccctgtcctttggctttttctcaggacttttctggaatgggatgtctatgtcttgttactgggcaagtttctgctctaggctggggaacaaactcttggacttgctgactgaggcactcttcctcctttttctcctccacgctcaagagtatggctttagggtagcgcagtgagaatgccatccccagaattggggcagtcactgagtggcaggaggatggtgatgccaccaagccaacagggcccttagtagagaagcccgagaatgctgaatggccggccaccttccaggcagtttcatttgaagcaggctagacattgcttagtagggatggaagcattttggacactgagccctgtataaccttcacctgcagacaggctcacttcatggcactcataacactcatggcactcatggtacctctcaggctgtttccaggactactaggactttttcccaactagctccagcttagtcccttcttgttactaacacttgtagtagccctataaccagaaaaagcagagcaacttggagcatgccaagttcatcaaggactaaagacagccttccctccagaaaagttcctcggggcacctgacaatatatgaggcattccttagcacaaatgcttcttgtgttactgaagaggggcctgtgttactgaagaggggcctgtgtcactagcccagggattggggcgtgttcctgtgagacagtgccagagggaatatttattatgcactttaactctcactttctgtctatgtgcatgcgcacacatacacatgatgctttttcttttcttgtttcttttttttttttttttaatttttgagacaggatctcactttgttgcccaggctagagtgccatggtgtaaccatggctcactgtagccttgacctcctgggctcaaggatcctcctgcctcagcctcttgagtagctgggaccacgggggcatgccatcacacccagctaatttttaaattttttttttgtagagatagagttttaccatgttgcctaggctggtctccaactcctgggctcaagtgatcttcccaccttggcctctcaaattgttggaattagaggcatgagccaccatgtctggcccacaatactttttctttaaatttatttctctttccataccttagctcatattctttccatcctaattatgtgtcttacatatttgtgtgtgtgtgtgcatttatggtgctctgtttcttttaaatgtcctttgcattctcccctgctttcttttatctgttcatcttacttcatctctccttaaaatgttggttttggccagttgcatgctgcagtgttggcatccatgcctgtgttgagcagcagaactggctgcctgctgacaaggccacggcacaagtgcccagttctacagtgtctgcctcccaggggcatactctgggattgtagaataacagagagatgataagagcagtcttgggtgtctgatggctgctttgtatttacttttaaaaattatttattttacctttatggaatgatttatagtgttcaaacactgttagagatttgcgtcatcttagccacacagctggtgtgtgaggacactcagagtaagtgttgtctgtgtttaaagaacctgaggcacagagaacttagagggcttgcccatgagcacacccagaaagtgatgggaccaggacccagccagtgtgtagctttcgtgcctagtgggagagggcttcgggggctgacggcgatactgggctgcaccgagtgcttcgtgtacctttctctgttgttcttcagctcatacaccacaaagagaaaggcgaggaagtctgcagacaatgttgtgagcaggcatacaagaggcctaggtttttaactatttacattttcattcatttagtcattcaacacaaataataattccttttaagttctaggcactttgcagggggctatcaagattaacaagatactgttaccaccttcaggtgggctcactcatagtctagtaagggagaggaaacagtctggtgcaatgcagtgttatacatgccatcacagatgtctccccagtggaggcctctgcataggccatctctacctgaaagggggtagggtgtgaaagagctaagagttggatgtgcctaagggtgggatacaggattgataaggagggaaaacaatgtgggataatgaaggggaaagtaggcagggaccagctcatggggtcctcatcaacaatgccagtgaatttgcattttattctgtagatatgaggagtttcaagcatgatcagtttttcattttgggaaaatgtcagaagatgagaggatggatcaaaactgctttaacactgaaggcagaaagaggagttaagagaccaaagaagtagcagtagcagcagggatggggaggagggggacacatctgagagatgttaggaagtagaattgataggacatagtcatcaagtagatcaatgtgtttggggagagggctggatccagatgcttgaagcaggaggggaacaaactctgaccttttctcccccctctggaatgagtttctctagagcgttaagtgtagctagagaagtccaagcgctgggacgttccagtgttttgaggtctggacgaggaagaagaactagccaaggaaaccgactgagaagagcatttagtgagaaaagaagaaaaccatgaagagtgatgtcctgagacgctcaagaaacagggagtgatcaactgaagcgtaaagcagcatagggacgagactgtgagagcagacgtccagtgcaggcacatgggaaagtgggtgctagtataaggccagcccttttagacgggcgttgggtccccacctcttcgttgcctactcaagcgtgttattcctgcatttgtgccctctgtatctgcactgacaacctttccctctctactggatcattccaattacagtcacaaggttggcatggtggttcatgcctgcaatcccagcactttgggaggccaaggcaggaggatcactggaggccaggacttcaagacctatctgggcaacatagtgagacccccatctgtgaaaaaaaaaaaaaaattagctggacctggtggcatgaacctgtagtcccagctattcatgaggctaaggtgggaagatggcttgagcccaggatttttgggttacagtgagctatgtactccagcctgagcgacagagcaagaccctgtgagagagaggaaggagaggaagaagaggaaggagaggaagagaagaaagaatgaaagaaagaaaagaaaggagggagggaggaaggaaggagagagagagaaagagaaagaaagaaaaagagagagaaagatgcttccattatgccatattcttctccagctaccatcccatttctttgttccttttttaggaaaactctaaaagagttgtctgtactctgtctccactgcttctcctcccttttcttgaatttttccagtcgtgcttcccttcctacctctctaccaaaacctctcttcgtcaggtcacagtgacctccatgtttcaaatcatttctcagtccttctcttacttagttgttggcaggtttgactcagttgatcactccctgtttcttaagtgtctcaggacattgctcttcatgttttcttcttttctcactaaatcctcttctcaatcggtctccttggctagttcttcttccttgtccagaccccaacacactggaacgtcccagcacttggacttctctagctacacttacgctctagaggatcttatttggccacatggttttaaatatttctatataccactaatgactcccatattgaaatttataacccagactctattctaccagtgctcaggccaaatatcctgatgctgtcctagacttcccgtttgtgtctcactgctcatctaacccatcagcaaattgcattggcccagccctcaaagtagatccgtctctaccagtacccttctgatccgagtcatcataataatcgtttgtctggattgctgcagtggcattctaaatagtctccttgttgccacctttgtacccctgcctgtcatcctctgatgtgaagtcagattctgtcactgtcctgctcacatccactcaagagcttccttctcttgagagtgtaagcccaagtcttatcagtggcccatggggccttccataatgtggcttctggtgtctctcaggctcatctccagcccacacttcattgtttccctccactctggccacactggcctccttgttgcccctggaatacagtaggcatgcggttatctttgccctactgcactttctgtctggaacattcctcccctggatagacacattgctcacttcctttgggttgtgttcatgtgtcccctggcaagaggggcttccctgacctccctatgtaaaacagcaactcatctctactgctcatctctgatccctttccccttctttattcttctttattggcccccaaaccgtctcacagagttgatatgttacctgctcactctaaacaaataaggcaacttgatgtgtgtctaccagaatgtaacctatagaaaaagagactttgtctgtttttagtctctgctgatccttttttttttcttttgagacaaggtctcactctggtctcactctgttgcccaggctggagtgcagtggtatgattgtggcttgctgcagccttgacctcccaggctctagcagtcctcccacctcagcctaaaatagtgcctggaatagacttggtgctcaatatatctggttgaatggatggagagccaaaatgtatctccggcctggtggggttgcacactgtggtcttggtgataggtggcttccttcgttcagatgcagagaaggctagcaaggagctggcctaggaaccatgaagaagtgaagctagagactgtcagtggctttgctcccatggtggcatccgaaggcaggccctgcccttctcttggccgtggtctcctcttgtccaacaggggagaatgatcttactttccctccgagtctcagtttgaggaactaggaaacaactagacagagaggaactgaagcccaggaatgagcactctctcccatccatgccaggggatgacacctgctgtgcaaactctttgtcacgaggatctagacatcctgacacctggctcccattgtgtccctcctgaagcctccctagtgttccctctctaggtgagactctcctgaccctccttcagcctgggagcaaagactggtggaagctgattcttagggtggctgaactagctccacttccagggggtgcccccataagagcatcagagcctgtagtagtgagagagagatccaatccagacatcatggaagctaagctggcctgtggggaagtggggaaggaaggccagggcagtggctctgcattgggatgggatgggccaatgatacgcaggcgtggcctttcccacctgcatctttttactgctgccgtggagcaaatcaccccaaaacttagtggcttaacacagttgattgtttctcacatttctgtgggttttctggtggttctctgctggtttcccctgggcgcactcatgtagctgtgtccggctgggtctgggtccaaggtggcctcattcatgagtcaggcagttgtaggctggctattgacagaggtgcctcggtcacattccatgggacctctcgtcctctaaaagactagactggcttccttatgtgacggtgtcagggcagcattccaggtgggtaaagggagaaactacaaggcctcttgaggcctcaagtttagaatttgaacaatttcaatttccactgccacattgtattatactcaaagcaaatcaccgagatcaaccaagattcgagtgacggagcaatagactccacctttccatagcctgagctgctgagaattcatggtcatatttgatttactccccgccctcccgcccccctgccccgacagcgttcaggatccattgacagtggcaaactgaccaaatttcccaggtgattactctgaagagccagccccttgtgaatatgagtaattatcaagctaagatggaacactgtgtgttaggccccaagctcaatgcgcgacaggtactatttctcacagggattctctgagatatgtgatctttcttttttttttttttttttttgagactcttgttttcactcttgctgcccaggccggagtgcaatggcgtgatctcggctcactgcaacctccgcctcctgggttcaagtgattctcctgcctcagcctcccgagtcactgcaattacagttgcctgccaccacgcccagctaatttttgttatttttagtagagactgggtttcgccatgttggccaggctggtcttgaactcctgacctcaggtcatccatctgtctcagcctcccaaagtgccgggattacaggcgtgagccactgcacctggccgagatacgtgatcttccaacacccattttagagttaaggaaactgaggcttagggagagaagattacttgctcaaagtcatgaagcttataagtggctacactgaaacttgaaccccaaggctgtgatgttcttaccctctcttgagactgactggctagccataacctgataaaaaaaaaaaacagtactaatgataatgagcattttgcatccatggtctcattggctcaatatgacaaccctgcgatgtaaaatggaacagttttgaagaaatgaaactggatgttcagagtgtgagtccattgctaataagaggtagaatcagaaacatgcagacagataacagagaattctaccctcaagtgagaatgtcaccccaggagggcagggccttatctttattgtttaccagaccttggaatgagtgactggtgccttctctgtgatatggggcttcaggtcagcacaggcaggttcctctgtggtacagtgcactgggcctggcctgtgtggggaggctggggcaagggtagcacgtgaagccgtgggtcccaggtcagcagtgacaccaaagacaggaccttcagaggaaagggccagtctactctctattttatgctgcatgagaggggagaaatgaaacctcagttgaagcagggtaggcattgagagaaagttcttaacctgtgaggatttattcgtgctggagccactaagggaagttatagaatcactctttctgaaagcatgctgggatcagatggaccagaggacctgaatcattttcctatcccaaggagccatgccccacactaccataagtaacagtggttccatggactggtgaattctctcctgggccgctggggagacacagccctagggaaccacatatcaaagtgcctgagcaggtgaggcatgtatagtttaaaaaggcttcccaagagattgtgagtctcattaggtgcctgccatctcccagtagaatataagcttcacgaggacatgaatttatgtctgtgttgtttattcttgtatctagcacctagaacaggcctagcacagagtaggtgctcactaagtatttgtcgaatgaataaacaaatgaaattgtcctctgtcaaatgcatcttcagttgagaactaaaacagagtcctttgtgtagcacagacactcattcacttaggggctagactgatgaccttttgtatttatggttctataaaataagagagacctaaggcctccatgaactgtgaggaagttgggatctccccccgcctcaagcctggcgacttgccctgccgctccctaccccagggagtgcggaggcttactctgttcacacctcctcactgagcagagcctctttggtcattggcttggcttggcactgaatttctctcatctgtgcccatatacacatgggatggctcttgtttgacttgccctttgaaaaacaacttaagcatgttgaggtttcctgttgattgggggcagccagaggcctgtgacccagcagggaattgtcagccaatccctgactcacccaaactccagttttctgtgtgtgagcgagcagtgacagcagcctggctcaggggcagctggctgccttcctgtggatagcatggcattccggagcctgagaggctgggcagcccagagctgagggccacggccttagggtcaggtaggccttgtgctgtgcagtgttggcaaatcctgctgtttttgaactgaaactgtttggaaagaattctgaaagttgacagtggttactctagtagacaagtagaaaagtgtgcccaagaggaagtatgctcatggtgctcttcaataagctcacctttcccttccttttgctcttcatcattcaccgagcaccttccagacactatttgtttgtccctgggcctagaagaaaccatggtctagtagggaagaccaagaagtcccttgatacttacaagtgctgtggcaggggtgtgctgagtgctgtggggatttctcttgagttgcctcagggccctggcagttcagaaagtggcagaggcactgcttcctcttcagagagtcagcccagtgtagtggaagttcacgtcctggtttcacttaccagctgagtgacctcggatgagatattaaacctttctgtgccttagtgttttttatttgtaaaatgaagataataaacatgataacctcatagacttttcaggaagattaaatgagttaacatatgtaaaaacatttattcagaagtgttccttgtagttgccaagatctgcatatggatttggagctgggacatggtagatgccaattattggatgtgatgccactgctggagggtggagctgcctaaggagttggcctccccaccccattggcttcctcaatgatagagtggaaaagactctttcctgaggggcgcttctgacctgtctgaggccctcagggattctaattctggtcagaacccaacatgaagaagtgagatgttatgtctagtagcagaagtcccaggggagacagaggcttgttaaagggaaagatcaaagggtctgagtgtatttgggggccacttcagggagtagtgttcaagaaccaccttgcaccagttcacaagagctgattagtggcatctcttctcaactccacagccagtgacgtcacattggtagctcagccatagttggaatatttatactaccaaagttggcaagtgctaccaatctgctgttgcccctagagagccggttgttcagacttgtttggttttggggtttttggtccctttttccctctttttaccatacacagagtctcactatgttgcccaggctggtcttgaactgctgggctcaagcgatcctcttgcctctgcctctctaagtgctgggattacaggcatgagccaccacaccttctgagaactggttgttaagcatgtggcagcacaccactgggctttctgtcctcttactggcagatgttagactcttgggatgctctcgcttggcacagaacaggtgtctgtttcagacattactcagggtgcctggggatggtttgggcagagaggcctgttgagtttggcctgctgtgattaaggagctattgctctccttgaagacagccttcaaggtatattacttgaatagaatactctttgagagtcctccaggaaaaagatgctgagttctgtaagaataaaacaggatgccactggttggtcagccactcactgccattttcttttcttttcctttgttttgttttgcccccaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatgtagcaggggtcgctgcctgcctcccccttgcccagagcacgccattcccggggccagcagctggcccccggggcgtcttgctgacccgtaccggtacccgcgcccacagcctgggcatccgggagaagatatcagcatgggaaggtcgccgagaggcgtcgcccaggatgagcatgtgtggagagaagcgggagggctctgggagcgagtgggcggccagtgagggctgccccagcctgggctgtcccagcgtggtgccgtccccctgcagctctgaaaagacctttgatttcaagggcctccggaggatgagcaggaccttctccgagtgttcctacccagagactgaggaggagggagaggcgctccctgtccgggactctttctaccggctggagaaacggctgggccggagtgagcccagcgccttcctcagggggcatggcagcaggaaggagagctcagcagtgctgagccggatccagaaaattgaacaggtcctgaaggagcagccgggccgggggctcccccagctccccagcagctgctacagcgtggaccgggggaaaaggaagactggaaccttgggctccttggaggagccggcagggggcgcgagtgtgagcgctggcagccgggcagtcggagtggctggtgttgcgggggaggcgggcccacccccagagagggaaggcagtggttccactaagcccgggacccctggaaatagccctagctcccagcggctgccatcgaagagttccctcgatcccgctgtgaaccctgtccccaaacccaagcgcacctttgaatacgaggctgacaagaaccccaagagtaagcccagtaatggtctacctccttcacccacacctgctgctccacctcccttgccctccaccccagccccgccagtcacccggagacccaagaaggacatgcgtggtcaccgcaagtcccagagcaggtaatgcatgcccctccggtgtgttgtagctgaataccgtggctttcttttaaatggacagtgcaaacacagattgtaggatgggtcgcagtcattagtgcttcgtaagctctgaagtgctgaataattgttaggtggtagttgtggtagtgaaaaatgagattgttctgctcttacaagatacttggacatgagtgggaatgcttacaggatacttgggacctgagtgctggtcactgaaggtattggctgggtttggcctttggggtagagctgggctgtgtcctgcccctgttgtagcttcctcagtcttctgttgggagtaggtaaagcaggcagtcctttgcggagtagtaggatcttagcctccctaccacctgaagtaccagcattagaaattaatttctttgaatgaagcattatctgaatactgcattttatcattaacatggtagtgtcggcaaatttaacacaattccttctctcctgaaggcctcctggccatatacgaaccctgggcctatatcaagaggggattattgggaagattgatgaaaaaaggagtaaaacaggaatgagcctgttccgaggctcacgttggtttcctggtcagtctcaggatttctaaccccagattaccaagggctgtctccccggtaacttggagctggagctattggaattggtgaaagctggcaggcgtcttgttctctgaatcagggtaggctgggagtgagcttccttgggaatacttatcctcctacaccttactgccattctcatctaaccccacgactgatgggtattcaggtttgtttcacttctggggattctttagtttgtccccacacttcaggcttcatctaacatatcccatctcatatataaactttcctgccatgtgcagaaaggaagaaatttcaaagattcagacccccgagccggaacagcccgtggctaagggtaatcccgtgtttgagtccaccccagaatgctcactggctctttaattcttaaacggcctgccaagagtgtttgctttgtccttgttcatccatttctataaacattcttctagagcctgctgtgcaccaagattgtgctggtcaagaggatgcagaggcaaataggacatggttcttccattcaaggacttcgtggtctggtgcacagataaatcatagataatgtcatacgtgccatgactcatggcagtgcaggaggccgcagagacccagagaaggggcatctgagttagatgggggagagaagggaggctcctcatagagggagttgctgagctaaatttagaagagccaaaagcagttggctaggtgaccaaagggagtgggggggagagttcatcagcctgaaggttttacacatattccaccccacactgcatttatatataatatatacacacgtataccatatatggaggagtcccttcatgtaagaattaacttagcaaacttaaatctgtgctcttggaaaaagagaaacagttccagaagtgcagtctgttctgtatgccatttcacacagtgaacatgttccatgaggagtagagatggtaagtttgtgtctgttataccaagtgtgattcttatatttaatatacttttttattttaaaaaaaatgcagtccaggtgaggtggcttacacctgtaattccagcactttgggaggctaaagtgggaggatcatttaagaccaggagttcgagacagcctgggcaacataatgagacctcatctctacaaaaaatttaaaaaattagctggagtgttggcatgtgcctgcagtctcagctacttgggaggctgaggagggaggatagcttgagcccaggaggttgagggtacagcgagtatgatcacaccactgcactctagcctgggcaacagcacaagaccttgtctctcaaaaaaatttgcgtgtgtgtgtgtgtgtgtgtgtgtgtgtgtgtgtgtgtgtgtgtttgtgtaaaatgcaagccaagccaaatgtttcttctggcattcagccaaaaaaaaaaaaaaaaacctggggagaaactattagttttaatgagagacagcatgttggtcctcagtgtgacaccttcctgggggattttcaaggataatttgactgaacatgatttgtgtcttatttactgacttgagggctacctgcatacgatgctgagtctactgtatatgccaaagaaaacttgctctcacactaactctggtcctgggccaacatttgcgaaccactgtgctcagccattggatgtttaactagttgagaatctctgggccaaagacagaaatctgggagtcatcaagatagagatggtagatatggcaatggcccatggatatttggtccctagaaagtgcagagtgagaaagagtttttaagacagaactctgagagacccggacacttaaaaggcaaatggaaaaggagaacccctcacaagagtctgaaaagtagtggccagagagttagttgaaagccaggagggaatgtgtcacagaggcacacggaggagatgtcaatataaagagtgttcggttgtgttgagtgcttggggcggggcaggggcaggcaagctaagaacaagctgtagccttcaggacacttttagccctttacctacaccctaggactctcaggagaagctgttagtaaacaagagaaaaagggctttattggctgaaaggtctgatggtgccccaaagaagagggaggtgttcatgggtgggaggagggatccagtcagtgcctttccttctttccctccccaggagcctgcggggacttgccttggagagggagagggtacagttggggtctcagatgagggacgtacctctctcatgaaggagaggggcagagagtgctgtaggctcagggtgtcttaggagacaacaagctgtggtcttgaaattatacagtagagaggaaggttgtccaaaggatggaaaggagcaagctagctgaagggaagcctggtcttggaagcagcttctggctgcaaattgtcctcccagctccaccttggcagtggtcttatttgttttaagggctcagcccttcctgcttcaacaaaccacccagcaacaactgcttttccaaccccctgacagccctgagtgggaccctcccagtgttgagccttcctacctgcttagtgcagtggcaggagtccccagctaggatgcagatgaggatgtgagactccagaggcagaccaggcactcaattccagtggaatcacagacacttctcaaggaggatattctctagggctcaaggccaaaattatagttaagagctcaggccctggagtgagacgtcgcctgggagaatcatgcctctgtcacttccatctcctctttcacaagatgtcccaatactggtggcactgttgtgaagattaatgagataacacatgtaaaggtggatttgacgcagcacctggaacagcatgcttttaagctggggtagttgttatctaatagcggtattattcaggataaggcacattgcaggcacccaggctggggcctttcagaccatctgtctcttcatttggatggtaagtttggacccaccttgatgctctttcagaagctgcctttgtaaggagggcctatggtctttgctgttgccatggacattccccagcaaggcagcagagatctgattcagcaggaatgactcttgctcttgttatccacagaaaatcctttgagtttgaggatgcatccagtctccagtccctgtacccctcttctcccactgagaatggtactgagaaccaacccaagtttggatccaaaagcactttagaagaaaatgcctatgaagatattgtgggtaagcaatggcagaggtggcacctgggtcatctcagggggctgcagaagaacaggaacaggaggagacacctagattgacctccttcactgtgggcaggcatggtcccaccttctggaactcctcctggaatgggacatcaggggaagcaccttagcttagacagagtggctttgtgattaaaagcctggctcttgaatgaactgaaatccaaaggacctttggggacacgagaaggagaaaacaacatcattcctttcctttatttttggaaggctttgaagtccaacaggccctcttccttagctgtgtgcccttaaggcaaatcacttaacttttgtgaagactctgtttttctcttataacatgatgatgtgactatattaacaacaacaataatagtaataatatttcgagccgggcatggtggctcgtgcctgtaattccagcactttgggaggccgaggctggtggatcacctaaggtcaggagttcgagaccagcctccatctctactaaaaatacaaaaaattagctgagcatggtggcaggcacctgtaatcccagctactagggaggctgaggcaggagaattgcttgaacccgggaggcagaggttgcagtgagctgagatcgtgccattgcactcctgcctgggcaacatgagtgaaactccgtctcaaaaaaaaaaaaaaaagtaatatttcataaggttattgttagaattaaataagattgagtgtctggtgcaggcctgctacctggtcagagatggccatcttctttctgtgttcttacatggtggaaggggcggagggagttctctggggtctcttttaaaagggccctaattggtgaaggccctgcactcatgacctaatcacctcccagaggcctcacctgtgtttccacataggaattttgggggacagaaacattcagtctattgtacaagctaacacatttcattgccccagtttcatggtgctggcagaagacacgagacccctgggtcgcaaaggactttattacttatggcacagtaggcagcatgagcttcgtgttcacacgggtttccccttgtgcctaagtcccatggggcggtgtggagaaggcccaggtggaagctgcacacactgcaggtccatgtcccagctggggagcccaagcgtaggaaaccccagtcttttcagagactgctggcaaacctgcctaacctttgtccttggaggagacattatctttatcactctggtcaggaaacaaatctgcctctgccctgaagggagacactatctctgtcttccaaggctgtttgctgtataaataccctttaaaatacagtctggaactgtcagttcctcttgttcagaagaagggcagaaatgcgagactccattgggatttgtcttccaacaggtgggaagacatggtattggcaaacttgtgttcacagatcagatgaaagatagaatgctctagcctgggttgcatttgttttgttttttggcgttcatttcaattctattagcatcctcatcagtaaggggctttgattctgcccaagtgaagtgtgcgtgtcagtgtaggtcagtgaggaggagagaggctgtgtgctgcctgcttgctggctccctctctatgtccctgtcttgcctctgtcttgggccttgaatctgaagaatgtggtgttagttaatacatgagagagagaagtggcccagggtagagggaaacctccagattatcagaagcctggaatcttttttttttttttgagacggagtctcgctctgtcacccaggctggagtgcagtggtgcgatctcggctcactgcaagctccgcatcccgggttcatgccattcttctgcctcagccttcccagcagctgggactacaggtgcccgccaccacacctggctaatttttttgtatttttagtagagacagggtttcaccgtgttagccaggatggtctcgatctcctggcttcatgatccgcctgcctcggtctcccaaagttctgggattataggcgtgagccagaagcctggaatcttatgaagagagggccatctgttccctcatttgatctgagccattggtttcacagccgtttccttaccacttgctgggccattgtttctggggagacagcagccatgctgggatgtgcagggacactgctttcccaggaacagagcgtatagtatgtagccatgcaaaactgggtcacagcaggaagactgtgggaatgaggtccctagaaccgcaaaagagtttggggagggaggccctttcccttaccactggggaaaagacagctttgtacctataggccacccagagcagaggtcaagagctaggggcatcagaacaaaagatccagaagccaggtgggcagttaaggaagatgccccaactgcagcccataccccagttctactcagccacccaagaggcagccagtgctgttcctgtatttctcacctccttatgcaagactaacatcccagagtggaagaaagtcctcccgaatgagtgagtaggcagaggcctagacacacttgccctcctctttcccttctctcaaacctgacctaagaaggcctggggaacagctgtgttgcccagaacagttcttccaaaattctgccccccaaacattgccccaaaaaatcctgaacagagccctggatggtggaactctggacagagagaaatggttgaagccgtccctttctcaaattatttcagttcagatgatccaagaacgtatccccacaggaaatccttgtcagataatagagaatgggaggaccacaggattgccagcacccagcatagtcaagggacatcagaaaaacacagccctctctgcccacggcagcagccacactgggtgctcccagggtcctgggcagcaaactgacacattgcagtttctgccaaactagaatgtaccctgcaacaggaggtagggagggggtggggcaacagagctgcctccccactcattagggaggactctcttccactctgggtgttgcatgaggagttaaaaaaaatatgggagcaccttggctgcctcttgggtggctgagtacagctaggggtcagcgctgtgtgggcagaaggtagaggtagctgctcacctggcttctggatctttggagcacttagagaacagggaaagaagagagggggaggatgcaggagaaagggaggggagcgacccaggcaccagtttgggaatatactgcatcggatgtttaggttttgctttggcctcgtggggtggtgggggtggtttccggagtctgcagttaggacagtgccctgtgcgtgttttccctttttatgtccccatagcagcccaatctgaatttctgggacctgactagggaggccagagggaaatacagaggaaaatactctctttctgttagattctggtgggtttccttttccttccctggggacaggcccgagagtttggagctccccacaaggcttcagggggtgtcttattgctgaactcagaatggcagtttcccgtcttgcttaggactgatcagtggctcggacttcctgggagccgtctctctggtcttggcccagcctgtgctctgtggggtgaaggatgactctgaccccgctggatcaggctcctgcaggcatgcaggaatggagctgttgggaggcagagagcctagtgctcatctccatcttgggtcctggtgattggactggagtcctgtctgtcataggtggagggccagttggccccaagacaaacatgtctgtctgtgaacagtggactcgaatgggggttgtggagggtttgctggcctcctgcctacactaggcatgatgcctgaggagctggggtggggtactcccaaacatactgaggtttaccttgctaacttgcagaaaaggagttcggaaagaaagttactgccttgctgcttccagggctgctatttcccgcctgtcccatctcacatctgcccctggaagatgctgctattctaccaggccttatgtttgcattctgagcctgacacttaaaaatgcacccaaggaagcagcttgttaaggaattatgtggagtggcctcggcgcctgagctgcattcctgcagattcccactcccatcagctagcctgggctgagggagcgtttccaggaacttcagtgggatgcaagccggggaccgggccagtcagcctggactgcaaagtcttttgagcctccactctctctggttgcttcccttatttgcccccaggctgggaaacagtaaggagcagagggcacccactgggatggaggttgcagtgggaaacaaaacagccaagaggtgcagcccagggaaggtgccggggctgtcgagaaatggtgtcaaggcttggagggtgggcaacagccagccccttagaggccccagtctgatctgttgccagggagttgggctcttatcctggccctttctgtcctgtgtgagagagggaaaaaggctgagaaccaggagaaacagctggttggaaccggacggaggttgttggggagggaagctgcagacccaggaccctagtaatgggtgtggtccaggaagcttaggactgtgtttggagaaattctcagtgcctgtgcgtatacacacacccctttcctaactggtttttccagttaggttggggctgggggagtgctgtatgtgtggttaagaccaaaggagttatggggaggagtgaaaggttgtggagaggagtgggaggttgtagggaggagtgggaggttgtggggaggagtgggagcagggcccagaggggctggattcttcctttaagaggatttgtgtgacacctttgggctctgataatccccttttagaagagtgcaaagcagaaattctcggtgatgccttttgtcccttatttcatcatccaagctgggaaaggttgagacctctggcttctccagctgggcttgctgagggccaggccttcagggaagagggtccacctcttcgtccctctccaagggtcatgtggactgtcccaagaaagctgtgtgggcaggaatgcaggtagaaatttgcagtctgccaggctccctgtctcccattcatgcccctgctgaatctcccattcagccttagctcctttagctctgtcctccctaggatgttctgcacaccatttcccagcctaccgtctcctccaactctgagccattcctttgatacttatttgctctcagctggttcagtttagtggtccaggactcagggtccacttgtctctgtacatctccatcccctggtcccctgtccacctggagagatgactgggagaatctatttgagacagctcctccggggcagtcaggaatggtccaggaagctgagagatgagttagggcagtgaagggaccaagctgaggctggggaggcagcgtgtgggctgcagccagccgtctatttgctggagaactgattagtggctttgttacattagacaggatgttaaacattgctggagaagagaggctggcacaaggggctggggaggagcaggccttcctgaaattgagtttccagagacaggacctatcttgagaacctgatgttgctggctgttttcccctgggttgtcagtgatgtgcaccaggcttgtacatctattacttccctgggcctcagtatcctatgtctttttcttggagctttggattttgtatcaatattcaaagctcttactgtagggaaaagaaggaaggaaggagggagtgaggtgaaggagggaaggatggaaaaaaaagagggctagtcttgggactcatgtcacactcagaagccattggaagtttagaaagctctatctaaagcagtggttctcagttgggggacaacttcactcttccctccctccattcctgcctccctccctctctctccctccttccctctgtccgtcccagagagcatctggcagtgtctggagacatttttggctgttatagctaaggagatgctaatgtctcctggtggatagaagccaaggttgccactaaacatcctaaaaatggacaggacagtctaccacaacaagaattattcaaccccaaatgtcagtggcttggagaaacccctgggattgggacaaggcttcctataggttggggatgacaataaaggccctggctgatcatgcagtccaaggcagtttcgatttgttgagcttggcataaatgttctccctgccgtgatgtggacagtgatgctctggtcctgttttaggggatcagaagactgtgtcctggcattctcccttcttagttcccccacctcctcactcctgcagggcatatgttggggaaggatcaagaagtagagaatccatccccaacacctccctaagtgccccacagtggggtaggctggagaaaacatgcagggggtgccgggtttgctatttggcttcttgcgacagggctgctgggccagctccgcttagtcagggctctggaatggagacaagtcattttaatagcatgactgtgttacaggaaaaggtctgttccattgctggggactctgcttggagttgggaatcacttaatccagtcccaaatcccagtgacccatctttgactcataagtttacagagatttatattgctcccactgcagtctatttagctgtcactgaaatccctccttcacacccacaccctaactctgttagagcatttcctaaattcgttgtggttctgcataagtagatgccacaatgtggagggagctccactttggaaatggaggaatctgcaagcatatagggattggctcttctcccgtgtcctctctaggaaagcttcactctcagcagcctttgttcctcgtcctccagctccttcttctgcctgcttcctgaggagtggggtctgagttcctctggggcgtaaggcacattcagacatctgtagaacaagtgtgggactcagtggcacccaggctcaatcctgctgctgagcagaggtgctggagtgagtcctgctctgcagcaggaaaatagggaaaggggtgcagagagggctgtgttctgagttccccagggacctgttcaccccacggattctgccaccaggattgagctaggactgacccggcccatggtgttactctattttagaaaatgtgtgtgttggaggggtgggggcaggagatacagcttgtggaaaggagtgccactcaacatcttcaagggcagggattctgttttggacttttctgagattttctggtaatgccaatacaatgcccgctgccagagattttagaactagtcctgagaagcaagaactcccctcacccccaccctttggcccagactccttccaagcctttcacacctcccctgtgtcacagcaggagagtttgttccaaaaggggagtgttgatggttctctttttgctgagatcagcggtagagggaatagacactacagtaggagagtcatcgaacagatcattactgaacacttcctccttgctaatcactgttccgttccgaggttgcctcagtgaacaacacaaaaccctgccctaaaagacttgttgaacggcatcgtaggtgagaagggggcctggcgaagccctgctccctacggttctgtgagttcctccatgcccaccctccaaagtaggtccccagggagatcccctgagagttgggtgaagggacagccatgtgacctgaaaacccttcctaccttgaactgtgttatctctggggtgtttgcagcagagggaagggagccaaggaaagactcttgttgctggctttgtcctctggctgggcacaggcaggggtggctgagccagtcttgtgcaatccctgaatttataaagcagaggccaggctgagctgggctgggggtggggggttggggggggtgggggggtgggtctgcttctggacttggagccaggatctgtttgtagcctccccactgcagacgggcagctgcatgactcatgagctgaggggccaggcagaagccattctctttggttcacaggaattctgcttgtttatttgtgtgtgtgtgagttcgtgtgtttccttcttcccttctcccccttctctaactcttcctcctctgcaggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacaggtaactcagccctgacatcggcctgtagggttagcgtgagggccacagtgggggcctgctcttccaagacttgggcccagcttccactcaggcttttaccctcactagtacttgataaagggtctacggccataccaccctgaacgtgcccgatctcgtctgataaaggaggtctcctcagcaaaggactgtgcactcaaggatgtccaccatgttgaaacctctgtggacaattggcacctgctctgaggggcatcctgtcctatcttctttcccttcctacacaagctctgagctgcaaaactcagccaggagcccttgcagtctcctctctgattatttatcaccctgtgggaaacaggaagacagggccctagtgggagtcttggcattctgcaactctgccagaagtcatctcagtactggcattagggggctaggtgtaggtccccaaaccacatttggagagccagacaggtgtctgtgacacctggagccagtcctgtgggagagagtaagcatgaatctttaaggaatggatggggagaaggcagaatgacaggaaaggtgaaaagccaaaggaagctcttggacttcagctccttctgtccttgtccaggatgtcaggaggcaggtggagaggcttctctgacctccccaggtaactctaattctctttgcaaatggaaggacctggatattatatagcattggccagataatataaaatgataatataaaaatgatttcttctgcctttggaataaggtgtttgtttttataaaagatttaccccatagctgggagtggtggctcacgcatgtaatcctagcactttgggaggccaaggtgggcagatcatctgaggtcaggagttcaagaccagcctggccagtgaaacctcatctctactaaaaatacaaacattagctgggcatgatggcgcacgcctgtagtcccagctgcttgggaggctgaggcaggataattgcttgaactcggaagacggaggttgcagtaagccaagatcgctccactgcactcctacctgggcgacacagcgagactccgtctcaaaaaaaaaaaaaaagatttaccctctaattaggactcttttcaaacaggcttcccctgagtttgcattgccagattgattgggtgagaacaggaaattgggggctgtggaggaaggaggatttgctgaggagtgaggagaggcaattccagaaccagacagtggttgggtgtctgtgggatacttgcctcctgacagggtccgcgacaaggatggtgccctgggatgagaggtcagcgcatatggagagaggcagagagtagatcagggctggggagagggcagccagggccttgtgggtatgggatccaattcagtgtgaggcctgcctggcccagctttggtggtcagagcccagagcccctgtgttctccatgggagcagttaggagggccaggctgcaggatctcccagcccagcaggctggccagtaggttatggcctctgctgtcagaaaccttttaggattggctcgggagcagaggtccggaagactggttccatcacccaggcccagtaattcttgtcccatagctcaggaggacccccgcaaaattcccacttagtcttctttttccactcagatgagagcacaggtgtttttagcctctgctttcgttttttgctggcagtagtgaagcttcctttagggaaggcaagtatctaatctatccctgacctggctgattagcagctaaagtcttaagagagggatggaagttccagggcaagatggcggggatccagggatgccggcccttggcctctgtgtccccatcccagcagacagacactggccaaggcctctgtggcaagcccctctcgcacgtcctctcccccacgccagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaaggtaccctccccagaggcagcccactggagccgggcaggtgggcgggcaggcagccagcctttctctctctttcctggcttccttccttccctaatctggactgcttcctcgattccctttgaataaattctgggtccgtgcactggcctctttttcatctgattaattcccctttcttatcaataaagatgcattaactgaccttggtgctcagatgttagaggaaggaaagtctagccgaggttccccattagtaagtgtggtgtatgaattttggggtatccgcacacataagcatttccaggctttcaaggacctaggactcaaacaagggttcttcctataactctcagcattgaagaattttcagcaatgattttcacacataggcagccaggcccaaatccccagcccaacgcagcaggatttagccagatggtatttttaacctgcaaacaatgcttgggtatattgggaatttagcttcttcctgtcggggccccaggttatggcccagaggggaaaggctagaatccttgttcctgttattgcatctcagaggctctttgtctcagttggttcaatgactcttgggacccaggagctaccatcctgtctagtttgatcacagttccttcctctggggagctaagtttagtgtccttgtcttggggcaggagaccactcctgggggactaggtatatggagagctaccatgcatggctggtgagtcaccacttgaggtcggttctgcagttagaccagtcctggacccagcgggtgcaatgcagaaagcttgtaccattaagggcagggatgggctcctactcagccttcttggaagtagggcagctggtgttaaggttacctcacccatcctgcttttctcacccagcttgtccaaagaattaactccatctacaatgccaagagaggaaagaagagattaaaaaagttgtctatgtccagcattgaaacagcatcactgagaggtaggctttggtgccagagctggttcagctgtttggggcccttgggcattaggaacgggagaggcatcaatttacctgtggagggtagagccctgccaggaaatggccacgtaggagggaggagcagacagggaagaaaggtctgggatgggttccttcagactttgggctgtgaggccctgagcagggaggtgggtgtgggaatcggcttctgcaaaaggaaaggccagactcactgagcattgcggtctgtttcccatttcaaatcttgacctcctggaggcagggtccatcttttccaggcctgtaggcccctcttctggctcagcctccaactcaggccctcagcttccctcatgggtttgaatataggattcgcagtgtgagctctgaaggagcctggccccaggccactcagctccctgcctgcagatgcctgaccatgggcccagagtagcccagagaaggtagagatccatcccctgtgagaaaagctggggtggtgggggagcaaaaaacattggctgtgaggtccagcaagtatgtactctgctgttccttttccagatgaaaacagtgagagcgagagcgactctgatgacaggttcaaaggtgaggcacagctcccatgagtacggaagctctcccagcagggctgcagggaatcagccttcccttccgatgcatgtgtggttccagtgtccctaaccggcctgatgtggagaggtgacagacaggccagataccagaacaatagagcagggagccacagggaagtctgtccttatagacatgtgagctcagccctgcaaggttaaatccagatgtctccctttgccaaatgtaagggtggtgacctgcccaaactgtcccaagccattgtccatgggagttgggtgctagatttgcctggtaaatgttgtagatctcagccgggcgcggtggctcatgcctgtaatcccagcactttgggaggccaaggcgggcagatcacgaggtcaggagttcgagaccagcctggctaagatggtgaaaccccatctctactaaaataatacaaaaattagccaggcacggtggcgggcgcgtgtaataccagctacttgggaggctgaggcaggagaatcacttgaacccgggaggcggaggttgtagtgagctgagatcatgccactgcactctagcctgggcgacagagcaagactctgtctcaaaaaaaaaattgtagatctggagggtcagagaggggtacagaagattacaaggacctcttctggcaagaaatgtgccgtagactgaggaaactgtttctctggaggccctgcagtcccccatctcccctgtccccagagaggagcttgaaaaggttctggaaccttcacattccagggtccttggataaatctttgtgctttctctactgggaaaccctgcctaggccttcctggatgattatcctctcatccccaggcaaatgggcaagtggactttggatgtaggagcatgtcctgctaggggcccaaggatgaagccttcgtggatgttcgtgtattctagtccttttggtacagggacagagtgggtgccaagatacatccctgggtttgcctggcctcggcagtcctcctgccccagctcagtctccagaggctccaggaggaccaggcccgcagcttcctgtgtcagggcagagtctttgtgcaggggtcagcaccttgtgcctgccggtcctcctgcactgtgagctggggatggtatcagactaggctcacgtacttaaaagtgctccacagcaatggagccctgagccaggggtagaggagttaacatgaggcctgtgagggtccattccctgatgtgcaacctgcctccagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgcgaaacacctacctccccgaagtctcctaccagtttcccaaggtgaggccttctctctccccaccttgcccatattccccctcttccatcctctatccgccaggcctatctggggaaggagagagatcttgttcgtcatacgtcctcaccgagctgccacagccctgaacctgcctcctctcagccaggagggaagacagggctgcagcgggggtgggtttgggccagtgcttgttcaaaggatgaggactaagaaagaacctctcaatgtgcttataataaaatccagaacaattgaataccatacagttcacccacttaatgtatacagttcagtgtttgggtgtattcacagaattgtgcaatcatcaccacagtcaattttagaacatttttatcaccccaaagagaaactctgcacccactagctgtcactccgcacttctcccaccagcctgtctctcactccgccttccctgcttgtcgccagccagcctggcctccctcttcttcctctcacactcaacccctctctctctgccattgcctctgccaggaatgtgctttctccagctcttcacgtggctgctggctccttctcatttctcaggctctgctcaagtaggacctctttcaggaggtctgtccagacacctgcatggagcccctcccctgcccagcttgctctggtacataaccctgcttattattttatttttttattcgagacggagtttcgctcttgttacagaggctggagtgcaatggcgctatctcggctcactgcaacctccgcctcctgggttcaagcgattctcctgcctcagcctcccaagtagctgggattacaggcatgcgccaccactcctggctaattttgtatttttagtagcgatggggtttctccatgttggtcaggctggtctcgaactcccaacctcaggtgatccgccagtctcggcctcccaaagcgctgggattaacaggcatgaaccaccgcgcccggccaccctgcttattttttttttaagccccgctctgagatgttgtggttgaccatctcactctgctgacgagaatgtgtaaggtcggggaccttgtcccctttgttttccattgagagccaagagccctggcgcatagcaccgtgtcagatgccatatagaaagcactccgctggcatttattgaatgaatgaatgatgactctgggctctgtaagaattcggagtgggacaagggttgctgagatcatgcccgctagtcagtggcatctagggccctcaggggaggaggggcttctcagccaccaccacccgccctcaggttccatgtcatctcctggttccttcttccctgcagctggaccgacccaccaagcagatgcgagaggcagaggaaaggctcaaagccattccccagttttgcttccctgatgccaaggactggcttcctgtgtcagagtatagcaggtgaggcctggcctggcctgagggaggaaggagcatagccttctttacccccatagcgtgggcacctgagtggggcctgctctagtctcatcctctcctacagcaacctggcccttcaccccacgtgaaaatgacggtccctattcttgggggctgtttcctaggtcctctcacacctccctgatgccagacctctctttgttccagtgagaccttttctttcatgctgactggggaagatggcagcagacgctttggctactgcaggcgcttactggtgagtgaggccattcggtcctcaggccagcaggcaggggataggccagggtgtgtgtgtgtgtgtgtgtgtgtgtgtgtgtgtgtgtgtgcccttctgcaattttagcttgtatgaaatcctatgttatgcttcctgaggccaccccgaaccccctgccaacacacacactttcacaggtgaggctaccctgggagagcagggctcagagtggtgcttctgagggggccttaggatcggaggttatctggagtaaggggagggagtgggttttcatgtctttttagtttttctctactttttcgtcatttcccttgggatcatgggctctgattgctggtctctggttgcaggatcgaatcgcccccagcagtatgtgtatatgcatcagattaggtgagggacaaccttcctcacccccatacctggccagcctgtagtggggaggaggcctttctgtggtgtggtggggctggagattgggcagggacagagacataccttctctgggaatctgagagagataccttgaatctaggggaaagggattaggttttgaaaatgttagccattttgtaaagagaagtccctcaccatttcccttcccattagtcctgggaaatagattgggtagaggctcagagcctggcccctgctgcactcccagcttggagctactgggttgttgacaatgttttggggtttccaggccttagcaagagaaagcctccccagataccagtctaggggtagatgaagggggcaggagccctgaaggaaggatttggggccggccattcattcattcagaaacacttatcatcccttatcagaagccctgacctattgagagtcaggcacgtgctattgagagtcaggcacgtgctcatataaagatgagtttaacatggatctccctctcgaggaactttagatggcctgttacaggagattggactttcaacacaggagggaagggccaagggaataagagggaataaatgttgtttagaacctgtcacattccaagctagatgcttcaagtatgtcttttaaaagaaaatgatcacaatagcccatgggttattattatccctgatccatagattggaaagtcaaaactcagaggtagaatgacttgcccaaggtcatacagaaccagaagggaagtcgtttgtcaccaatttgtactcttggatcacccccagaggatggactggggagagggggcgtggggaggtagaatgcccatggaggggcaaagggcgtatgcacaggagtgatgccaggtggtgagccaggcagaggccagcatgcctctggccgcctgggcctcccaggcttggaaggagtgttgcgaaggctgcctttgctggaacatagatggagcagagctgctcctttgtagtggggctgctgcccccagggaagagcgtgtttgtcctggcgtgctcagagagggcctgggctgggtctctgccaagggggctggcactagctcggcattcctgcagattggacacaatgattctgatccaaatcccacatacttgatttaatcacttggggctttaggggaggcgggggagagggaaagagacaggagtgagtttcaggcctaatatggacaaaaacagattctgccttctctttagatctgtgacgtgtggccagcaggtttggagactgaaatagccccatctgcatttgcttagcagcctgcacgaggggccagcacctgctgctctgctccctccccactcggacttgccaggccctccaggcctctgagtcctgctggagaaggcactgcagcctgcatgggggctccgggcctgggagctctcagtgcatgtctcccctttagctacccaccttttttttttttttttgagacagagtttcattcttgttgcccaggctggaagtacaatggtgtgatctcggctcactgcaacctccacctcccgggttcaagcgattctcctgccttagcctcctaagtagctgggattacaggcgcatgccactatgaccggctaattttgtatttttagtggagatggggtttctccatgttggtcaggctggtctcgaactcccaacctcaggtgatccacctcccttggcctcccaaagtgctggaattacaggcgtgagccaccgcgcctggccatgcctaccttttaagtcccattcttcttttgctcctttactccatagcaaacctctacccagtgtctttgttttctttccttcctgtcagaaagcagcaggctttaggggtaagacagccaaacagggccaaagcaaactcctggctccacagcttctagataggtggccttaggcaatggctttatctttttgaactcagttgcctcatctataaaggggataataatccctctctcacaaatctcttgtaaagtcccaagcccaggagtcaggtatagcaaatgttccataaacagtagctcccatctcttgttttcagtttgctctcttagaatggaggtggatcaagaaagggagaaaagaagcaaaaaaaggaatggtatgccgaatgtgccctatggggctaaaaagctacaatggcttgtcctaaggatgtaccctagtccttcccatctgctggggtcccagcctcagggctatgaatccacagacaccctgtagcctctgccaaactgctttgccctttgccagcccccgtcagcgtcctcctgggaggaagggtggagcctgtgtggagcctggcaggagcctggtacctggtgctgggagaccctgcagagctgaggcctgtcctgagagtggtggctgttccttcagggctctggttgcagagaggtttagaggaggcttaaagtcttcctccactagaagggcagtccttactcctccgttcccaaggaaaaggagccagaaatggtaatcatgcattctctgtgtctgtctctctcctcctcctccttgtcctggcccagccaagtgggaaagggccccggttgccagaggtgtactgtgtcatcagccgccttggctgcttcggcttgttttccaaggtaagaggctctggcaggcttccctccccgtcccccagctgacagctcccacaggagtatctgcagccagcttagatgagaaaaccacctgtgactgtgagcgagcgggagacagaatgcaggaacaagtaccagtgagctctctgacaccctcccattccccggcctggttctctacccagctggctggcatttccccagctcctgtgctggcagtgtctgcccctgtcacagcccaccctgggccctaggcagagccagagtccttggggaagcaggagcgcccagggagctgactcttgggtggtatttcctttgcccagctactccgctcttggggactgaagcaaggccagttagggaacagaggagtcactgagtgccaaggaaaacgggaagggtagagtgtgcagatcatggcaagaccaccttcccgtctcccagcttctgggctagcctggtcagatgcttggctgccctcttctctgccaggagggggaagggcagtgccctgacacccttcctctttgggctgctggcggtgggcacaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtagggatttctgcaccctcttctctcgggctacgggctggggtggcaggaggaccatgctggccaaggtcgtagtctttgggggttgcagagcacggtccctccttgctcaaccatgtctgtgtaccccatcactagggaccaaaagagcaaacaataggaatgtacatgttgtccagccctctgttcctcccaggggccttccctgacccatttggactaaactgcattccatctgccttccttttgttcattcattgaacagttactgaatgtgtgccatctcacaatcagggattgcgccagacctcagagcagagtcagaggtagagggacgtggctctgtcctcatgaagtttgtagtctagtgggagatactgctattataaacacttttacatataaatagataattcctaaatgtgttacaagccaagtgaaagcacaggaccttatgagagtgtgaaacaggggagtctgctttaaataaggggccagggaaggtctcctctgagaaagtaacactttatcagagacctaagtggtgagtgggggcaactaaatgaagcaggaggagggagatggaaagagaaggatatgaacgggagaagattattccaagtagaggaaccagcatctgcaaaggcaaaagttgggcaagtgcaaatgctggtcagagggttgatggggtgggggtagaggggtgggttggcaggcaagaacccaatcacgatgtccctgctaggccaagttaaggatttggggttttatctaaagcaggggtatgataagatctgacgtatattttcatttcattttatttttttgagacagggtctcactctgccacccatattgtgcagtggtgctggagtgcagtggtgctatcatggctcactgcagcctcaccctcccgggctcaagcgatcctcccgcttcagcctcctgagtagctgggactacaggcgtgcaccaccaaacccagctgacttttgtattttctatagagacagggtttcaccctgttgcccaggctggtcttgaactcctggactcaagcaatcctcccacctccccctcccaaactgtagggactacaggcgtgagccacctgtggccagctgatacatgtattcaaagcccactgtggctgccatgtagataatggtcggagtgaaaacggggagaccagcagggatactgttgtggcactatgggtaagagatgatggcagctttggattaagatgtggtagaacaggggaagggaagtagatggattttagaattaggaccaatagcactttgcgtttgattggaaatagggagtagttgttacagagactgtaaggctgactcccagttttctggctggagccccagggtagatgatggagccatgtactgagatgggagctcgtgaaggagaagcaggtaatgaggaggaagagcaagagtccaaatgtgtacatgtcaagtttgagatgcccatgagacccccaagagaaggtatttagtagcaaagagtgtaaatagggaagagaagagagcccagtatggggtcctcctcagtcctggggaaccccaacgtgcagaggccctgcaggagaggaacactcaggagagggctgcggctcaggagcacctcaaaaaggaagccgtgatccggatcaggaaccaccaagaggtcaggatgaggcgtggcaagatcttgacaagtgcaggggcccagaagttgggctggagtgagttgagaagtgatgggtgtgaggaagtggaaacagcctgtgtagacatcttctcaagattgcatggctgtggagagaaatagggaagagggcagcaattgaaatgtggaactagggaagcttgttagggatggtagtttgtatgctggtgggaatggctgccagaggaagaggtttgagctgcaggagcaggaggggctagcagagagtactgagaagatgtgggtgttaggctccatggagggcttggtgtttattaggagaggagggagtggcttagtagattttggattctcatctgatggctttgattttctcaaagtagaaaaggtcagaccgggcaccgtggctcatgtgcttgtaatcccagcacgttgggaggctgaggcggggggatcacttgaggtcaggagttcgagaccagcctggccaacatgttgaaactctgtctcttccaaaaatacaaaaaaaaaattgccaggtgtggtggcgcatgcctgtaatcccagccactcgggaggctgaggcaggagaatctcttgaactcgggaggtgaagattgtagtgagtcaagattgcgccactgcactccagcctgggcgacaaagcgagactccatctcaaaaaaatacatatgtcaaaatagaaaaggtcatcctttgagagtaagaggtggatgttgggttctaggagagggaagaataaataaattagttgtagagagtgggagagggactgaccaaaaaagcataccaggcttgctgagcagtggcaaatcctagcttgagggctttctcctcgcctcttttctccccttcatttagaggaactttaggcttcatggtggctgtggggcacaggataggggacccttcccttatagcgcagcatcatgcctgggagctcttcatggtctggccctggccacctcactgggctctcgtcttctgacttgatacttagtgttgcctcaaccctacttccttttgcctagaagacacttctcttcttttctctttggggagtcaagtaccttgtgctctgagaggcttccctgacctctccccacccacatgagcttggctgcccttctagatgtcctgcctgtccctgtgcagatgttggtcacatctgcctctgtcctgacactggactcccaggctgtaactactcagctccttcagccccctgggcttgatctccttgaaggcagggatgcagggaacaaggccgggagtgggagcagcctgtgtgaattctcaatccctgggggaagggggagggttgggccccagggacagtagggactggagctgggtgctagagagcagagcctgttgggctgcatgcagggagcttgcgaattttggggcggggacagggcctggagcaggtataaagggctctggcatcattgtgctacttctttctgtgagtccacgttcactgaccatttggggtgtacccagcatctggcggatcactgggccttctgggagtacaccatcaggcgggagagacagtggacacagaccgttaccatgccctgtgcccattttgctgcttctctggggcccagaaggatggatgctgagttaggagttagaactccttcatttgcttagactctgaggaacaaatgagatgacgtgggtataaaaactccttgtaaagcattacctttgatgccatggggcaatgagagagaactggtttctcaccctagttttcaggaggcctgcacatctatgctgcacacacatgctgcgggaccaaggaggaggccaggcagaccccagggacagctgctttggcacggcctgagcgtcagcagttcctcctgccctcaccgctggagtcactcactaccttccacccctgtgactcccccagagaagtggctctctgagctgtggcactcaccttgggagcagcctttggaggaaagagggccaggcctggccctgataagacagtcctgcttcctggcaaggctgcagaatggccagccctttgcttatgttttccttgtgactggcatgggacttagggtgatggagataaaggccaggatagcaggacaaacagcctctggaaggaaactctttctgcaggaaagggagggggacagggcaacaaggaccccagcattgcccttccagaggcaatggctgggattagagtcctgggatgcggagatgcctggagagcagtggggtctagtcagcactgggggcttagacctttgtctggggaggtgggcaggaggaccctagagatgtggctgtgtggttcccttcttctccctatctctaagagcagtcagctctcctctcttcctgaggtcccgatggatggcccctcaactccttccttctggagccttccccgctttcacaggcagccctcttgcccacaggctgggtgttcgagtgctacgagagcagagctgtagtccgagggatggagaagaggggtttactgcatagcagggtagacgagagacctggaaaagagcaggttggaaggggaaagcagctccagttgcttcgtggagggccagagggcagcacccacttggctggccccggcccactttcccatcgctctcctgcaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcaggtagggcccagccgggcaagaaagcagaagggaggggggaaggcacacccacaagcgaatcagcaagtgttcaggagcctaagcaggcgccggagaccagtgctggagtggggctgtgcgtagggagatggaagactaggtggaaaggtagcacccctgtgtgggtgagggagcagggtttgggagcacacagatggcaggattgagaaccctgtggagggcttggcctgaggggagagggagggatatttcttcctttgcaacagccaagactgtgcaggtgccgggatatgtaaaggggaaaggttaagaaattgagatttttggtggatggttgcatttcttctggagggggaggcaaagccatctcaatgggatgctgagtttgaggaaagagctgctgtgaggaaggggcaagagcactgaccggggacagtgtgaggaatgctgagccagccagcgagggtcctgtggagggtgtcccctggagaaggcaactgcagtggcccagggctgggcaatgggagggctggggagaaggatgtgatgggggcactgaggtgcagagaggagagtgggtgaggaaggctggccagcccacaccgggaaacagatgatgtgcagggcctggaggtgccagggaagtcggggagctggtttaggaggagtaagaaaagagctggatgggtcacaggtcttggtctgaaatgctggcatttatgattttagaggtagaggtgtcgagaaggtctggtggtggccatgggaggggtggcagaagtgatggtcactggacgtgaggcagtttaggaagtaagaagtcggagctcttctagacagccaaggtttaaaaaagaaaaaagttttatgtcagtggtggttagggggtgacacaggcaaggcacaagtgatacggctccgatgagtgcaggaacactagggtttttggttcttatgctggtttagataaaacgacaccgacacacgtggagtggttttaaggagcggagagtttaataggcaagaagggaaggagaaaggcagaaagaagaaagtacagagacagagggagagaggctccaaagccgagagagggaaccccaagtgttgtggataccagccagtttgataagaaggctggaggaggcggtgtttgatttgcatagggcttaggggattggtttgaccaggcatgtcattcatgtagcccctcccccccccccccccggaagctggccttcccatcctagccttttaatatgcgaatgtagggcgcctgatgttctacacacgtgggaatatgcggggcagccatgctgctaggcacctgtaggggcaagggcaagaggacaacggtgggaattgccatgttgggtggacccaatttctaatggtcttcatttgcatatcaaaggttgcctgcctggctctaagagccggggctttctttccagacaagaaacatttttgagctgctttaaaggaaatgaggtacagtggctcacgcctgtaatcccagcactttgggaggccgaggtgggcagatcacaaggtcaagagatcgagactctcctggccaacatggtgaaaccctgtattagctgggcctgtagtcccagctactcaggaggctgaggcaggagaattgcttgaatccaggaggtggaggttgcagtgagcggagattgtgccactgcactccagcctgggagtgacactctgtctcaaaataaataaataaataaaaatttaaaaatttttttaaaaaaaggaaacaaaaacttttcctctctccataaaataatttcttagtaagtcctacaacaacaggatgggttattggcaacatgttacatattgttttggtcaaagaatccatcccaagcagtggtttctctagagtggtcatttggacattgattaagccaccttaaatgtcaggtgctcacaggagggcagtgaaggaaaatccccgttctggtttgtcctccaataagtcctgaatccctggggtatttccttccgtatgtatgaggaagcagttgagaggaaaccgagaaatgaactcccgattgccttcagagggacaggaacgcaggcccatcctcagcccaggagaagaaaggaggaagaaaaaccagagctgctgacttttccatagagcaccagggtttagaaaggaaaactgcccctcacttgttcccatcacagcctcaatgcttctgtgtctcacacttctaggtgttctgtgggcccatcaggcccttgtgaagaaatctagcccaacagctggaatgagctgggtacagcagttccaagaggcccctcctgtgtaccagccatggtcattgtcagccaacaaagcccctgactgcccagctttggtgccctggcctggcctgaccttagtggcccctaagagagcctggaccatgaggtttcttttcctgaaggttctaccctctaattcagggctgagcttcctctttgccaccctgcccccccccaggccagctcccgtggggctgtgaatacagctattgtttcctgtggttgcagctgcctctgagcacattccaggaccattctgggagggacgatcccaaggtcttgttcttggcctggccgggtattcaagttctgccaatctggggtcttggaaaagatgtccttcctgttctgcctggggtctgcctctggctggagaggggaggggtaggtccagccagctcatgatccgttgctgatgttttaggttttccacaagttctttgtccctcttgcctagttctgatgtggggtgggagagggtacccacgatctgcattcactggccctaggggtttacaaaacctactgcctcctcagccacgggcccactgatgtgccccccaaacccgagacagcccttttccagatctttgtcagatgactgtcctgcgggttgctgcataccttcctggctgtttgcaggtacatttccctaagagagtagcattgttgtccttgaggcgctacgcagtgggaaagcggggactttaccagtctgcagggtccctgaaccccattagcatttttgttgcactgggaggtttacgatcaaaggctgtcctgagcctccagcgagctctaagttcctgggcctgggctcaggtactctgtctctctgtctgcccatcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggtgggccaccgggggaaccagctggggggaagggtggagggggaagcaggtgctgggatcttacttgtggcccctcggcctctttaccaggctcttatcctttctccctgggaggtctatccccggctggagtacttcctgttagctgaccctgggaacctgggaggtctggaggcctggcagagggcattgcgggactcatgccctgagccactctgctaatgactccttttctcaggcgctgatggtgaatctgggatctgaccgattcatccgacaggtaagagggtgggtgcttgctagagttgggctcctgagcaccctgcaccatcacacacactactcaaccttcacaacctgtttgttgagctctctctctgggttcagtactactcacagactagtcaagggtggggagaagctggtcttggaatccttgaccttagcagggtccgcctttccagtgacatcatgagcttctagaaggcagtgtgggaatttgaagaacacggcctgggagtccacagacttggccactggactttgccccctttgagccacatggtcttaggcctctaaattcttctgagctctaaaggagaggtggtgacaacacctgccttgaaatgtttgctgggggttacacaaataactatagattgttatgtaacgtacaggtttgcaatcattgttgtcaactacaaaaagcctttgttagtcgtggaaatcctcctggctctctacaaaggagcacaacccagtgctctcccctatggaaatgtacttattgtctgttacacaccaatgacggagctgaggactccctgggtaccaggcatagtgatgtggacacagaaacagagtatagagacgaaacaacagtctaacttcattcctgagacacaggctggccacagtccccctgccccaagccaactgtgcctcctgcctggagctgaagatggaggaattggggagacctaatcaggaacccctggctggtcctggtcacagaggccagtgaatgccacactggctctaccccctttttttttttttttttttttttttttttggagacagggtctcactgtcatccaggctggagtgcagtggtacagtcatgacactgcagcctcgacctgcctgggctcaggtgatcctccccatgtcagcctcctaagtagctgggagtacaggtgcatgccaccatacttgactaattgtttttttgtgtgtgttttgcagatagagggacctgctaagttgcccaggctggtctcgaactccctcctgggctcaagcgatcctcccgctcagccttccaaagtgttgggattactggcgtgagccactgcgcctgaccctctaccacttttaatctctgtaatcttgggcaagtttcttaacctttctgtgcttcagttcctcatcttaaaatgaggttgatgatagttatgagggttactgggagagataaatgagattatctactcacgctcttctaacaggtcttagcacatagtaagtgctcagtgtcagctatgattgtcactgtgctttctttctcctgcagatggacgacgaagacacgttgttacctaggaagttacaggcagctctggagcaggctctggagaggaagaatgagctgatctcccaggactctgacagcgactccgacgatggtgagaatagtgcccgggcacggtcagctctgctccaggctccctctgctctgggtcagggccccatagggccagaactctgcctctgcacaccaaaccctttctggctgatgaggaccttggtctcactctagcgtcttttctaccccaggtagtttaggaaggaaaacccaaagacatgtggcaaccccaaagatactttctgctgacagaaaactaattattcctccttctgaggccttgcctcaagccattgcaggagatgaaaggcacttcctcttccttggaagccagaaaaatcacttagggtgagggatatgatgaaagtggtgctctggtttctactttaattcatccagcaattatgtttcaacttccatgttcagaacatagtttctggccttctgcagctcgtaggctagttacaaggctatgagcacaagaaagcaagcttccagaggccgggtgtggtggctcacgcctgtaatctcagcacttggggaggccaaggcgggtggatcacctgaggtcaggagttcgagaccagcctggctaacatggtgaaaccccatctctactaaaaatacaaaaagtgcacctgtaatcccagctacttgggaggctgaggcaggagaattgcttgaacccaggaggcggaggttgcaatgagctgagatggcgccattgcactctaacttgggcaacaagagtgaaactcggtctcaaaaagagcttccagaacagaagagtggtactggctggaagtcttgttggggagaggaagactacaccaggaagattgaggaaggctttgcaggctcttgacctgaacctcaaagattgtcttttcccttccagaatgtaataccctcaatgggctggtgtcggaggtgtttatccggttctttgtggagaccgttgggcactactccctctttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggtaagtcttggttatcagctctcttctctaattttttcacccacagcagggctgaagaaccaggcactatgatggaagctcttggacatcagctagggccaggcctcttaacatccctttacctctgttagaaacttcaaggtagcattcttctcctccggccccagtaaatgccttcacaaggctatgcacaagctaagccacatggctagaggtaggactcatctccacctaggagcagcatgccattggttgcccaccccctcctcaaagagaaagataggagaaagcccttctatccagagaaaaggagcagactgagcaatttcgggggttctgagaacccagtggttgggaattcccttacagagcattgggccagctgtcgtaggttggtggcagtcttcatttaaggcagatggttatcttgttttttgctatttcatcagctcattcgagggctttttcatctcatcacaatttttctgtctaacctcagggttagtacttcttctgtcctctaatactatccatttagtataacaacctttttggaacaacatggtagagttgtctgaaggaagctagagatgtccacttggggcagctctgaactgagaagcagcctcctcacctagtgcagcttgggaatgtgcatggggaggcagggtggcagcagcaaaccccggcaagatgtcactaatgatcgccttgatgagccagcccgaattctagtaagatgctcctgcaaattatcatcccagatgttttctttctccttttttggcatctgtgctccatggttcccttcatgtaggcctctccttcccttcctccaatgactgttctcttccctgtgcctgtttcttttacccaggcctttttgagcagcgagtggagcagtacttagaagaactcccagacactgagcagagtggaatgaataagtttctccgaggtttgggtaagtggccttgttactgatgagatagatgttcagcaagaaggaaggggctgggagatttgtgttcccgaatactctaaatcaatgtcaacaggtgttatactggggctgtagacagaacaggatgtagacatcccatagtgactagaaggttctcagccagaattccaagggcattttgcacagtagtggtccttcaatatctgtgggggattggttcctggatacccaaggataccaaaatccacagatgctcaagtcccttctataaaatggcatagtatttgcatataacctgtgcacatcttcccatatactttagatcatctttagattacttataatacctaatataatataaattttgttattttattttatattttatttattttattttagaggcaaggtctggctctgtcactcaggctggagtgcagtggtgcaatcctagctcaccgcagcctcaaacttctggcctcacgtgatcctccctcctccacctcctgagtagctgggactacaggcatatgccattacacctggctatttttaaaatttgttttgtagagatgatgtcttgctatgttgcccaggctggtctcaaactcctgggctcaagtaatactcccatattgacctcccaaagtgttgggattataggcgttagccaccatgcccagctgtaaatagatattatactgtattgtttagggaataatgacgagaaaaaaaaagtctatatatgttcagtacagacaccaccatccattttttcccccaaatattcttgatctccagttggttgaatctataaacatggaacccatggacgcagaactcatggatatggaggacaggctgtatttaccatattgcattacaaagaggaatcccaggttcccacatacatcaggtctttctgtttgcactccttcctgagtgaatatgaaggccattagagccagtgagctttcctctagaccataacaggtctgcagacacagcagtgcgagtgcccttcctgcaaaatgcacccctccctgcagggtgctcagcccgccagatcagagaatcatagcatgtttctgtttaaagagaaattgagaccaaagaggttaagtggcttgcgtaaaaccacacagtgattaataccggtgccctaattagagctctcacgtgttttcactaccctggatcagatcacagttataatccagtcttcctaatccttcctctcccactgacagggttagggctacaaggaggagagggagtggaggttggaagggataacactgaacattctctcttgtcctctctggcccacaggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaaatatttgtatattcccaaggggccgggtgctttcctgtcctgccagagcatggatgaagtttcgctgggtgctcgtgactggccagttttgtgcagctgactgtctcagccaaaccactgatcttccctggaggccttcggcctgcctgcctgcctgaggtccccgctgccagtcccgggccctggagagcagatgctgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttctcaataaacaatgtacagttgtttgggcccag

SEQ ID NO: 36167 - DNA, 72158 bp, Homo sapiens
ggtcgcgtgcgggagggggcgggtggggaaggatcgcaggcgagattacgaggcgaggctcgcgcgcccgcccccgccctggcccccagtgcccacccggtcggcccggcacagccatgatcaaggcgatcctaatcttcaacaaccacgggaagccgcggctctccaagttctaccagccctacgtgagtatccagccgccgctgatccgggcgagggggagtcgttggcgacgggcagcgcccagcgcggctttctcagagcgaccccctccggcgcgctgcggcccttgtcccgtcccggccgcctggcgctcgccagctgtcagcctcctggtgggtgtggacagggtgcccacctccctgccgcgcggtcagccaccgacgtggctttgcccgggcggttcctccgcccgtcggtgggctgcatgctttcctggctgcgcgggcgaggccctggagacttcccggggcccggccctcgccgatcgggcagccgcagcccagccgcgccgcggagccctgcgcccagtccccaagagcccaccccgcgcggctgccttcctgccgcccgcggctgcagttagcccgggaggaggaagacggcgtggaactcgttcttctcgcccccctccgccgactcccatcctttccaggtggacttctttctgttctttggacagatgggctaccgtttttcactgtggtcctctcatagcacaggaactttggcttcctgcgtttgataactgcacgttctgtacagtctctcttctgcatgtttcgatacgtgacagactgcccagtgtgactttcaggtgtctccttattgaaaaggaagatatgtgaggacctaatatttttatcaggctttttaccagctggctgcaaattatttaccctcgaagtaaccggcgacgtttgtagttgactgattggagctgtggttctatacctaaaagttatgatttcagcttctggtttggcatttttccacgtatgggaatttgccctcatttatagtttttttctatttatgaagaatagtagcatttgtagaacttctcttttaacgtgtaaatactgtttagtatggacaagtgcaggaggcattaaggtagtagagataagtgatttgttgatgatcgaggaagggttttatagagttatgtgcttacctgagggcagaattcgctagctgaaacacataaaattggactcccagtggtaggattaatgtgaggtataactgttgtgtggtattgtggcactttgcttatagcaagaaatgagctttcaattcaattttgaaattgtgccaaggctaacacttttatgcagataagtcccagatggaaatcaatcttgccattacaaagtaaatgtgaaaatgtcagtttgcctaaaatgataatgcagtctggaggtgttagttgaagtgagaaatcttgagcttattcttcatttttttcagttgttttgcttttgctagctataaagaatattttctgctactcgtgtgtggttttaatttagtataacttcaatactaatggtctgtttaaaaattctacatcattctttaatccagattaaattctagttgatcctcccgaatgggaaaaaatgccattaactttacctgtttgttaaaatatagtaccagcctttattgaaggagtctttgtcataaccattttgccagtgtcatccatttgcagtgtaaaaaaggtatgttgcaatagtaaaacaattcaaaaaattatttttccatatctaaacttaagcaatattaaaaatagtgggtttcctggctaatccatgtaatcggtgtatactactcgtatagtgtataatttaactatctattgaaaaatgcatttaatttagaaactcagaaatctgtctttcccttgtccaaaagtgggaacagaagtattgtttaccatcacttactaggtagcagtgacggttaatgtgggaagtggcagttttggcaggagtggcagctcaggtggcatttttggccattgtatgagtgacagtgccactgagggcacagagctagaagatataaaaagaagaatctggtggtcactggccgtttataggtggagtatgagaagttgtttctgtgttttaagtttctataagttgggttttgccgagtgtttttttgtctttcaggaataatttaagattatttatttatacatttgcttcctccactagaccataacctttttgagggcagttattttttttcagtcattcattccatcagtttgtcaacggataaatttaatttatgcctaccatgtgcaggcactgttttaaaatctgaagatgaacagataactttcgctcttgtgtgaggaacatagcactattaaggagtaggctgtattatagcatgccagatagtattacgtgctgtggaaaaaaaaataaagcgggtaagagtcttagagagtgagaggatgacagtttaaaatagggtagtctggtaagttctcactgagaaggtggcatttgagcaaagacttgaaggaggtaagaaaggcagccttgcagatatctgggggaagagcatcccgggtagaaggagcagcaaatgcaaaaaccctgaggagagcgcctgtttgaagaaccccaggaacttgtacatagcaggagcagactgtgtaagggaacattagttggaagtgtctgtttgtgtagggcgtcattctattcttgctgcctggaatgtccttcctttccattgccacgtgtacaaattcaaccccttgttctaggcccagcacaaacatcacctaaacattccgtgaagcctttgatcttgctcaaagcctcctcctggtttttaggatttttttcatctttgttatgacacagtattctcgttcacagcctataattcctcgtggcagccatcctatagaatacttgaaggaacgtatcagattttaggtatatttttgtcattctaagcagtcaacactgagtcttgaacatagaaaactctctaactctttgctaaatgcatttatttagaatctcctagcttgggatagagttgggattagttaacttgctgagtttccttctatctcttaaaatgtagtccttcactaactagaggttttaagaatctctgcctttagcataaaagtaatgatggcatatgtgttactcagctgtttctgttttaaggggtctctaagaagtatatgtccaatatgaataaaaatattgagtttaatttattaaacaatatctagaggtgtgactgagctaacaattccatatactggcaggatgctgaggtttgagtccaacagtaatcgtttaacactgagcagtttaaaaaatgtttaaccatttgccaacaagtttatcctactgcacttcattttcattcctcatttatctccctcaaatataacaacttacatattcatctctgccctttaacagtgcacatttccatttcatgctgtaatagattgttagattcgattgtggctccaagctgttatatgtgagaaataggaagttgcgcacctgttttgctaaacagaagttttggttcattctgctagagtcagacattacgaattcaagtgtgggctgggtgccatggctcatgcctgtaatctcagcactttgggaggccaaggcaggcggatcacctgaggtcaagagttcaagaccagtgtggccaacatggtgaaaccccatctctactaaaaatacaaaaattagccaggcatggtagcgcacgcctataagtgcagctactcgctcgaggctgagataggagaattgcttgaacctggggaggtggagaatgcagtgagctgagatcgtgccactgcattccagcctgggtgacagagtgagactccatctcaaaaaaaaaaaaaaaaaaaaaaaaaaaaaaaaaaaaaattcaagtctggactcaaaatgcatcccttttcgtttttgccttctatatccttggtctatgactgcacaaattcaaatgttttgcttggtttgtctttttaagttgatacttagcttcagcgacttgacaacagtaacctttagtcttttaatacttacctgacagtatttgtgcattactgtaaataactaatgagacttatattttataaactaaatatatttttacatagctatcaaacaaaaaaatcccttcggttgtgattccatagtgtatcctctggtgaattacttttaaaaaatttttctttttttatagagaaaaggtctcactatgttgctcaggctggtcttaacctcctggcctcaaacactcctccagctttggcttcccaaagtgctgggatgacagatctgagccaccatgcctggcctgtgaattacttttataaagtggaaatgtctttcttttgtgtgaattatcttagttgtttcttcagatataaaatactgtgtgtatgtatgcatgtgtgtgtacacaccacacacatattaagtgcaagcaggaaaaatttcaaattaacctatatgagttgcctcaatttttttaataaactgtatttaattaaactgttaaccaaatgcaagccttaggaggaactctaagattcttctttctcgtttttttttttttttttaaatcttaacataaaaatacaaagtgttgaaagtatagataacttcttttttcttttaaaaatatcccttaaaaagatccatccatgttcactcatgtctttttttagtgactattaagacgttgtggcagatgggataattaaacttatgtctgtgatcaagatagaattatcaacactcctgagtatgagggtgttaacacatactaacacacggcatttcagctttttgttaagaagaaaattccatacgatttggtttccttccatattagttataatgcgtttgtctgcataaattgggttttatgtagcctgactcaagtgcttggaaagaactatgttaggtacattataggaagtgcagagtagtagaccgattccaaaagtatttgattcagcaaatcaatgactttattgtagatccaatttctttctctttctctgctttactcatcacaaaattactattatccaaaggctgtttttctcctttggtaatcagttcaattcagaaagagacaaccatctgtttctgcagtcctggactgtgtctttcccttcattctggttagacccacccaagaccaatattcttaccctaatcaacatccaactttggattggagctgaagatgagagtgaaaacgggaataaaatggatattctgttggaaagatgaaagaaaggagtggatggtgggtaggcaaacaagggtctgctatttcttcttctaaacttttaaaaaaatatttatttttatggccgggtacagtggctcatgcctgtaatcccagcacgttgggaggcctagatgggaggattgtttgagcccaggagttcaagacaagcctgggcaacgtggcaaaaccctgtctctatgccaaaaatacaaaaattagtgagtcatgttagcacacacctatagtcttagctgcttaggtggctgaggtgagaggatcactgagctccggagatcaaggctgcaatgagctgagattgcgccattgcgctccagcctgggtgacagaggagaccctgtctcaacaaatttaaaaaaatatatgtttttattgaggtatagatgacaaaaaaaaattacatatatttaccgtgtacatgttatttttgtatatgtatatattgtgaaatgggtaaatcaagctaactaacatgtctatcaccactattccctctttattagcttttaatatatattagttttctgaaattttagattgcttctgaggttgttaatatcaggaatagttccttgtaatatgcaatactgaacctgtgtcacaatagatcttaatttcaggttttccttatatcaaagtatcctcgaaaaacccaaatgcttatacgttcacagtttttatgtggagtatgctggaaaacttgctttttaaaaattaagactaaaccttttgaatatttaattgtaaaggaggaaataaagtcttcaaagttaaaatgatttttggttatgaggtaagtgttataaataggacaatgttataggtcatttcatggcttttctaaaagaaggccttacgtgacgtacctatattatattctttagcaaagttgttttcaattttaagtaagtttctttttttgtgactgtggaaaattaaatattaaggccactaaggtcattcttgattttaccacacacagataattattaacacttagtgtatttccccccggtctttatttttcttttcagaatgtcccagtgaataggatataccttttagacattaataacacaaataaatgctttgaagctgatgatggatttattaaacattgtggctttaagataactgaatatgttaatgttcagccactctcttgttaaaatttaaaaaagacagtatatggtaatagcacattaataatttgcatgtcctaagaaatgtgtatatatctttcttttgtataaaattaaacttacctgtgtaacctgaggttatcagtgtccttgtctttttcgttctgaaaggaaatctttgctaatttttgtttgaaagtcaagagttcattcttacctttagcacttagtcttttttgtacctgtggattatggattttgtcactgctgttttataattcaaggtgattctgagttgttaccatctagagggcccagtccccttccaacttcttgttgtataaaactgtcacattaggctaactaaacacattttttcctcacccatctgccttttcagctttcctctcatcaaatcctttgaagtacaatatagttaaaacagctttctttgctgaagaatcaagcaactcttagaaggatattgaagtgaataaaggacaattctagctaataactgttttcttaagattccaagtggaggaagcccttgtagagttaggcctctgactaggccttctagagataggcctctgggaagaggggtggtctttctggatactttctgatctgtctctccattacactctttctcttttcctgtccatattctttcaagtatttatttgttgtttgtatggccctattctaagcactagtaatacagtgataagtaagacggatgtcacccttgccctgtgggtttacattctggtgataggagataggcagtaaattatttaagattgtaattagtctgaagacaaatgaaacagtataagggaataaagcttgatggaggaaagcctatattagatagggtcattgggaatacctctttgacgacctgacatttgagaggaaaactgaatgagataagagaggaagaatatgaaaacagtaaagaaaagaatgtttcaggcagaaagaagtgcagtgtccctcaaatgggaccacacttgatgtgttcaggaatagcaagaaggcaagctgagaaatcacggggaagagaggcaggagataaagctaaagagaacgatggggacagatcatgcctgtatgccacaccatgccccttcttgacataattcagtttgatgacatcatgcccagcatgttctccacaagaggagatactcctctttgaatcacacttgcattttgccatttaaacagtgcctctgcagaaggggcagtgaggctctcctctgattggttactttcttctctacccagttattgttaggctctgtaaagaaggtgttgctaggccagtgaatgaaggtaaaagtcagtgcatcaaaaccaggcatggtgtgtgcctatagtcccagctacttgggagggtaaggtgggaggattgcctgagcccaggagttgaggctatgctaggcaaccatagcagggcccctgtcttctaaaaaaaaaacaaaaacaaaggaaacaaaaaacatgagtgctccagttctgtatagcctctctatcaatgagacctgtgatcaagctttcgtaagtcacctgtgaagtaacagaactcaagaagaaaaccatttttttcttagcttattgtcttaattatatgtgaatagagtttatgtgaagcccactagacccacctctattgtactgaaaagcatttacatttttccactcttgcaagcctggtgtaattacaagaatcacttgctgtcagtcacagttctctttgttactcaggaggaaagggctatcttttaatattccagacccactgaattgttttgattaccttgtgcttactgaggaagagtactagttgattctaccgcatacatatcctatttcctgtcattaatatatcttagtgtgacatgaaagggttataaaataaattttattgtagtaaaaaatatataacaaaatttatcattttaacagttgcaagtgtacagttttgtggcatgaagtatattcacattgttgtgtcaccatcaccacccatccatctgtagaacttagtctttcccaacagaaacttcttacacattaaacactaacttcctattctccccttctcctagtacctggcaaacaccattctactttgtgtctctatgaatttgactgctctaaaaacctcatataggaggaatcatagaatttttgtgttttggaaactggcttttcttttagcacgtcttcgaagttcactcatgttatgtagcatgtatcaaaatttccgtaatttttaaggcggaataatatttcattgtatgtgtgtacataccatcgacctaaaaggaagaggctgaagcacaaaataggattcaaagagtttacttgagccaaaatgagaacagttgcctgggagactcagactcaagtatccttggatatgagctccctttggccattgttacaagcaggtttgtgaaggcattaaataaaggggacatggagtgggctgatactaagttgtctgtcaggaattctcactagtttatagaaataactttggttaatgattgactaacattgttgagatgcagggagtagtttatagtgtgtggtgcagcattattaggttattttctagttacttgtggcagtataaagcagtttcaatagataaatatttctcatagctcaaaggagagaagtaggatgtgattgctgtcacattttaatgcctttctgggccagatcatttaaaaggacttgcattcctcagataaaagtttctttcttgatgccgtattttgtttatccgtttgtcagtggaaacttgggttgcttccatcctttggctattatgaataatgctgtgaacatagatgtactgatatctgtttgagtgcctgcttttactttttataggtacatacccagaagtggaattgttagattatatggtaattttatgttttgcttttttgtggggaagcggcacatcattttccacagtggctgtaccattttacattcccaccagcaatgcacaaaggttctagtttctctacatccacgttattttttgttttttgaaaatagccatcttaatgtttatgaagtggtgcctcattatggttttgatttgcatttctttagtgactagtgctgttgtgggtctgtttgtgtgtttattgaccatttgtatgtctttggaaaaatatctatttgagtcttttgcccattttaatattcagttgtttgtttttgttgttaagttgtaggagttttaaaaatatattctagatatcagtctcctgttgtatatatgatttgcaaatattttctctgattctgtggttgcctttttactctgttgatagtgtcctttgatacacacaactgtttaatgagatttaacttacgtttttgttgttgttgttgttgttgttgctggtgcttgcttttggtatcatacccagaaaatatttttttaattactatataatagtacattgtatagtatactataatttaaccaatcaatgtggacttcaattttgagtaaggttttttgatgagattaaataagagaatggttgtggagcttgacatacaaagacttagtaactgctgtgtaaataataatgattacttttattactgcttgttactttctacttctaagtggaagatcatgtagtcagtcataggactatagaacacaccagagattgttctcaaatactctttgtgttttctcagaatgaattatctcttttattttattttttttccaaaaaccccagtgtttaaattatatgggccctgttttggtaaaaggcaaaaggtttgtaagatctgaagagaaaccagagtatgtgggccctgttttggaatgaacttgctgcttataaaatggaaagtcctcaaacactcttccacagaaaagttctgtaagaagacttttataggagaaagtatggctgtaaaagttgccccagcttctttcattttctctgagaaattagctaaccttttaaaaaaaatcttaattaaaatatagctctcacatgctataagattcacccatttaaagtatataatacagtggcttctagaattatatcatggttgtgcaaccatcgccacaatctaagtttagatcatttttgtcaaactaaatgaaatttagtaactattagcagtcacttttcaatccccactccccactgtccctggcaaccactaatctgttttgtttccttagatttttctattctgaacattctatataaatggaatcatgaaatattacagtcttgtgattggcttcttttactttacatgatgctttcaggatttgcctatgttgtagcatatattaatatttcattactttttatagctaaataatattttagtatggggaaatatatatacactgtatcttgtttgtccatttatcaattgatggacatctgggttgtttccactttttggttactatgaataatggtgctatgaacattcatgtatgaatttttctgtgaccatatattctcatttctctagggtatataactgggagtaaaattgccaaatcatatggtaagaatatgtttaattatttgaagaaatgccagactatattctaaagtgactgtaccattttacattcccaccaacaatgtctgagggctccagtttcttcatatcctaaccaactcttgttattgttggttatttttattctagctgtcctgatgggtatcaagtagtatcttattgtgattttcacttacattttcctgatgacagatgatgttgaacatctcttcatgtgattatcatccatttacatacctttttgaaagaaatatatattcaaatcctttgcctgtttttaagttgtctttttattattgacttgtaagagttcttaatatactctaagtgcagatcctttgtcaggtatatgatgtgcatgtatctcctcccattccataggttgtctttttactttcttgctgctatcacttgtagcacagtggttttgaattttgatatcatctagtttatctctttttttcttcacttgagcttttggtatcctatctaaaaaatctttgcctactccaaggtcaaaatcttgtaactgtgtttcctttcaagagtttagtagccttaattcttatacctaggtctgtggtccatttcaggttagttttgtgtatggtgtgaggtggggatccagttttattcttttacatgtggatatttagttgtttgagcaccatttgttgattattctttccctattgaattgccttggtactttactccaaggtttcctcccagattttatcttgttcttggagttcttagaccttccagctaccaccatggttgactctctaaatatttcaaactcagtctgtcaccttctcagctttttgttatttcagtaatagagtgtttgccattgaaattgggaaatattttaatatgtgtctttgttcattttttgcttctataacagaatacttgagactcagtaatttatagtgaacagaaatttatttggttcatggttctggaggctgggaagtccaaggtcaaggagccacgtgtggtgagggccttcctgctgcatcataacatggtgaaaggcatcacatggtatgcacacgtgggcaagtgtgggagaaaacttgctttgataacccactcctgtaataatgaccttcattcattcatgagagcagagccctcatgaccttatcaccttttaaaggtcttacgttttaacactgttgcgttggagattaaatttccaacacatgaactttgggggagacattcaaaccaaagcagaatggttgatggtggtttagggcgttaattatacctgccatttattgagtacttttttgtgcatgctaagcattttttatacattgtaagagaaaataggagagaattcttctctaaagaaatttaatgagatatcttggagagttctaattaagttactattgtaggtgccccagtctcttcttgtttgggatttgaggatactgctatcctgattgctggttctttgcacactctggctgaagttaggcctgcccatgtacacagagtctccagccagacttcttaggagaggccttggcagaaaacacactaactgaattttctttgctagggtcttctctttttcatgattcctaaatgtttggagtgctctgaggctttgtcctcagatatctctttttttttttttaagtgcaacataaactattattattcttcatatattttcttgattctgtgattttgtccacattttacttctgcccttcatgtaacttcatactccccattctctatatttttgaattctacctattctttaatgcccttcctcagtatttgtcacttttctttgaagatgacagtcttgctgctcaaaatcattgttcctcttgacttcttacagtatgttatttgtactactcttatgtcagaaatcgccctctaccttttattataaagttattttctatatatgtatgcttatatatgtgtgtgtgtgtatgtatatattttatatctatctatctatctatctatctatctatctatctatctatctctgtctctgtcacccaggctggagtgcagtggtgcaatctcggctcactgcaacctccacctcctgggttcaagcgattctcctgcctcagcctcctgagtagctgggactacaggcatacaccaccatgcctcaccactttttttgtatttttagtagagatggggtttcaccatgttgatcaggctggttttgaactcctgacctcaaatgatctgcctgcgttggcctcccagagtgctggaattacaggcgtgagccaccgtgcctagtcctattttaatatttttattcaaccagggcctcgctcagccacctaggctggagtccggtggtatatcacggctcactgcagccttgatctccctgggctcaggtgatcctctaacctcagcctcctgagtaactgggactacaggcatgcatcaccatgcccagctaatttttgtattttttgtagagatggggtttcaccatgttgcccaggcttgtctggaactcctggcttcaggtgatcctcccaccttggcctcccaaagtgctgggattacaggcttgagccactgcacccagttgattatgaggaattcggtttctttttttgaaatataaaaaaggcaaaatacaaaactataaattcaaaataatgatatctatattttacttcttgtattagatcataagctgtttgagaaaaggatctatttgtctttgatcttggtaatcctctgtattttaacatttaccagagtgaatgaatgcattttaagaaaatactttcctaaatttttaaaagaatgatgaggatgggagatgacattgactatgattagagggaagttttaaagttgcctgtgtgatatatgcataaggacaggagggaaacgtaggaaaagagaaaatattgttagtgggtttctgttttttttaaagtttatttttgtttttcattactacattaagaaatattaaaataataaaagtttgtgcccttttgtaactgtagttgtctttagactgatgtaatctaggagttgtgaccaactgaaatatagctcttttgacttcggttgtgaaactatagtgttaggaaatctgatcagcctgaagcaagttctaggctccttaatgaaagctgctaagttaaataaggaaaatagttttatgtcagcagatacttatttaattttagcttagcctttggatgtttgattaaaattttaaggcattctttcctatattgttttcttttttcttcatttttaattgatataataactgtgcatatttatggggtacagtgtgatgttttgatctatgtatacattataaaaggatccaatcaagctagttaatacatccagcatctttttttttttttttctagagatagcatcttgccctgtctcccaggctggaatgccctgatgcccaggctgatgggcagtggtgtgatcattagctcactgcagcctcaacctccagggctcaagggcctcaagggatacttttggctcagcctccttggtagccaggactacaggtgcccaccaccatgctcaactaagtttttaaaacgttgttgttgttgtttagatggggtctcactttgtagcccaggctggtatgaaattcctggcttcaagcaatcctccggcctcggcctcccaaagtgctgggattacaaacgtgagccactgcacctagcaacgtatctataatctcaccaacttattatttctttgtggggagaatgttaaaaatacattcttctggaagttttaaaatatatattattattaactgtggtcaccatgcagttcagtagatcacaaaaacttattcctccagtctgactgaaactttgtgccctttgatcaacatttttgctttccccgttcctccttttattcccaccaccagccgctggtaaccaccgctactgattttcttagttgagtattgccagcattctaagaagattccaagtggcagcagttgaagttcctatgagaaattctttcactatcaatgtaatgaaacatagttaaaggttagcacagttgacctcttccttgataagcagtaatataatacagaaagataacattccttaaaagaaaacttcctatgagattttattgtccttagaattgtagagctgacttttcagataaggcccagaggtagtacttaaaaataagtcagtgttaatgcatgcttattatatgccagatatcattctacaagtatgtacacgtatgtataaagtaagtgtatgaactcagttctcacaacaccaccatgaggtagatattgttgcattctccatgctacaaatgaggaaaactcaggcacagagaggataagtaacttgctcaaagtcacagagttaacaaagagtacatccaggaataaacccatatatctggttgcagattatttactctcctcctttccttcttttagtttgtttcttcaagttatacgtacatattggttaaagaatctaatagtttcataaggtttgttatgaaaaataacatttcatttctccctttccacaagtaactatttttagctgctgatttcagtgtttatgtacgtgtctaaataatgtacttgttttactgcctgatttattacttgtagacatgatttattctgctattaaaaatgattatttggctgtcctctcctccacaactaattcccagtcccctcatagttatttcataattttggttagatcagtgtttgatgtttacgttaatttattatgtaaacactatcttcagctgagccatgttgtaaactgtactgttttttctttcctgacactttttcttcaaaggttgtaattaccttttcatttgatgtagtttttaatgcacttatcactagtttacatctttgccagttgtctgaatcatacacatcttttctcagttttaggttcttaaataaatctcttctggagccttttgactaggaccaatccagaccagttgtatggcagtcatgctgggatctttattattttaggggattccttttgcttgtttcctgtgttggacctcctattgcttcatttctttgtttactatcctgccatggtggagccagtaataccctccagcaatttcttgagaaaaaggtcatgggaagtagattttttgtgatctggcatgctgcccaaaaatttttattatgactccacattgactgcatataaaattttaggttagaattttttctcagaactttgattatatgcttcatcaccttttagtttccagtgttgctatttaaaagtctgaagcagttctgattacttacctttgatgtgtgatcatttataccttccaaaaagttgtagattcctgttttttgggcagagtttctacagtttcacagacccttgccattggtctgttttcattagttgtgctgggtacttgatgggtcctttggtcgtagaaacttttgacccctgctggaaacatttcttcattttctgttctcgagtctccttttttcagtttttctgaatttctttggactcttctacgtatcttattctttctctttcattttctatctttgtgccctttgggtcaatttcccacctttattctccagttttctactgaatttttaaaatttctccatatattttaaattcccatgagcttctttatttctgaatttcactcttttataatatactgttattttatagttgtattatcttttcttacttctcttatattaatgatatatatttttaaattttcttctttttacttggtttgtttcctctgagttgctttttcccctattttatgtttaactttttaaaaaaatttatttattttttattttttattttttattatactttaaattctgggatacatgtgcagaatgggcaggtttgttacataggtatacaagtgccatggtggtttgctgcacctatattagagttgtcttcagctgtccaataatccttgactgactgctcctttctaaggatagggtactgaaagctgattggaagctctcaatccatgattagaggttgcctgtgcgatctttacttgaggtaatcaagctaggcagtttaggtagtgtaggaattggaattgtgactacaactccccaaatcgtcatgacttaacgtaatacaagtttgtttctcacttggataaagcccagcgttggtgttcttggtcaactagaacctttcatgtgggcctttttttatcattcttgagaaggggccaaaggaacttctacatctagttagcatggaagattttgcaggaatttttatgagtgaggcttgggtagtatatttttaacaacctgatcatctgggaggaaaaagctctgatttatagcatttgctgatctttatggtataaatacttcatcatgaccaatttcaggctactgacatgatgtcaccaaatgcagaattaggaagagatacacccagtaggctttcatgccagctctggcataccactgtaactactagccacattccactggccagaactgtgttgtatggctccacctaaattcaagggagggtgaaattgtgtgccctggaagtaagggaactagattttagtgaacagctaacagttttctgtcatagttggtatctctattatcattatctttagatctagttagagttcctacagagttatgttccaatctcctgcctagacggtgaagaaggcctgcctctaggtattctgagaactgattagacaggatctggtggtatctgtacatttacctaatccccatgttttcagtgtggtccctgaatttattttatgttactgtaacaaattaccacagacttagtggcttaaaacaacccaaacttatcgttgtacggttctgtaggtaagaagtcagatgtgggttttactggactaaaatcaaggtattggtatagctgcatccctttctggaggctctgggagagaatctatgttcttgtcttttctagctcctagaggccaccctcattccttgctcatggcttccattctccatgttcatagccagcggcatagcagtatatctgtgattctttttctctagtcacatctccctctgaccacagcccaggaaagattctcagattttaaagtgccatgcgatgcaattagctccacctatataatctgggataatatcttcatctcagagtccttaatcacatctgcaaaggcatttgtcatgttaaccacacatatttacaggttccagggattaggatgttgtcattttttggtgggccgtttttctggctaccacagtaccccttgctctccgaagaccctccctttgatctattcctagtaataaaattatgaacttttgttggggatggtagtgggaatttagtgatccttctgcttttcaaacaaactttccatccttattttacagtactctctttatcttcacttccagacatatgtaaaagcaccaattcatgaggtttttgcctagtttgtgacacaaattgagttagttttatgatttccctctcaccaatttaggattaaattttctgagaatactttaacacttatttaaacactttcaagattttgttgttgttgtcttcctttcccattctcctcatccttgtgtgtttatgcctttaccaaaaaagccctttaatattgtcttagctggggtttgggcaggcaacaaaggcagatgtgtgtttaatttaccatcttaattagaacacagcttgcacttttaacttctgtaccatactgccttaactttattgccttttttatgtgtaaggtaacccagattttggataatataaatggttgtggatcctgtcttctagattacaaatttatttattcaatacgcttttattggctactctacatcagccactttgctgagcatttcaaatacaaagctcaggttccggtgttagaattcagactactacaaaggaaatttgagcacattgttataagtgtatgataggaatagaaacaatactaaggaaccatggagaaaaaagggactaattttaattgagagtcaggaaagacttcatagaagtcataatgttctagctgtgtcttagaaagggtgttgctagagaatggagtgtggaagttgttcccagacggaagtgggaaaatgtgaagaaggtgaatggtaagaagttcaatgtggctggagcagatcataaaggggagaagaaagagatgatgaaacttcagggattagtctggcttagattttggagaacgttttatggcatggtagggagtttgtatttaggtcagataaaaactagagatctttaagaaaggaagtaacacggcttgcacatctttggttaaatttatttctaagttttttatttgtttaatttcttgtttgggatgatattgtgaatggattttaaaaagttattattaaaaaaattttttttgaggcagggtcttgctctgtcatccagactggattgtggtggcatgatcttggctcactgtaacctccacctcccaggctcaagcaatcctcctacctcagcctcccaagtagctgggactacagacatgcactaccatgcctgggtaattttttgtagagacagggttttgccatgttgaccaggctggtcttaaacttctagactcaagagatcatcccacctcagcctcccaaagtgttgggattacagacgtgagtcactgaaccaggccaaaattttcttttcttttctttttttttttttttttttgagatggggtctcgctatgttgcccaggctgatcttgaacttctgggctcaagtgatgatccccttcagcctcccaaagtgctgagattataggtgtgagccactgtgcccaactcagaatcattcatatttaagggcgtggttcggttctttaacttactttttataggattccattgtacaattccattccgtaattatccttctgtgactggtggacatttgggtcattttcaacttttcttattacaaacagcgcttttatgaacattcttctgtttgtctcctggtacagaggttaagagattttttttatgtacagtcaactcttgcaagggtctacttacacacagctttttttcagtaagtttattgggaagttttttggagatttttgacaaattgaaaaaacttgccaattgtgtagcctagaaatataaaaaaaaattaaaaactttggagatatgttatcaatgcataaaacacagtagatactagtttattttatcatttactaccataaaatatatacaaatccattgtaaaaagttaaaatgtatcaaaatttatgcaaacacgtagagactggacgtggtgctattctcagtacgtggtgctactctcagtggagagaactgtaaacaaatgtaaagatgcagtattaaattataactgtataaaattaactgtagtttgtactgtactactgtaataattccaacattctgttgctattgtggtaaattcaggtgttttgagaatctgcttaaaatgctgtgtgatgctaatcatctcctggtgagcaatttgtctctctagtaaattgcacatcacagtaaaaagtgctttctcccaattcctgtgtaatttgttatcatgtttgttgtaatatcataaaccttgaataacactatgggagtcatatgaagtgctactagtgatgttggaagtgctcccaagcagcagagaaatatcatgacgctacaagaaaaagttgaattgcttgttatgtaccttagatagaggtctgtggctgtggttgcccagtattcaatgaatccagcaaaaggactattgtaaagaaaataaaattcatggtcaggcacggtggctcatgcctgtaatcccagcactttgggaggccaaggcaggtggatcacttgaggtcaggagttcgagaccagcctggccaatatggcaaaaccccttttctactacaagtacaaaaattatggctgggcgtggtggctcccatctgtaatcctagcactttgggagaccgaggcgggtggatcacctcggtcgagttcaagaccagcctggccaatatggtgaaacctcgtctctactaaaaatacaaaaattagctgggcatggtggtgggcgcctgtaatcccagctacttgggaggctgaggcaggagaatcgcttgaacccaggaggcggaggttgcagtgagcgagatcatgccattgcactccagcctgggcaacagagcaaaaactatctcgaaaaaaaataaaaataaaaatacaaaaattagctgggcatggtggcgggaacctgtaatcccagctactcgggaggctgaggcaggagaattgcttgaaccctggaggtgggttgcagtgagtcaaaattgcaccactgcactccagcctgggcaacagagggagactccatctcaaaaaaaagaaaagaaaaagaaaattcatgaatctgtagctatagctatgccagtgtgtgagaaaactttgcaccttttgcaaaatccctttttacgtcgtattgaaaatccagctcttatgtgggcacaggaatgctataagaaaggcatatctatagaatatgatttgagaaaaaatgaagtcattatatgataacataaagcataaggaaggtaaaggatctaaagctggaaaatttaatgccagcaaaggatggtttgatgcttatagaaagaggtttgagtttaaaaatgtcaagatgacaggagaagccagctgttgctgaccaagaggtagcagacgagttcccaggcaccattaagaaaaccattgcagagaaaagatgtctgcctgaacagatttttaatgcagacgaaagtgccttattctggaaaaagaaaaaaatctaccacaaaagatattttttagtaaggaagaggaacaagcaccaggatttaaagttggaagggataggctaactctactgttttgtgcaaatgcattcaggtttatgatgaggactatctttatctataaagctgctaatccctgagccttgaagggaaaagataaacaccagctgctagtctcttggttctataagaaggagtggatgagaaccccttttctggattgagtccatagatactttgttcctgaagctaggaaattccttgctagtaagtgactgccttttaaagtttttttgatattggacaatccccctggcatcccagaaccccatgagttcaacaccaaaggcattgaagtggtcaccttgcccccagtcacaaagtttgtaattcagcctaaagatcagggtcataaggacctttagggctcattacacttggtatttatggaaaggattttcaacactatgcaagagaatcttaatagaatatcatgcaagtctggaagggtgacatcattaaagatgtcattgttgttatagaaaaagctgtgaaagccatgaggcctgaaacagtgcattcctgctgaagaaaaccgtgtctatatgttgagcatgacttcacaggatttatgacacaaccaatcaaagaaatcatggaagagattgtgaatgtagcaaaaaaggtgggagaatgaagggtttcaagataagggtttcagagaaatctaagagcgcatagcacaacagagtaattagcagaacacattttgatggagatgagtgcttctgaacaatgccagatgataaggaagtagacttagaagaagcagcgccagaaaacaaattgacattagacaatctggcagaagagttccagttattcaagactgctttgacttcttttaatgacatggacccttctgtaatatgatgctaaagctaaagcagacagtggaacaaggattagtactgtatagaaacatttttagagaaatgaaaaagcaaaacggcagacagaaattactgtgtatttccataaagttatatcaagtatgcctgcctctccagcctccccatccactacctccaccttttctgcctttgccatacttaagacaacaaaacaaacacctctcctcgtcctctgcttcttcagcctacttaacatgaagacaaagaggaagcctttttgatgatctgtttccactcagtgaatagtaaatatattttctcttatgattttcttaataacattttcttttctctagcttactttaagaattgttaagagaaaaagtgtagtggagttaacatttttggggagtgaaaacttatgcatagatttccaaatgcatgggggatcagcatccctaactgccacattgttcaagggtcaactgtctatgtaattgccaatgtgcaattgtttttgatcttcaaaaactggtttcatatggtttagattagtatctaggagagaaagtgctggttaataaaactgtttccccaagtgattatatgtttaccctcccactggtgagatgagagtttctttggctctacatcgttgtcaacattttttactatcatatttttatacttttgctgatatggtacatgtggagctatctcattgttttaatttgtatttcacttaattactactgcgatttagtatcttttcatttctttgtggaccattcacatcctttcctgtgaaattggtgttcatgattttggtcagtcttctattgcagtgtttaggaagcttactcttgttttgttttgtttgagatagaatctcactctgtcgccaggctggagtgcagtggcgcgatctcagctcactgtaatctctgcctcctgggttcaagcgattctcctgcttcagcctcccgagtagctgggattacaggcacgtgccaccacacccagctatttttgtatttttagtagagacggggtttcactgtgttggccaggatggtctcgatctcctgaccttgtgatccacccatctcggcctctcagagtgctgggattacaggcatgagccactgtgcccggccaggacgctgactcttactggaatatgaattgcttggtccaggttaataaatgtttattgacccaatccttggctttagatcggcttatataaagatgagtaagatggatggactcttacctcagtctatatttagtaaaggttaaacttaattggaagctccatagttctatttctttcctccattcaaatatagattagctacactatttatatctttacctttctgattcagtttactcatttgtaagataatcagctttgactagttaatatctagtttcccttttaccagtgtatgtaattcatctaatattttttcttgttggtttttgaaacttagaaatgtgttacttttattatagtggtaaatataaataattgggttttttttctttttcatcaaaaaatactgggttttgcttctgtaaggtataatttaagtcacttctccaaggacccctctcttagatggatttcccagacagatattgctacctttgattttaaaaattcttaaaatgctattaaacctatacactccatcctaatatatatgaattattcttcctcagagtgaagatacacaacagcaaatcatcagggagactttccatttggtatctaagagagatgaaaatgtttgtaatttcctagaaggaggattgtaagtaaagcatttcatagacatttctaagttttgactatgtgattaaaatatatactgtttaatcagtttatggtaaaagttttctacttttgattaattggattaggtgaattaattgccacctatgttagctataaatctaacttaaagaattatttttaaaagatatgcaatcttttttcctcttaaaaattttggaagggaattttatataaaggtaatatattaaatcgtaaaaattccaacattacagggaagtataaaatgtaaaataagaatctctcaaccttagtccttctacccaatttcttgtgtatccttctagaaaatagtttgtattgactaacatataaagtatgttatatgtgttgactaacctacaaccttaaaatttttatttatgagatcacactttgtatgctcatttgcatgttgctggttctcagtattttcaaaagctttgcatagaaacacatctaggacaagcttattctttttaatgactacagagtattcctttttgtgaatgttcataaaaattagattacattctttattttactgttacaagactgaagtctgtttttcaaatatacctaattcagctaatcaatttttctatttttaaaatgaataagaatattgccaaatattacaaacaaatacttttaaactaataacttccatgaaaatggtttgttctcaaacataaatcagtcagagaaacttagaattttctgtattttactgtgtatgatggatgagaaatactctggataacagggaatccatggtcataaggtactttttatcatgtggaacacttaacttgggtttcctgaaagattatatcatgctgtccttaaatgtccaatacatacttacaaattttgctgttaactcaaggcttctaatttaataattgagacaagtgtacctgcttctgtttttgaattttacttgtacttatttaattttagttgtctttgacattactatcacttcctctcatcctagcctcttgatttcttatctcctaggaaacttaccacccagcacagtgcactgcatgtaagaacttgattaatcttactagggtgctatttgaattagaaattgtggctggaaattgtgattgttcttttttaaccttacaaaaaatagaaagcaaatattgcagcagagatgaggcctcacatctagtttaatcctagttttgtcactaactagctgatttccttggacaggttacttaaattctcaggcctcagttttctcctctataaaatgagttatttggactaacaggatttctcagtcctgtggttttatatgatgtattacattctgtacaggaatttttgtcagtattatactatagcttaaagataagattatatttttaaaggcaaaatatgtacttgccgcattaatattttgcttgcttttaatagcattactggcctttttgaaacttatattcttcagaagtttgctgtccttttaaagtaaagcaaaagttttaagataatcactaaatcgctgattcagaatggagtaaagcctcctatttgtgttctttttgcctctttcagggaacaattgcagtcatagtctgtaaatatactctcagaatctttaaattgcatgtagatatttttaaattaaacatcttctctagaagagtatctagcatagtaggaaatttttattcttgtcaaagatcatttctccttttgctattagaagacatagaagtagtatataccttgggaagttgtttctacagaacttataagtttagtattatttttactgtgtaagaaatagatgctggccaggcgcagtggctcacgcctgtaatcctagcattttgggaggcctaggcgtgcagatctcctgagctcaggagttcgagaccagcctgggcaacatggtgaaaccccatctctactaaaagtacaaaaatcagccaggtgtggtggtgtgcgcctgtaattgcagctactttggtggctgaggcaggagaattgcttgaagccaggaggcagaggctgcagtgagctgagatagcaccattgcactccagcctgggtgacagagtgaaactctgtctcaaaaagaaagagagagagagagacagagaaagagaggatgaagggagggagggagggaaggaaggaaggaagggagggagggagggagggagggagggagggagagatgccattttcccatattctgttgggatggatgttagtttaattttggttacatatagccttgattgtaaattatgtaagtgtttaggggtcttttaagaaggtgaattcattattgtaaacttaactatgaaatagctaaactatatttagaaaaatatgtttggaatgattcctaaattattatttctaaaatactaaaattccagtcattataaataaaagtatttcatgaaagagtttagtatcttagctcagttttcttgcatttatgtcaaaacaatgtaattttggaagagatcttgacggtaaatctatccaaaacttaagaagtgtcattcttcttttttttctggttgataatcagtcttaagctgtgtaacttactgtgacgtatggagttaaatctagtaagcacttacaaatgccccatgatctaatttccgcctacttctctgactttatcatttactaatcttttcttatctactggccttttttctcttccctgaacatacatactttgttcttgatgaaatgtccttttagtacttactaccttagcctgaaatgctcttctctaaattttttccaagccaactccttatcattagatctcagcttaaatgccactcttgcttaatattcagcctgaagtagggaacccatcaatatatcatcattgtattttgattgtcagtgtaacacttgccactatctgatgatgttctgatgtgtgtgtttgttgcttcttccccactaccagtgcttggcacatagtagttactcagagaatagtttaatgaatgaatgaactgaaattaagcactggcttcttttacttgatgtttctgaagaaaacagccaccttaattcacctagtctctgaataagttcacttaaatactttgccattgaatgtcacctttcatttgacaagtggtttttaaacaaattgtcagtttgcttgagctaatgaaaatgattcgcattttgtttccaataacattacaatttttttgtcatttagattaattggaggatctgacaacaaactgatttatagacattatgcaacgttatattttgtcttctgtgtggattcttcagaaagtgaacttggcattttagatctaattcaagtaagttaacacttgcttcttactatcttaaataacagtttgacatttaaatttttaaaaacttatatattctaaattttctaaaatgatgttagtaagaaataaagcatttcataatagatattgtgttggtaaaagaggtcagaggacatagaaacaagcaaacatttgatctgattaaaactatcataactagtttaatcatgacattttatcttgctcatgtaagttacagcaaggagcttaagactcgtgggtttcttaacacatgtatccaaaactaaccctaaaccctacctctccctgtctcctgaaaatctttcataatgtccctggaactcaaggtcagtcatcagcaaatttctttttatcttcagcctcttctgttaatattactttacattttgctctaaattaaatcttgcttccctgatgatactacgtgcaaccctttgaagtagtggccattttctctcctgcttctttctgcctttgagcctggaggtgtaatcttagcttctcattgcattttccagaccattctttcttctcaaacacctccaaattttatcttatgttatcagactataccaccttctatccatttagttatagtcatcactcatctccatctctccttcattggagattttgttaagaattgtgaagggtctgagatttgctctacttgcaaactaagaagttaacctgccataatttcatggatgctggcagaaggcaggagatttctgggccagagacaaaggaccttattactaatagcaaaaacattagctaaagtgacagcatttgcttgcacgaattctctaattcccaaagggtgatatgaagaggtccagatgatacctgcacacacagtggattaaatgacagatgaggaacgccaagtttagggaactggaatcttttataatggatactaagcatgtctgcccttgtttggaaggaagactgtctcttccaagagtgtaaggaaacctatcctttgctgtggaagaagacactgtctattttccagggctgtttgatatacaagcatgcttaaaaagatagcccagaacaaagacagtcaatgcctctgctcacaatacgtgtggaaacacaagatccatctaaaattgtctcctaatagattttggttcttggttccctggcattcattccagtactgcttgttttgtaattcttggtgattccattgttcatatgtataattctcccaatatcctggtgtcttcaaaatctggaactcctctcttccaataaattttgccctccactccatctcactatgtacccatttctagattttatctttgtctaaactgtaacccctccataatctcaatttcacagttttgaagtcgttagacctattgcaaccctcagttttaaaaatccatcatttttttcactctgattttactgatgtcttactttccttatccagcttaaatttcataatcatggtagtgatatagccttgtgtacactgaactccttgcccacacccatacatctgaacatacctagaggaaaaaaaaaagtaaccatatttaccagtctcactttaaattaatgatcccttagctcattgagtcctttatgctacgcaagaatcattttctgtttccccggtccatttactctcccatacctctagatgactactcatacagtctcctctctcctaaaatatctagcacttctagcaccttgcttcccagtgcacagataaaattggcttttgaagttagcaagaaggtggcatggtttgagctctagttggcgttacagaatagacaagaaattaacccaagcagacaacttaggtaacaaattcttagcactgtggctaaggctttaaaaataaaaacattgtggccaggtgtggtagttcacacctgtaatcctagcactttggaaggctaagctgagcagatcacttgagcccaggagttcgagaccagcctgggcaaccccatctctacaaaaattagacaggcatgctgttctgcacctgtcgtcccaatcacttgggaggctgaggcgggagccagggaggatggcttgtagtgagctgagattgtgccactcactccagcccaggtaacagagtgagaccctgtctcaaaaaaaatagaaataaaaacattgttaataaaataaaaaaggagataaatgataaattgatctatttgtatgccatattactcttaaatctgtaattcttaaactgggtttttgggaggagctgggtatcaaagttacatgaaaccacaaggtaatcatggcacatattcctggtatatgtttcttctttgttttgaagattggcggcagtgaggaaatgaacgtaaacatgtatatattatgaggtagaatacaaatttttcataatatttaaagctctaagtggagacttgaaagaaattttgagcttgaggtaaaggtgccccaagatcccttgggtatatgttcactttcctcctggggcctacttgagaaacactgctgagttatgttttgctttctcaaggcttttctagtaaagaaaaagaagccaaatcttacttttgatgacattgaagggttgatcaggactatatattgcattgccttgtaactttgtttattcttacatttcttagtttatcccacctaggggagtagttaattcattttatcattatgtcaagagagcattatatttttacagaaaaaaaattaatatagaaccatgctttctatttctctgtttcccatgactgaagagagtggtagacatgcacactatgttccaaaacactgtttttatttacctgagcctagccactagaattacaggaagaaaaacaggagaaagtgtaccatttcaaatttagtctcttattgaagagaaatgttgctattaagaaagaccaaaacaaatgtgtcttttcctagaggtaaatcagaagtattttatgcttgcgtcctgagattaagtcatcaccattgattattattttgatgctgttgttgatcttcttatgagaaagtagttctatctccaaaggggattagatggggagttttcaaagaacaaacatggtattaatatatcatatccaaagtaaattctgtcatgtactcgtggaaagtagaaactatcttttgtgttttgcaaaattttttatccatgcttcacacgttgatcacttgttttgatattagataacatacagaagaaaggatttcaggaggactttgtcattttccgattactaaagtaggctagagctgtttttacaatacccctgagttaccacatgctgatgtattgtgtcacaaaaaagaagatttctgtaattcaccttataggtactatgtctgtcactatcaggaacatgttggaagttctgtggttgtgatctttccccttcaattaccacagttcattaaatactgaagagggagtgtactgagcacacatgagtcagtcactttaaaaaacatcagttgaataaacaaagatggaagtgcatagcttattatttctgcttctgtttcatcaaatagctattcagagagaactgattttcttaatttgttcatcctctagtttttagaaaggcaattttaatgtaaaaagtaaaagtggaaaattataaaccaagagagtttacatcaaaacctcttggtcttgcatattcttttagagaacagatcaagaaaactcaatatgtaactattaaacctatgcttataattttgatattttaaatatcaaagtgataccattcatataactggaagcatatattttaatgcagagagttagtgtctctaaggtatgcatatgttgtcccaaatatgactttgtatctgtataaaatctgggagaaggcattattaataaattcgttatggaatttacaccgctattccaccagtactgaatttacattggtagtccacagaatttacaccagctacccaaacgaatgatcagtttttgttttcttttgtttctttttaaaaattccttgtaagtttggaaaaaaggggtggacttttttttattgatatataccattttagtgtgatattaactgctatgtatgccatatatgctagagttaatagctagctttttaaggagtcctttctgttgtagcatattgttattggaagtgttaaaatatttacaggatgagaatagaagtttattaaatattaatgttgggttgagttatttataagcagttgtattgtccttaattagtttattatgccaagctgataatggaggcatataaattcactggataattccaaatctctgttacagttttctgtaccacatgtaacagtaatcagagcatcagtcttattcagttgtagctagattaaaaaaacaacaaaattgagaactaacagctaaactttctttaggtttagaaagatacgttctgaccatgttgttagaatgtatatttaaactggagctccatatataatatttgttattattacagtactgttaaactaccttttgaggaattattttattcatggctgctaatgctcatttagtatgatgttgagcaagttatttattctttatagaccttaattttttttttaactttacatgcttgtttcaacatgttgcctacagacaagaggttgttagaaagacctgtgaattaaagctatctattatcttgtagtggttaaaaccatttagctctgccatatactatgtaattttggcaagttatttaacctctttgaccctaactttcctcatccacaaaacagggataataataataacaccaattcacagagtaggtgtgagcgttaaaaaaagatatttcatgtgaaacccatgactaaatgattaacatttcagtggtttttagctaacattatcactaaagcatatatttgtaagaaaggcatataaaatattattttgttagtacacaaactgaagtaaatatgtttttttttaatctttctgactttctcattgttagaagcatttttgaatctttttatcctatatgttgtttgatggcttggaatgaattttatatgacacatttatgtgataagaaatagtcttcattggggaaatttataagccaagaatacttaagtgaggaaaggtctctgatcttcccagcatcacctggcaaattatggcgaggtaggtacttctgaccgactgaatatacagtggtgtgccgatgaaggcccacccaattatggttctcatctatcatgatggtaggcctgaaagcacacttggtggtggggtgacagatacactgtttaagccttgggctatgtaggtttgggtaccacctgttttttaaaattgcctaggaaaaccgactgtccagcacttggaaattgtgggaatttgcaactctcctgttggagatgaaccaactcttggtcccagaggaagatgagtttctggtgcagttcctcctgctggagcaagagggattcctggcctagcgagcttattttccaggcactcaagtgaatgcccaggatcattttaggaaaattctgcctcctacattatactgtattaccaggttatttaaaactttctgttttcagtaagatttgtttctcatgtatttttgggcaacccccagtttttttaaaatagtttgggtcagattgttagagttgtgcaggattcctaaaattattttcctgtgttattttcatgcttgagaagtctgatttccagcaattgcaaatataataattctcagttatttacattgctatttgtgacaaatcctggtatcaaatttgatgataactgcttttctaatttacatgtttcattgatgtcttagcagttcttttaggaggcatcatggcgtcaggtttagagtgtcagggtgttagagtcaggtagtatggatttgaatcttggctctgtcacataacagttatataactttaggcaattacttaacctcatctgtccccagttttcttttttgtaagtgctgatattcatacttatctcaccagcattgttgtaagaattagaactaatttatataaacaatcagcaaatggtctagaatatagtagacacgcttttcttagttacttcacagtagtgaaggaagtagtttagaactcaagtgcttaaagtcagagttttggagctggaagtgacttaaaatttattttcttcccttcaatgtaggtttaagagaaaaactcaggttatgttggtctttttctttgatttaaggtaaattcatcatgtcctaatgtagaatggttggttttcaggaaggaattggacatggtggagagactccccaaatttaacattaaccacagtacagctattaacccaagaaattaacattgatacactactatataatctgtaggccttgtttacaatttgccacttgtcccattcaaatgtcctttttctcattctggatgtaattcacacattccatttagctgccatgtcttcttaatctcctttactgtgtaacaattctttaactttgtctttcattcatgtctttcatatactgatccttttgatgagtactagccagttattttgatattccccaatttgggtttgtttgatacttcttaatgatttagattgtgcattttgggcaagaataccacagaaataatgttatgtccatagtgcatcatatcaggaggtatatgatgtccatttgttccactacttgtgatatttgtgatgatcacttggttaagtttgagtccaacaggtttatgcaccataaagtttcattttcccatggtgctagtatttttatggggaatatttgagactatgtaaatatactttttctagtcatatatttgttaattcatcttaatatctattgatcattcttacctaaaagaattattaatatttatggtgtttaccaaatggtggggtttttttctatcatacctcaatatttaatagttgaaattctcctgtgaggaaaagctttgtaatatatatatatttttattgtactttaagttctgagatacatatgtagaaggtgtaggtttgttacataggtatacacatgccatggtggtttcctgcacccatcaacccgtcatctacattaggtagatgtaggacagcattatcttctaatgctatccctcccctagccctccaccccctgacaagtcccggtgtgtgatgttcccctccctgtgtccatgtgttctcattgtgcaactcccacttatgaatgagaacatgcagtgtttggttttctgttcccgtgttcgtttgctgagagtgatggtttccagcttcatccatgtccctgcaaaggacaggaactcatcctttttatggctgcatagtattccatggtgtatgtgtgccacattttctttatctactctatcactgatgggcatttgggttggttccaagtctttgctattgtgaacggtgctgcagtaaacatatgtgtgcatgtgtctttatagtagaatgattcgtaatcctttgggtatatacccagtaatggggttgctaggtcaaatggtatttctggttctagatccttgaggaatcaccacactgtcttccacagtggttgaactaatttacactcccaccaacagtgtaaaagcgttcctgtttcttcacatcctcgccagcatctgttgtttcctgactttttaatgatcgccattctaactgaatgagatggtatctcattgtggttttgatttgcatttccataatgaccagtgatgatgaggttttcttcatatgtgcgttgactgcataaatgtcttcttttgagaagtttctgtttatatcctttgcccactttttgatgggattgtttgctttttccttgtaaatttgtttaagttccttgtagattctggatattagccctttgtcagatggctagattgcaaaaattttctcccattctgtaggttgcctgttcactctgatgatagtttcttttgctgttcagaaactctttagtttaattagatcccatttgtcaattttggcttttgttgcaattgcttttggtgttttagtcatgtagtctttgcccatgcctatgtcctgaatggtattgcctaggttttcttctagggtttttatggttttgggtcttacgtttaactctttaatccatcttgacttaatttttgtataaggtgtaaggaaggggtccgctttcagttttctgcatatggctagccagttttcccaacatctattaaacagggatcttttccccatttcttgtttttgtcagatttaccaaaggtcagatggttgtagatgtgtggcattatttctgaggcctctgtcctgttcccttggtgtgtatacctgttttggcaccagtaccatgctgtttgggttactctagccttatagtatagtttgaagtcaggtattgtgatgccttcagctttattccttttgtttaggattgtcttggctgtacaggctcttttttggttccatatgaagtttaaagtacttttttgtaattctgtgaagaaagtcaatggtagcttgatggggataacattgaatctataaattacgttggacagtgtggccattttcacgatactgattcttcctatccatgagcatggaatgtttttccatttgtttgtgttctgtcttatttccttgagcagtagtttgtaattctccttgaagaggcccttcacatcccttgtaagttgtattcctaggtattttattctctttgtagcaattgtgaatgggagttcactcctaatttggctctccgtttgtctattattggtgtataggaatgcttgtgacttttgcacattggttttgtatcctgagactttgctgaagttacttatcagcttcaggagattttgggctgagactatggagttttctaaatatacaatcatgtcatctgcaaacagagacagtttgactttctctcttcctctatgaatacagtttatttctttctcttgcctgattgccctggccagaacttccaatactgtgttgaataggagtggtgagagagggcatccttgtcttgtgccagttttcaaagggaatgcttccagcttttgcccattcagtatgatattggctatggttttgtcataaatagctcttattattttgagatatgttccatctatacgtagtttactgagagtttttagtgtgaaggggtgttgaattttatcaaaggccttttctgcatctattgaaataatcatgtggtttttgtgactggttctgtttatgtgatggattacgtttattgatttgcgtatgttaaaccagccttgcatcccagggatgaagccgacttgattgtgttggataagctttttgatgtgctgctagattcggtttgccaggattttattgaggattttcgcatcaatgttcatcagggttattggcctaaaattctctcttttttcttgtgtctctctcaggctctggtatcatatcaggatgatgatggcctcaaaaaatgagttagggaggagactctctttttccattgatcggagtagtttcagaaggaatgataccatctcctctttgtgcctctggtagaattcggctgtcaacctgtctggtcctgggctttttttggttgttaggctattaattactgcctcaatttcagaacttgttattggtctggttcagagattcgacttcttcctggtttaagtcttgggagggtgtatgtgtccaggaatttatccatttcttctagattttctagtttatttgcgtagagttgtttatagtattctctgatggtagtttgtatttctgtgggatcagtagtgatatcccctgtataattttttattgtgtctatttgattacccttttcttctttattagtctggctagtggtctatatattttgttagtcttttcaaaaaaccagctcctggagtcattgattttttgaagggtttttcatgtctctgtctccttcagttctactctgatcttagttatttcttgtcttctgctagcttttgaatttgctcttgcttctctagttcttttaattgtgatgttagggtgtcgatattagatctttcccgctttctcctgtggagattttagtgctatgaatttccactgaaacactgctttagctgtgtcccagaaattctggtacattgtatctttgttctcattggtttcaaagaactcatttatttctaccttaatttcattatttacccagtagtcactctggagcaggttgttcagtttccatgtagttgtaaggttttgagtgagtttcttaatcctgagttctaatttgatagcactgtggtctgagagtctgttcattatgatttctgttcttttgcatttgctggggagtattttacttccaattatgtggtcaattttagaataagtgtgatgtggtgctgagaagaatgtatattctgttgatttggggtggagcattctgtagatgtctattaggtccacttggtccacagctgagttgaagttccgaatatccttgttaattttctgtcttgtggatctgtctaatattgacaatggggtgttaaactctcccactattatgtgggagtctgaatctctttgtatgtttctaagaacttgctttatgaatctgggtgctcctgtgttgggtgcatatatatttaggaaagctagctcttcttgttgggttgatccctttaccattatgtgatgcccttctttgtcttttttgatctttgttggtttaaagtctgttttattggagacaaggattgcaacccctgcttttttttttgctttccattttcttggtaaatattcctccataccattattttgagcctgtgtgtgtctttgcacgtgaaggggtcttctgaatacagcacactgatgggtcttgaccttttatccagtttgcccatctgtgtcttttaattagggtatttagcctgtttacatttaaggttaatattgttttgtgtgtatttgatcctgtcattatggtgctagctggttattttgcctgttagttggtgcagtttcttcatagtgtcaatggtcttcacaatttagtatgtttttgcaatggctggtaccggtttttcctttccatatttagtgcttccttcaggagctcttgtaaggcaggcctggtggtgacaaaatctctcagcatttgcttgtctataaagggttttatttctccttcacttatgaagcttagcttggctggatatgaaatgctgggttgaaaattctttaagaatgttgaatattgacctccactgttttctggcttacaagccagcagggtttctacagagagatctgctgttagtctgatgggcttccctttgtgggtaacccaacctttctctctggctacctttaacattttttccttcatttcaaccttggtgaatctgacgattatgtgtcttggggttgcttttctcgaggagtaactttgtgttctctgtatttcctgaatttgaatgttggcctgccttgctaggttggggaattcctcctggataatatcctgaagggtgttttccaacttggttccattctccctgtcactttcaggtacaccaatcaaacatagatttggtcttttcatgtagtgtcatatttcttggagacattgtttgttccttttcattcttttttctctaatcttgtctccaagctttatttcattaagttgagcttcaatctccgatatcctttcttctgcttgattgatttggctattgatactgtgtgtgcttcatgaagttctcctgctgtgtttttcagctccatcaggtcatttatgttcctctctaaactggttattctagttagcaattcctctgaccttttatcaaggctcttagcttccttgcattgggttagaacatgctcctttagctcagaggagtttgttattacccaccatctgaagcctacttctgtcaattcatcaaactcattcaccttccagttttgttcccttgcttttgaggaactgtggacctttggaggagaagaggcagtctggcttttggaattttcagactttttgcactggtttttcctcatctttgtggatttatctacctttggcctttggtgttggtgaccttcagatggagtttttgtgtggacatccttattgtccttgttgatgctattcctttctgattgttagttttccttctaacaggcccctctgctgcaggtcttctggagcttgctggaggtccactccagaccccgtttgcctgggtatcaccagaggaggctgcagaacagcaaagattgctgcctgttccttcctctggaaggttcgtcccagaggggcacccgccagatgccagccagagctctcctgtatgagatgtctgttgacccgtgctgggaggtgtctcccagttaggaggcacgggggtcagggacccgcttgaggaggcagtctgtctcttatcagagctcgagcactgtgctgggagatctgctgctctattcagagctggcaggcatgaacgtttaagtctgctgaagctgtgctcacagccaccccttcccccaggtgctctgtcccagggagatgggagttttatctataagcccctgactggggctgttgcctttctttcagagatgccctgctcagagaggagtaatctagagaggcagtctggccacagtgactttgccatgttgtggtgggctctgcccagtttgaacttccaggtgggtttgtttacactgtgaggggtaaaccgcctactcaagtctcaataatggcagacgcctctgccccgactaagctccagcatcccaggttgacttcagactgctgtgctggcagcaaatattcaagccagtggaccttagcttgctgggctccatggcggtgggatccactgagtgagctagaccacctggctccctggcttcagccccctttccaggggagtgaacggttctgtctcactggtgttccaggtgcctctagggtatgagaaaaaactcctgcagctaggttggtgtctgcccaaacggccacccagttttgtgcttgaaacccagggacctggtggtataggcacccgagggaatctcctggtctgcgggttgcaaagaccatgggaaaagtgtagtatctgggctgggtggcaccatccctcacagcacagtccctcacaacttcccttggctacaggagggagttcctcaaccccttacgcttcctaggtgagatgatgccccaccctgcttctgctcaccctttgttggctacactcgctatctcaccagtcccaatgagatgagccaggtacctcggttggaaatgcagaaatcacccgccttctgcgttgatctcgctgggagctgcagactggatctgttcctattcggccatcttgccatccacctcctttgtaatatttttactcttttaaagtcactgctcaaaatatcaatcataccatattcaactataggtagaagaatgtatttttaggcgaaataccattttaaaaatcagcttttgcttgggagtttaaatatagttttgacaatttatatcaatatgagctttaaaaaatgttctcaggagtagttttgtacacagaaagaaattattcagaggttactttcagttttaataatacttattaaccttaacaaattcataaacccggttctttcttagaattctaaattcaacatacaaatcaaattaagtcgcttaaatggagggactgaaacaattaaatttcctatagtacaagcactcctcactttgcagattaccatggtaataattcatgtttatagaaaccatgtttatcactttgcacagttcagtggttgctgagatctattaatgtggtaccctataaaacaagcagtgcctgtattttaaacggaatttatatatttaatatgttttatttttatgctcatattttggcatactttctcaaatttttaaatatctcttaatttttagaagttcatatattatggttactcttaagttatcttaagtattctaatagtgtaggcaaattttcctttacttttcagcttaaaaagtcaggtggatcacgaggtcagaagtttgagaccagcctggccaacatggtgaaaccccgtctctactaaagatacaaaaaattagccgggcatggtggtgcgcgcctgtaatcccagctacttgggaggctgaggcaggagaatcacttgaaccccaggcggggaggggagtggaggttgctgtgagttgaaatcacacctttgtactccagcctgggtgacagggtgagacttcgtctccaacaacaacaacaagaaaaatcccattccaattggatattcacgtttacatagatttataaaagcctagtctgttaagtattcttacaataccacattttttaaggcttaagtatttaaatatcaactatacagagtctttctaaacttaacatgaaaatattaatattataggttcacatcataatttctgttactttaaatttttctgggttaaaaaatcacttaactagtaaggcaaccatttttttttcctagtttctgaggttattacatgttgacttgagaggccctggcctgatcccaagactgattctttactaacacactgataggaacactgatacagacattctatcacatagaaaaatggttgatctcagagttcttcctgggttgaaatcatagccatataacttaatattatgaacttaactattattacttctttctacttccagaagtctgcactaacatgacggccagcataatttaccatgttagttgtatttccatttcttctgctttcttgagatatttcattatcttcctcctggttccaaagacaacattaatgactttccatttgtattagtcagtgttctccagagagacagacctgacaggatatatgtatatatgaaggggagttagtttattagggagaattggctcacacaatcacaaggcaaagtcctacaataggccgtctgcaagctggggaagaaagaagccagtagtggctcagtccgagtccaaaagcctcaaaaacagggaagccaacagtgcagccttcagtctgtggtcaaaggccagagagttccctggcaaaccactggtgtaaatccaagagtccaaaggctgaagaacctggagtctgatgtttcagggcaggaggaaccaaaggaagcaatcagtatgggagaaagatgaaagccagaagactcagcaagcaaggttatttaaccttcttttgcctgctttgttctagccacgctggcagccagttggatggtgcccacccacattgagggcaggttttcctctcccagtccactgactcaaatgtcaatctcctctggcaacaccctcaaagacacacccagaaacaatactttaccagctatctaggcgtccttcactcaagttaacagctaatattaaccatcaccgtgttgaatacttttgttaatttattttgttctccttaaattttatcatttgatttaggtggatgaaatactttaaagaatggtgtgaaaagcctgtgtttgtagttagttctttttctatttcttcacttaaaaggaagttttgaatgagattttaactgttaacagtagatttatgtgggtgctgtaagtatggacagttcaaatttttgctttatacttttctgtattttccatattttctaaatgatcacttcttactacattagaaataatatattatttgttgttgatgtgggttctggaattagatttttgagatttgaatcaggactctaccattaagtgttagtggttaaccttttgctttagattactcttctgcaaatggttgatgataaaagtagttgccttatgggattactgcaaaggctcaaataaaataatatacttaaagcagtcggaacagtggtaatgccacaatactgtgtagagttgactcttgaacaacacaggtttgaactgtgtgggtcaacttatacacagattttttaagataaagattacactgagtgtacctgcctctcgtgcctcccattccacctcctccacttcttccacctctgccacccctgagacagcaaaaccaacccctcatcttccttagtctactcaatgtgaagacgaagataaagatatttatgatgaaccatttccactaaatgaagagtaaatatatgttctcttccttatgattttcttaataacatttcttctctagctcgttttattgtaagattgcagtatagaatacatataacaaaaaatgtgtactagtcgactgtttatgttatcggtaaggcttctggtcaacagcaggccattgtagttaggtttttagtgagtcaaaagttgtacgcagattttcaactgtgtggagagtcagcatcccaaccccactgttgttcaaagatcacctgtaccaagtaaatgctagctgttattataattaactttctataaatcacagagaaggaatcattaatgtaaactctttcagaattattatgacatgatatagaaggtagatggtcctttcttcagctcttaatttctctatattgacgttgagttcattatgtgttaagtgcatggtacatagtaaatgcacaataaatgactgtttttgctaacattgtcatcactggcatgtgagtgtccaagtgaggtttaatagaaatccagtccagaatgcagtcatatattgagtcaagtgctatttacatatcttaaacaccatactttaaagattcttaatagtacatgcagtgggtacctattggagagtgtacctaggctacattcataattgttcttcaaaggtaaatgatgtgattttacgttcagtttgtcttccctagctctgctggtacattcaatatttgtaatggtattttttagttattggtttgagttaaaccaagatatttctctctagaacatcttgctggtgataaaaaaataattttttggcttcagcatattagtatccttaaatttatgcctcctatttttgcactaaagacttttcgtatcttataacatgtcagtgtaaccctttttttttttcatttattattgtagattcaaaacagcaggatctgtttctcctgaattttaacagaaatttctaaacccagaaaccaatttttttttttacttagaaactcaaaaaggggtctgccaaataagtggtattgtttaagggtaatttgtggtatttttattttatcttgtgtacatttttatttctccgtgtgtttggtattataatactagctaatgtatattgagtgttttcttttgtgagacattgttgtaagccctttatatttattcatttaatcactaaaacaactctatgatatagttaccattattatgcccagataagaaactgaggcttagtgttaaataacttgccctggatctcagagttagaggcaaggctagaatttaagtatacacatgctaaagtttgtgctcttgagtactaactacaaagctgtcatataatagatacctgttactctttgtggcctggatgtataggttactctttgtggcttggatgtaaagataaagaaaacacaagcatgttttataactagaatagcatgggaaaggaggactctttatatttggaggaggcatttttcgaaatctatttactttttatatttattttttgaatactaggtaattaaaatgcaggacaatttaaaatattattctttttgtaaattggaagtaatttttctcccaccagcttttgaattccttgaggacagagtttaggtctttggttttatatccctggcacctgagtagctactcagtagtagttagatacctgttatattgaaattggctttaaactttatatcattttaaagttgaagcacaagagggtgctgtttactatgatacttctaggtcttagctccttttatctttctacttgtgaaataataatgcaacagcaatttttttattgttgttatggttagaaccatcgagactctaatttttcccccttaatttcttcacttcagattgtcagttatttgttttttgttggccttgtgcatgtaacagatcatcagtgtgtgatggaccttagggctctagatttctgatgatattaaataatttttgctaaatcaaaagaaaattagaaagtcttttgaagaaggtttgttgattttttaaaactgaacagagtatctgagtgctttaaattttaagaatttttttcataaattaataacatgcagttataatgacattttgttgcagggtactttttttatagtattcacatttttttacatgtgatattgttctggattaaatgtggacagcatttttttcttcctaagttaacaaattacagtgtcttggtagttgtggcatgtagttatcttccttttatatcagtatttatcagcagaattataattttctatttctattttaattttataattatcatgtattttgaacagccagataaataattctggctgccatttattaaatgggtcttcggaactgtgctgggcactctatctaaattgtttaactcaatttttatgataatccagaaaagtaagtagttttatctctatcttatagttctgagatttaaaggagttaaatgatacttgaggccacagagcagggatttgaaggcatgtatgtcttcctggtttcaaagcatgtatcctcaacacagtactgtgctgcctctataggcaacccatgttttttaccactccatactttaccagaggcacacttaatgctatcacgaacttttttttcttttttgcccaatataatctgcacatttagtaggttctgctgatcttttataaatacatgtaagtgaaggggaactatttagacagcatttttaccaagatggtcttctcatggttaaaaaagtatgactgcaacatataggtaatcaatggaactagaaaaattaagaaagaaaaaataaaggcatactggaaattgtattctgattagtaaatctaataatgatttaaaatcaagtaagaccactccacgtcatacacagaaatcaatttcagataaatttggtccaaacatgaagagtaaaataataaagcttttgttttcttctgagtgaatctctttcctgaccttgctgtaagccaagattccttaaagtggacataaaacaatgttaactacaaagaagaaaactgaaaaattggattttattggaatggaaaaattctgttcttccaagggcactgttaggagaatgaaaaggcaagccacagaactggcaaaggtatttgtaatacatatgacaaaagactgtagctagactatataaagaattcctatacatcaataagaaaatacagacccttgtaatcccagctactcaggtgtctgaggtggaaggattgcttgagcccaggagtttgagaccagcctgggcaacatagtgaaaccatgtctttaaaaaaaaatgataaaaagaccaatagaaaatgagcagaaatcttgaacaggcattatgaaaatagatatctaaatgggtaatacaaatgaaaaggtacgcagtcttatatcagagaagtacaaattaataccatcatataccaccacacacccttgagtatggttaaagttaaaagatggataacataaggtggtgaaaaggctatggaactacagaaactctcatatactgctatttaaagtctaagtgcgtataatcgttttgaaagtctatttgacactgtatactaaagcttaacctacacgactctttgacctagcagttctactccaagtatacaatcagtagatatgtgtatacgtatatatatgttcactaaaagatgtgtaagaaatgttcttaacagtactaattgtaatggcaccatactggaaacaacacaaatttatgtcaccagtagaatggacacactgtgatattctaattcagtggcatactgtacaactaagaatgattagctgttgtattatgtaataacctgaataaatctcacaaaaaataacaatgaataaaagaagccactcacaaaagagcatgtatcctataatctcattttaatatggttcagacatagataaaatgtattcatagtgttaggaagttgggtattggttacctttgatggttgataagtgactgatggactctgagaaggcttctataatgctggtaatgttaaaacatgatttgagtgttgattatacagaaaaatttatgttatatgttatgatttttgtacttttctatgtgtatgttacacttaagtaaatacttaggtgggggtggaacttaagtggctttattttccataacttttaactatgattttctaaataagtattcaaatgatttctaagttaaagactattttaaaagtaaatattttcttctttctcaatggaaatgtcaccagtaacttgagttgtttccggagctctggtatcatcccaggctgtctagtttctttaagcagatgtgcccattaataggggtctaggaaaagacctttcccagctgtttcatcagggctgccctggtaacagtgaaaattttcctctcttcactcctattattactctctccaaaaagttaatatttgttaattgcttactctgtgttcaagcagcattaccccattcagtcctcataacaggagtctgttgtatcaaagaggaaaaatgtatctgaattagttagaaatagaatgagtaaagtcatttcaggcaccatgtcaccagggccttgaggagaaatagataaagttgggagtttgggtggatactaaatgatactaattttttacctaccaaaaaattaaactaaaatctcacttgtggctgacctgttgtaaagggaacatacaagattttttttgcctctacttccacagtcactcagtacaatacatctgacaccagatatttgggagtttgtcccccacacaccaagcagttctcctgctgggtgtcctgtaattcagtgctgacagtatctacgtggggatagtatcagatcccatgacacagtcccacaaggctgcccccacttcagatgccagttgcaagtagtaggttgtgacctgtacttttgattgagtgatggtaaattgggattcttgtgacccccctcctcagtttgattaatttctcagagcactttacagaactcaggggaacacatttacccacttattataaagaatattacaaaggatacagatgggtgggaccctcatggagaacctctactagggcagtgtggaagggaaatgtggggtcagagcccccacacagagtccgtactggggcactgcctcgtggagttatgagaagagggccatgatcctccagaccccagaatgatagatccactgacagcttgcactgtattcctggaaaagccacagacgctcaacaccagcctgtgaaagcagccaggagggaggctgtaccctgcaaagccacagggttggagctgcccaaggccgtgggagcccacctcttgcatcagagtgacctggatgtgagacatggagtcaaaggagatcattttggagctttaagatttgactcccccactggatttcagactttcatgcaccctaataatttaaccaaaaaatgggcaaaagatttgaatagacatttctcaaaagaagacatacaaatgccaaacaggcatatgaaaaggtgttcaacatcattgatcatcagggaaatgtaaatcaaaactgcagtgagatatcatctcattccagttaaaatggcttatttgcaaagtcaggcaataataaatgctggcaaggatgtggagaaaagggaacccttgtacacttggtgagaacataaattagcacagccaccatggggagcggtttggaggttcctcaaaaaactaaaaatagagctaccataggatccagctcactgctgggtatatattcaaaagaaaagaaatcagtgtgtcaaagagatatctgcactcccatatttgttgcagcactgtttagaatatccaagatttggaagcaacctaagtgttcatcagcagacgaataatggataaagaaaatgtggtacatatacacaatggagtacgagcaaaaagaatgatattgtcatttgcagcaacatggatggatagaactggagatctttatgttaagtgaaagaagccagacacagaaagacaaacatcatatgttctccttacttttaggatctaaaagtcaaaacagttgaactcatggacatagagagtagaaggatagttgctagagacttggaagggtagtggagggttggagaaaggtgaagatggttgtggagatggttaatggataaaaaaaatagaatgaataagacctactatttgatagctcaatagggtgattatagtcaataatcattgaattgcacattcaaaaataagtaaaaatgtataattggattgtttgtaacacaaaggataaatgcttgaggggatggataccccattttccttgaagtgattatcatgcattgcatgcctgtatcaaaacatctcatgtaccccacagatatatatacctattgtatacccacagaaattaaaataaattatagctagacaaaattaactgtatatattaactataataattttgttgtcacctccttgtggtgaggtcaagtgttttgagtatctgcttaaattgctatgtcctgctaataatttccccataagcaaaaagtaatcccttctggttcttgtgtatttttcatcatgtttactcaatatcgtaatccttgaataacaccacagtaactcccataccaagtgccactagcgatggtggaagtgcccccaagaagcagagagtgtcatgacattaccagcaaaagttgaatcacttgatatgtaccttagattgaaatctgcagctgtggttgctttccatttcaagataagtggatgtagcatatagaccattgtacaacaagaaaaggaaatttttaggaaatttcatgaagtcgtaccccagcaggcatgaaaacgttatttcacattttttgcgaaatatgaaatatgtgttaatcaactatgtcattggtaaggtttccatcgatagtaaactattagtagatttggggaagtcaaagttaggcatggattttcaactgcctggaaggctggagtccctaaccctacgttgttcaaggatgaactgtagttacatgtccacttagccatctaacattgatgccaggaagaaaccttagattgtggatttgtagaaacgtgccctacataggagcaactatagcaagaagcctcttgtttacattttacccctttccccataggatcacctgtgaatagtgggatgactattcatttcaataaactagggatagtcctggtttatagctgttgttccaggctgttattacattataataatgttgcatactattatataatttattattaatagctgttcctttttacttttaatactaccccatttaggataataaattacatggtccctttatcttaagttaccactgaaaagggtggtgagaatagaaatgggaatagaatagtcagtgacaactatgcaagttggaatttaagagattgatttttgaaggtttgcatcagagatcatcaggatcatctcaatgatttactgggatgcactggactcagaagttgctatatgcatgctatggtttattatagtgaaaggatacagagtaaaatcagcaaaggcacatgggatgaagtctggaagactccagttgcaagctgtcaggtgttcctttctactggagttacacaggacatgcttaatttcccccaaaatatgtcataatgtgtacagagtattcccaaccagggatgtttaccctgggggtcagtcacataggtatgtcatgcctgcatgactgaccttggctacttaagcttcagatcctcggagaaaaagcaggcattcactataaatcacattattaacatgaagtacctgctcaaattggtacagcatggcccaagacctccagcatacaaaaacactctaatcagacaactttctgaaaggttggagcttagttctcaggagctggccaagggctagtcctgaaaacagtccatttatgggaatgtgcagagtttgagcaacgcaagcctgctgaggtgactcttcccacgaggtcatacaagttattcagtttagagtttggacccaggtaagtctgattccaaagtctgtgctttttcgctaagtagtttttagtggtcttttatactgatttgataattaaaaattactggctgcattagatatagtagggacttggactgtgccttacctctcttgatggatatttcctaatgagctttcttccccctcacattaaaataaggaggcttagttgagtatttttaagtgcttttgtaagaaatggtgctaagactttctagttttagtccttttcaaaaaaagtttgttttctatacttatgtattgaaaagtaatttatctgtagttaaacttggtaggactctattctttttttactttttttgcattaatacaatttttagtttgaaaaagataaatgtataatacaaaattttagttcataattaagaattgccttccttatagataatagttttgaataaatttaaacagttcttaaaaccttttttctttttccataggtatttgtggaaacattagacaaatgttttgaaaatgtctgtgagctggatttgattttccatgtagacaaggtactatttgtattgtcacatctaagctttttaagaaaaacattaacttataattgtcatagcaaaaatggctttaatgaataattctatttttattcttttattattcaattcataattttttttttactatgagccaggctttgtgcttggtggagaagattcagatcctgccttagaggagttcacatcgaagggtggaaacaacggcattaacaaataataataatagtatgtgtagcatgttaatggggacacagctgaaccacttacctctgcctaggagactgtgaatggaggaaactacatttaaactggatttttaagggattagtagatatatcatacatagaaaaggagaggatggtcctactgacagagatataaaatataggcctttttgtgaggagggactgatactgatcaacaggcctagtttaaaacaaccattaatgccatgactttgaactttattgtgaggcaatttaatgtttttaaacaagtttttactgacgttattattgctttgtttgtatatttttttgatagagtgattttttcttgtattatggagattggattgataggctgggaaattaaacacatggaaatcaattaagagtttattgcagtagtccagaaggaaatgactaagacactacgatgaggtttgaaagaaggaaaaacgctaagattaggtttggaagaaggtagaattgatgggatttgatggcttattgaaagctgaaggtgagagaaagaatgacagatttctgccagtattagtagatatttgtgatacggaacttaggaggaagagattccactttcactatgtgcagatttttttctgtattaggtttgtataatctaagagattctttatgagtgattcaactactgagtaagagtctgaaaattttagcaaaaaaaatccagtgtgatttttaaaaattggctttattgaggcataatttacaggtgttaaaagtcaacagttttaagcttacaaaactaagtttcgactagtgtgtatagtacatgtaaccagcatcacaatcaaagtagtacaaagaatgcatttcattatttgtgaatgtcaaaaaaatacttttctctttggccagtattctagatcatatctctcatttaccaagtgatttgattttataaattaattcattttggacagtgtacttaagcatgatatttttatgagtctgtttttaatgttctactgtttttctctaattgctatgtctaatgctttttcacacttacaaagactcttgttatttttagtcattagggttcacaatattcaaaattatgtttgaagaccaggtgcaggtgctcatgtctgtaatcccagcagtttgggaggctgaggccggaggattgcttgagcccaggagtttgaggccatcctgggcaacatggcaaaacctggtctctacaaaaaatacaaaaattagccaggtgtggtgttatgcatctgtagtcctagctggttgggaggctgaggaaagaggatcacctgtgcctggggaggttgaggctgtagtgagccatgattgtgccactgaacttcagcctgggtgacagagtgagaccctgtatcaaaaaagaaaaaaatttatgttttggtacatgattaaaatttttagaaagctgtgttttaaaatgactgctgagaggtcatcattagcttatgtaaatacatttaccatcttttaagaaaattgaggactctcttgtgaaatgtgatggtaagagtaaggttcttatattttttttactagagaaagagaataaaagtttttaaggaaattaagctgtactcatctgcaacttccatacatgacacaaaatgtttttaaaacttctatttctcattagtatgcattcattttagaaaaatcagaaaatacagagagaaaaatatgtgaaaatcatccctatcccagagattgcctagtgttaacattttagaatatgtatagtacttgattttacatctttaaaacaaataatctttaaacaaatacatctttaaaacaataaagatgggatcatacaatatgtattttgtgttagcctgttcattttacacaacactatatcactattttagaacctgccaaaattagctgtctctcttttctctgggctaagatcttgttttattttttcaaggcaaggagacaaaagttttaggataccaaaagacagagatcaaataagtgtttcctttctattcgccaagacaatgctaactttgctttcagccctttgatgaaaattattttcaacttaaaaatatagatatatttttttaaatttcaacttttaagcagctctggaccttccagcagtagggatcttctgactggctcagctcacattttcttttttttttctgagatggagtctcgctctgtcacccaggctggagtgtagtggcgatctcggcttaatgcaagctccacctcccaggttcactccattctcctgcctcagcctcccgagtagctgggactacaggcacccgccaccacgcctggctaatttttttgtatttttttagtagagatggtatttcacggtgttagccaggatggtctcgatctcctgacctcgtgatctgcctgcctcggcctcccaaagtgctgggattgcaggtgtgagccaccacgcccggccacagctcacattttcttaaaggcaagacatagggaggtttgcacacaaccctcagactgcttctgggtcacaactgagtagatgaaaagagaaagttgtagagaatatcccttttgttatcagtcaggatgagctaatttatgctgcagtagcgaacatggaaatgttagccacttaaaacaaaaaagggttatttcccattcacgcagtatgtttatcatattccacatgctgtcattttgggatccatggtaacaaagctgccactatccagaacattgttagtttctatgtcagagagaaaaaaagttttcattgggtaaatttatctgcttttcagggtatcacagatgataattgtaccaagtattttgccactacaaacatggatcagtaactttccagcctccaatgtaacagtttctatgtggccagctgcccaacctgtaaaccactgtcacacattttcttttattgtggttgttactagtttctttttataaatctttacatgctaataactgtatcaatcacataggctagtgtagtcaccctgaagtagtgggacagacccacccctactcacaattggtttggatgtagagactaacaatgtcacaggtgccccaagaggataggaaaagatttattactcacataatgaggctttctggagaaaacagagaacaacacggggcttgggttttatggtggtttggtggtggggatggggtgtgaggatttctgcatgtgggccaggtcttaggtagtctgaactttccactagtgtaaaggaaggagcatccagaccttcttaacagcttgcccagatatggggcagaagaggaatggggactagtagaacttgaaggctgtgagcagacacacatcaaaaatggagtcagaccctttatcacatacagctaaggtatgctgtggttattacccctaaaatcctaaaatatgaatcattcagtttgtttcttacttacactatatgtttattgtggatttgctgggggagctgctgagttatctgcccatttcctgtatagtgtggctccaattgggtggccccgtgttgttgcccatattggaagaaagcatcaaaatccagggcaaaatgagagagctaaagattctgtgcagggcttggtttggaggatgtatgactttgagaatgacagctgttaatatactctattctcctctctgcattcccccacttgcctccacaagtgattagggtagagatctgatcggaggcctgtgtctttcatacccttgaggctgagagaataaagacttaagagcagagtgctttcttccaacctggtccctcttgaggatttggacagcctggtctttaaccacaggcacagaacgagagactccttttactttcaccaaataaaggagctactagccattaataacatcttggaagccagccctgagcacagtaagccaatagaaagaaagcactgccatctgaacaagagagattaacagattgaacaatcagaaattacgctccatggaaaagaactactggagaagatagagtaacacttgaaattttataattttaaaatttatttattttggtatggctggggtcttgctgtgttgcccaggctggtcttgaactcctgacctcaagtgatcctcctgccttggcctcccaaagcattgagattacaggtgtgagccaccacctggcctcacttgaaattttaaaatgattttaaaagtacttaagatttggaaaagtcttcttgggcttgaaaagagtttttcagactgaaaacttttaaagaaggtgatcacaattgaggcttgaattaaaggtagaagatcaagtgtaggaaataatcccaaagcataagactgaaagatagaaaacatgaagaagaagaaaagagactttgaaggatacatttaacatctattatacaagtacttggaggatcttatccaattgagagaaagaagaatgaggaataattaaagtattttagtaggaaaacaaggtctctcagtggtctagaaaacttgatatttgttttataaataataataaagtcatttaagagggagagatatatattaatgggaagtataagcacagtagagtttcatatttaaaaggaagagaatagtgtaataaaattagatcaaacttaaaatattgggagaaaagagaaagtataattaaaggtagaaataatattcaatacactaaaagtgcacagaatgaaataatttactgaagacaaagatgggcttaaataaaaggcacagtttatataggaaaggccagataaattctagagtatttttctttatagttaccaattttcataactggttgcttttctaatatccaccaaaaaagatcatttaagttttttagtatcctatggcataaaatttttaatatatttgatttgttttaatcagttgcagacattattttctattatgttcaagttgcccatctttggccagtgggaaccccttcagattatctttgctagttcatttgacctgacctaccccgtcataggctttggtagctgtcttgtgttgtggtccagctagatgttctaaactcattttattcatttcctgttccagacatgttgtcaaccattcttttctaggagccctgattcctttttgttggcgatggtatatagtaactacagtctagaggtgctcatgattatgaagttgctcattgttttatggccttttcaatgaacagagcatcttacgtattttctgctccagccctcaagtcagccatttctccaaggaaccctggcttccttcagtagagaatgatgtttagaaatgacgatttgggcactgtgtttgctcattgttactggggtgacatgactcctggttcttagtgaactgagctgggaaatagatgtatgtatacacgcacagctgtttctggatcttgatatgatattaaaaatcattgaccacttcttaatacctcagaatctagtacaatactacagaatttcttctggctttctcgttttccatatttgcagcttgcttctctgacagagatcagtgagagatctcattataaaaatatgtgtctaataattaatgttgattcactgttttaaatttttatatttttgtttgtttgctcttaccaacacagtttcatttatcactgtcatatgtatatcaggcaccagtctcttttatggttttcctaacttaatttctcattctttccttcctctaactttcaattctttattttcttgcagaactgcgaaaattaatgtatataatatgttctcatttgtgtaaattagatatgcatatacacacgtataacaagtatgtgcacagcaagttttctaggatacctaagatatagctagctgagtagctttggataaagggacctaaaaacggatgcagagtgtggtagagactattgttgttcatacataagtttctgtatgaacttttagtcatttgcctatattctttttttttttttttttttttaagttacggtagttttcaaaacactgtcatgtctggtttggtttggttggctaggaagattaatttatataaatttgtcttcagaatttgtgcatgaggtgtccatgcttccaaaatgaaaaatagtaaataatgatgactttttttttttttttaattgaggcagggtctcactctgttgcccatgctagagtgcagtagtgtgatttcagctcactgcaccctccacttcccgggctcaggcagtcctcctgggtcagcctcccgagtagctggaagtacagacgtgaggcactatgcctggctaattgtctgcattttttgtaaaggcagggttttgccatattgccagtgatctgtccaccttgtcctcccaaagtgttgggattacaggtgtgagccaccatacccagcctccagggatattttttaaattatgaataaatttgcgtgaaatcttacaaagaaatttaaattgagtaatacatatttaactcctaaaaagagtttgttgaaaaaaaaattaccgtataatacctagtggttctatgctaagcacttacataaattatttatttaattgttatggtaatcctatgaggtgcctatattatttctgtctctatttcgtaaataaggtaacagactcagagagctgaagtaactgctcaagggctacaagtaataagtggtagagtctgtattcatacttatctaattttggagtctccatttctaaccttaccacattattttaaaaaaattatagcagaatagattcttctgtgaaatgtaattcagttctgaattgttgattttttgatccaataataccttatgaaaagacagaagttatatttttactccccaatggaagacatcatttttagtcattgtaagatgtatttattagaagaaatctgaatattacatgtgtagaggatttgggggtaaaaacactattaaagtacccacaatttaaaaaattctacctttttccaatctagagcctgttagaagtactgtactacattgcttcattaagtaccatgagtgtaaaataataacctaattattgttggctaagaatctggcataaaaggctcttataaatcatattttagtattaaacttcacataataataataataatggtagttaatatttactagtcatttactttgttttgagtactgcattggattaccttgcttattcctttcaacagtcctatgaaggtagtactattgtttttgttttatagcccattaagctcagacttaaggaggttatataactgcctagggcttcacagtagtgatgaaagtggattatgagcccttactccaagttgtttttaccactcatacttttaacatagacaaagtggtatttgaaacaaaaagtgaatcatgaaacttctttttagtgaattttctttatgggtatatattcttttattccctttaggttcacaatattcttgcagaaatggtgatggggggaatggtattggagacaaatatgaatgagattgttacacaaattgatgcacaaaataagctggaaaaatctgaggtaagaatggaaaatgctgtagttaagaaggttctaagcatgatgacagattacgcatgatttgtagttttcactgtttgtccttcagtatcaccctttaggttcagccgttatgcttattcagtttttaaaaaatggaatatacacgtagtatgctaaaggttctgtgactgttctctacccaacagctttgtgtattcttcttttagccacagtcatagctgccttgggtaataagcacaattccaaatcttattgcctaaaagaattatctgaataatggaatctaatatttgctttgtaaaacttcagtcggtaattatcaaggaaatcttagaactaatattttaaagatatataaattttgtgttacaaaactacttctggaaagggaaaggacaggaaatggaattcttacagggaagtaagtaatgtttcaagttattaataaatgcaaaataaatattttgaatgtttgagttcacattcaaaaaagaaattcaataccttaatcttttaattctaaatctttccctaagatttcactgacaagttagttaagtcacatattttagacattagtacatatatatccatggtctttattgcattctataagatcggtttgttatacttagctaactttctgctgttagattcaaccttagatgggataaatgaggaacagccagcactttagcattgtataaaaccctacttcagaattgtagtgactcttccctcaagcactagtctgaatatcagtagcaggtgctgtagctgagccacctgggttcacattattttggttgtttattaccctagcagaggtttagaaagatcagtagttttatcatttgagttcaggagttcgagactagcctggccaacatggtgaaaccccatctctactaaaaaaataaaaataaaaaataaataaattagctgggcacgtagagcgcacctgtaatcccagctactcgggaggctgaggcacaagaatcacttgaaccccggaggtggaggttgcagtgagccgagatcacatcactgcactcctgggcaacagagtaaaacttcatctcaaaaaaaaaaagaaagatcaataattttgatatctcattcaccacccaacttgtttgaggatactcttacatttggtatttgcagtcataactcagattggaaaaaacagactttatttttataattattagtgttaagctcagatgtttcgttgatttaaagtaaatattactttgaaagcatcaaggttttaaaaatacactggcattaatttacaacaggtgagttctgaaaaattttaccttgttggcattttaaaggatcagtttaactcaattcaattctgtgtccattttaattgaagaaaacacagggtgaagaataaatctcaaatctagaaacagttgaagcttataaaacattttccagtgttctcttttaaatttaaaatagtcttgcatttttctttatctcaatttcccattcctgttggtttcccaaaggagaagtttatagtggtgatttagagctaagattatcttaactaactatatgttttgtttgtcctatagccaatttttaaaatattggcttttgaaagtggaaaacataaattaggttaatagagaaaattttgttttaggacaaggaaaaagactcataatttaatttagtataactgacttgcaatatattatttagtaaagaaaagattattataaaccctgagctattgcttttaaagtcttaaaagaacttaaaatgtgtgtcatttgttaaacattgctttgcaaaactgtatggttatagattttaaatgccaagggacaaacagtgatgcaatcctttaataactggtataaatgaatgagtatctagtaatttgtgaattctgcataatcatctgtaaaaaatattgaccagttgtctggaattttcacctttctaggtagttaactccttttcattggtggtggtccttctttttcttctgctacttaagacatttatgcctggtgttccattattggaatgctaagcttgtgggagttatttatatcctactgctcaaggtcatccccaaggtctgatttttcacaaaaaaaagtttgcaacctccggcataaatgggttaatgtgctatattgacaaaagttatgaaggacctataattattgcataatgggtatttgctttttgattgttgaataaaacttcgttaatgaggcaatttttcttatctataaagagcagtaaaatgcgtaatttacatttcaatggaaatagttataagaatactataacttaaaatctattcacagaaataatgctatttaaaatagtttagaatactggtgattacttctattattcattccctgatcatctcgcatcatacataattgttatctggtaccaaattagtttctcttcttttgtcttttacaagaaagtatgttttaagtctgattggggataaactacaaaattatatattttctatacatgtaacgtctgctaatattttagttatgaaatcggatttcaagtcaaagtgaggccatttagccctgatcatctttttaaaacagcactgaaaattatgatgactaatttttcgtagcttttgtatattttaagtatgtttgaaaggcttctagctttattccagctagaatgtcaaaagctttcatatgtttcatgtccatgttacttcaattggttaaatttaccagagatattactctgcagaataatccaaaattacttgaaacaaagtataaacttttcctaatcttcttactaaatttcagttaaaatgtattatataaggacaaacttaatgacttgtttggctgggcgcagtggctcacgcctgtaatcccagcactttgggatcactcaggtgatctgctcacctgaggtcaggagtttgagaccagcctggcaaatatggtgaaatcccgtctctactaaaaatacaaaaaaattatccaggcatggtggcacttgcctgtaatcctagttgctctggagcctgacgcgcaagaatcgcccgattccgggaggcggaggttgcagtgagctgatattgcaccactgcactccagcctgcgtgacagagtaagactccgtctcaaaaacaaacacacaaaaaaagacttgtttaaaatcgagaatgtcatgattgatgaaaagaactggttatcaatatttttaaaaattatttaagtaatatcttaggaacatcatttatatttaaaaatcagtctgggtataattgagacacagctttttaaacataacatgcatttatctaggggcctttgtcagaaatcagagcttttattatgttggtctaaagttagtacatttctggtaatggaaaaaagtgaaccagtttaattcccaatacctagacaggtggaagcaaagctctgccagatcctgaaagagagaagcaaagatatactctgaatgtatttccatctattctattttgatagaaaaatggtttactataacattggaatattgggagaggagggtttaagctgggaggttgatgggattcgggggaagtataagaggcactcaggaacctgcctaagaataaaaggactccctgggggtggaggtagaggggtggggttggggagatctgttagcttttatgtatttcatgttattcttaagatggataaatgggtctgaatttagtcactactttttgaaagtcagtcctcttttttttccgaacatcctgatctttctagctctttccattcttctctcttacagacctttatctttcagtctcccagacaggacaggtagacaaggtattgctgactttgagaaatatgtactataacaaagggaaagcaaaatgatgtcaaaggcaattaattatttaggccagactcaaaaattctttgtgttaataaacccatatagtccctgtagcctattttccattctagtttctccttgtagtttcttcatcttttattggacttagtgtattttactagtatatcattgatgtcatgtttgttctgttttgtctgcctgcattgtaaaaggaaagtttaaattttttttaaacacttgtcatctaactgacaaattgcatttgcagaagtgacaatttactttgtatataaaaacgtaaaatttattttgagcatcatatagcagaaccaatcttaatttaactctcacagatttgttttttttccatctctaaattaggattctaacataaaattgcctgctgggttttggaagctgtgaatttaaaaaccaaaagctgaaccttcagagttttgcatacaaaatgggaagcagtgaaggcttagaatagtgactgttaaatagtactttttcccctcaaatggttttcagttccaaagtcttaacagaattgcttttacagttttgacctgcaggtgcatattaacagtggccaacagaaaataagatcagaaatcttataaaacttgactgtatttcaaactagaatgctcgaaaaatggaattaccaaattaccaaatcaccaaaatacaatgggttttcattgtagcaaaccttctgacatccaaacatgtcataatcagaatcaataaaaatatattaatgttttagtattgaattaaaaaccctgaatatttttgcaaagcgtattggcaaatattggaaatatttttaatagacctctagttttacaaaactaatttttcttctgatatttcctgtacgttttttcacaccataaattaactgtgtgaattacttttttaaaagttccatgtacgtggtgatgagcaactattttgtgtgaaaccatgtaagcaaaagaaatgtttataaggtctctgattgaaaatttcaaaataaaagtaatttattgagtcctatggaggaaaaaatgtataaacttacgaagttagattatgcacttactaattagaaaaacatcactgagaattgatgattgtggtgatatcacaaagcattgccttttagccactaaatttttacttactctctcgatgtgtttgagaagaagtagcaacatacaggtggctttatagtatcttattttgagattgtgggctatgtcacaaaactggggtaccgtttttggtccctctatccatgttattttgtccctcatatagagaatacatagtagtctcattctcaccattggtcagaattattgccagtttctgtgttacagtatgtaatttattactgctattttccagcaaagaaccattaatcacttgggtctgttaactttattgctagaactgttaattggccttttttaaaaaaaatcaagtttctgttttcaaagaggagagaataagaaaagtggctctaaggtactgatggtggaaggtcagctcatgagctggttctgcctctctaccttgacatacacatttgtcttgtacttctacaaaattatggtgagaacccttgaggtcacttgtaatggtcaaaactagtaatgataaatccatgaaagtcattagtctgctctctttttttcatgcaggcaaatcctatgtttgaaattaaagctataattgaagataatccgtacaaaatgactaataatttggaaggttttttaaatttttgagcactctaattttgttaaaactgtgaaacaccatagttattgctgtctagagaattgtcatgagcttatctaaatgtttataattgcagtattaaagcactgccattaaaacaaagcctattatatatccccagattaaaagttattctacctcgtgttgagggattttttaaactattgacattttcttttttgctcaaaaacatgctttcaaaatctgccattattttgttaatgattttgagtctgaaaccatttaatattgtgtttattaatgttggtgttctttcactttgctgttaggtcaaaattatgaatgtgcatatagcaacttccagcaggaagggtgggtaaaggttttaatacgtacagtttgttccaactaccatcttattatgctgtattcaaacttgaaaaaaaaaaagatattttaagatggtaggatggtattttatgtcttagatgaaataaataacaagattactctattactttccttttcccttcaagaaagttgattgtttattgcatgaggaaaagggagctttcagggtcttcgaaatacattttagtaatgctgctttttcagttttgcttgcacatattttgtttatttttgggtctggcaatttaaaaacaaaatcaaaaacaaatcatatccatccattactatctttgtgattcaagtgcttgaaatttccaagagtatgtctgtataagtctttatctgtttggcctcattttggtatacttgcagacttcattttgttttctttctcttaattctgttaatttatttaatctcatgggagagaaaacatgatcattcttttatatactgtacttcattctttcatccagttcatattcttaactgctttggattcatatatttgtttttattggtgtagtcgctgcagttttacctgccatggtggtgctcaggtataacatagatggaaacaagttatttctccagtagaatttcattctttttatttctgctgtgtgtcaactatataatcttaaatctttaagaactatgttgtactgtcagaaatatcttacttttacgtttaaaaatgtatttacagtaatccccccttacctgtgttgggtacattccaaaacccccagtggatgcctgaaactgtgtatactactgaaccttatatatgctatgttttttcctatgcatatatacatatgataaaatttaatttataaaataggcacggtaagagattaacaactaataataaaagagaacagttataacagtataatgcaataaaagtcatgtgaggccaggtgcactggctcacgcctataataccaacactttgaggggccaaggcagaagactcacttgaggccaggagtttgagccagtctgggcaacacagtgagaccccatctctacaaatgtatattttttacattagctaggcgtggtgggacacacctgtagttctaactattcaggagacagatgggaagatcacttgagcccaggagttcaaggctgcagtgagccatgattgcatcactcactccactgtgggtgacagagtgagaccctgtctcttaaaaaaaaaaaaaaaaaaaaaagttatgtgattgaggcctttctctatcacaatattgtactgcacacacttattttcagaccacagttaaccacgggtaaatgaaaccatggaaagtgaaattgcgggtaaggggggactactgtactgctaacaagtcaggtaaacaatttctgtaagttttagcgttgaaaagttaagtgttagtaaaagttattttgttgctttgaatgtatcttactggaaaaaaaaaaaatcttaaccaagatgaaaattacttcatacctctgtgtcagcaaactgattgcctaatggaaagttactttacattttatgttttaataaaaatgtttcaggcatcactttcatgaatgtctgaaaatgaaatttgttttatagccattctggtgttgactgagtgacataaagtctttttttttagccctaaatttttatatataaacattgctagctggtttaaacatctgttgatcaattgtccttatcatattttctcaacattttatattttgcataatatgatttctttttaaaacgttagtttaattaaaacttaaagcacctattacaactttaaattttcctaccatttaaattcatggcatactacacaaaagtattgaacatgcttgagaaataatttgatcctcctaattcatttgcgtgttctgaatagttcctatcttttgcatgtctatggcttgctgcttatgtttagaagaattgtagtttgttgtacttagaaacttcttttggttttacatattaagcacaaatatgctatttaaatcaattgctatattgactttatgtattcttgttagcagccaacagtcgacaccatctttggtcacaatgatacaactcaatctaatgaaatttaacaggatgcatttttaaatttttttaatttattttttgctttagtttagctcttcatggtacaggatattatggaaaagagagcttcatgtacatttaatactgaaaacattatgtttactatttataagtgtaaaccatagtgtccaataaaatacacagataaacacacacacacacacgcacaatttctctcacaataataaaatcccttaataattcacacctttaaaatatttatactcaaatattttgtcaatacttttctatagtcagttcattatttgtcttctttatggaaattcctaagtaaaaatagtggcaaattggtcttttaactagaaaaattacaaaatcctcctatctaaaaaatgatactacctccaggacgtctgcaattttgtaaatttttcttccttagtagacaacatacttcctggtaaaagaaagccaaaagatggtaaacctctttgaattggattcttctttgatcccaacccactctaaattttggtagctagacctttaacttgaaacgatcaaattaaagaccctttcaaatattatacatgctgccttaattattatttagttgtatctccaacatctttgggggagcaggaaggaagggggggtaacaaaaacttcattgcttcaggtaggtataagtatagaggtcaatcacatttttagttgtacatcaaaaataactaacatccattaaattataaaacttctccagccctattcactatttaattgggtatggagttattcatttgtatcactcttatcattgcctgtgtagaatatacttattattaatactattctactaatttttctattatttccaattctgaattgataatccatggcttttatttcattgcttaacaatgtttgtatcctttatttagcaaatagtttacactggcctattttgtatcagtcaagatttttctcaggtaacagctttattattatttttattttaattaacaaaggtaggattacataagaaaagaaaactaaaattatgaaaagggaccttaaagctagtgtttctaattttatggacattgccatatataatctaatcaaagtggaagattcgtttttgttgtctatttttgtacaaaatgatgccactgaactcagatgtctttgttgactttgctttattatatagcctgaataaaaagtaatgaaatgtaattggtatataaattaaacctcaaatatgaaggctgttaacgtaggtgagaaaaatgatatgtatgcattttcttttatttgtaagcatattttcttttaaaattatttcacaaattacaaatgttcctactaataggaaagccaaatattatgcactagtggtacttactggaaattttagaattcatttatttatatttactacctcttgcatttatgcttttctttctctaaatttgtaaactgtaagctgaatatatgttgctgaatctatgctatatgacaaaacatttttaatcgttatatttttactaatgcatcaaagggttggaatgatcctcttcgtgtagtttcatctttaggcagaactatattctttggattgaggctttacttgaaagcctatttttttaatgttctagaactttattagaaaagtttaaaagagccctcacaatttaaaaaactaattttattgttttaaaatgttttaagggtttatccctaagaaattaaacaagcacaatctattacttgcaatttttatttcacagcacatattgctaataaatgccattttaaaagcaaaagaaaatctatcacaatcgttgcaagagatatttaataaggaaactaatgtaaatcatgcttcatgctatctgtcagttaaatcaagatataggtgaagatttaggttttatcatgtgaatattgtgtggtagtgcacattaatttgtatttaaatctttacattgttatcattgcatgtgttcactgtattttttaatgtgtcactgttttctctttatagattagtatttcaaagtaaccattccataccaattcaaactaccatctggtccctaagcttgttatatgaaaatcttttatcattgtcttccattgtaagtgttttatgatgagctacacctgagttgtacattttctttttcttttatttgcttctgtatacaggctggcttagcaggagctccagcccgtgctgtatcagctgtaaagaatatgaatcttcctgagatcccaagaaatattaacattggtgacatcagtataaaagtgccaaacctgccctcttttaaataaaaatgtaaaaaggccactcccaggtaaaatccagggggaagagtcatctaagtttaccatgcagttgtttaccaaaaatagaggaggagagtcttaacttttgctcttggatttaagtcaaggtactgtatagaagttgtgtaaaatcagtatgaaagttcaatgttgctgttcttgctcagtgattttaaagaaattgagtagttcctatgtgatttttttttttcttttctaaactgcattcctgtgcccacctacggcatgcctctatgtattggctactacagtgttttaaaaagtgtttcagatatttctctaattatgtacaacctaaaatgttggtgttttgtatggatcacaagtgcagcattccttaattccttctgctatatgtcacacagttgttatttggagaaccaagtatgtattgcatgaaaacattatgacttttttctcttagtttaaataaactccaaggtaactggacttctaaagcacctttctgtttgcctgatatctactttagcaataattttttttacaaccctctgactcaacaaagtaaataaaagtatattttatcactatt

SEQ ID NO: 36168 - DNA, 12126 bp, Homo sapiens
aaattttccagccgatcactggagctgacttccgcaatcccgatggaataaatctagcacccctgatggtgtgcccacactttgctgccgaaacgaagccagacaacagatttccatcagcaggtaacgtttgcaacttcctagatcttttagcttttcattcctgtcaattctctgagtattagggatgtagtgacttgaggatcacaataaacttttagcctctgcagatgaaaacagagatgcacttcttaggtcattccctggctaaataaaatctgcctggaaatctgtagaattccttgtatgatttatatatatacatacatgattgttagtaaaagcaaagtatatagggaatcatttccccatccttcaagagtggcctttctgcagtgttttctactttggccaacaaggatcaaaacggttaactccttagtgaggaggaggagagtggtatggggaggtagtagctcagtgcttcctgttcactgagacatctcaaagcccttaacactctagtttttaaatgtcctactggacattttgccagtttgcaaaattacatgtaaatggactataagcaattgtgtaagccatatgtcatgctgcaggctgcaaattgttcttaaaatggaggatttgtaattaagaaagccaatgcaagaaatgagtgaagctaactagagtaaacttatgaaaagctgtgaatttcatcatcatagaacattgcttttcagtctgaacattcttctaacaaaccttggatctgaggcttcttgtcctttgcggcagccacagtgggtttttgttgttaggggaaaaataaaaaaccttgcccgcagcatctggttaagattagggcagtttcctgcctaaggagggaagggagagaaaaaggaagaagaaatgcataaggagaatgaggagatatacaatgtctcagaaaacaggaaacattgtcctattttcccttgtcctcttctgacaagatctgggaaagtaccagaatttaggcacgaaagagaagaacgcctcgaagaaatgatcaggaggcaaaacttagacggaaatctctcctttgtgtattctgaaccccactaccaccttgctatttgtctgtctccaagcctgctagggaccctggaggaaacgcactgagcccattctgattgtccagtttctatcccccatttctggttgtgtacgtgtgtgtgtgtgtgtgtgtgtgtgtgtgtgtgtgtgtgtgtgtgagagagagagagacagagagagaaacagagagagtgtgtgttgcctaaatctcccgagagagagagagagagagaaagagagaaatggctaaatccccctagatcaaagtccttggaaccagatgtaccagcatcctatctaaacacaggcccctcctgactatcattgttttatcaccctttttccgtctacctttctcttcctcataaagcctagttttcctctgtttccctgccaaatggaagagttttccctaactacattcttctgcaggatgtgggggctcaaggttctgctgctacctgtggtgagctttgctctgtaccctgaggagatactggacacccactgggagctatggaagaagacccacaggaagcaatataacaacaaggtgcctggggtcctggagggggcatggcaggaaggctgagacctgagctctctcatcttagcttccagactcccttcttcaatccaaatgctttattccaagcaaatcagtccctcttccctaactcatgttaacatacggttttcattcctatgcttcaaatcatcctctgtcaaactgtatccttcctttgctttataagtgtgttacatttctcttttgggaagagttctaagattaatgctgttaatctataagcaatttttctgtctctccagagctttgtgttgtatttgtttacatattatctcttcttgcaggctcttaattccatggttagttccccaactaaactgtaaacttttatgattgtgagtttcctttattctcctaaaacccttcacaatattacatatgtaactgtagacagtctatacaagtactgactatgctttgtttaggtggatgaaatctctcggcgtttaatttgggaaaaaaacctgaagtatatttccatccataaccttgaggcttctcttggtgtccatacatatgaactggctatgaaccacctgggggacatggcaagtatagcttcagctcctgtcccacctgcaccatttgctttagttccctgctgatgcctggcctctttcttctttgtcttagaccagtgaagaggtggttcagaagatgactggactcaaagtacccctgtctcattcccgcagtaatgacaccctttatatcccagaatgggaaggtagagccccagactctgtcgactatcgaaagaaaggatatgttactcctgtcaaaaatcaggtactctcctttcttctgggtgtgcatatgtaatctggcatgaccttttcctttttctgctgctttgttcttgaggtgaaagggcaccaggaaaagagggcaaggaattaaggtacatctccccattcccattctgttatttaacctcatttgtttctgtacatttgggttgtttctggtttttctttttcttttcctttttttttttttttttttttttttgagatagagtctcactctgtcgcccaggatggagtgcagtggtgcaatcttggctcactgcaacctacacctcccgggttcaagcgattctcctgcctcagcctcctgagtagctgagattacaggcacgcgccactacgcctggctaatttttctatttttatagagatgcgttttcaccatgttggccaggctggtcttgaactgacctcaggtgatccacctgcctcagcctcccaaagtgctgggattagagtcatgagccatcgcggcctggtttttctttattacaaatagtgttgcaataagcacccttgtgcatatgtttttgtgcacatgtacaaatatttatgcaaaataagtcctaaaattggaattgttaggtcacaaataatcctttccccccccccaaattttttttttttttttgagacagcgtctctgtcacccaggctggagtccagtggcgcaatcatggctcactgcagcctcaacgtctcaggctcaagtgattctccaacctcagcctccctagtagctgggattagaagcacatgccaccacacccagctaattttaaaaaattttttgtagagacagagttttgccatgctacccaggctggtctcaaattcctgggctcaagcaatctgcccgcttcggcctcccaaagtgctaggattacagacatgagccaccatgcccagcccaaaaaagtttttgcaatcttacattcttactagcatgagaatgtcagttttttcacaacccaaacaacacaggattgtatcagcaagataaacaattgatttaacgttcatttaacaaacactttttgacccccagaacctaccagatgcagtgttaggcagcagagactcaagatgactaagacacaacctgtgtcctcaggaaatctcaatctaaaaaaatagaacaggaaagaaagaaaaatctacaatctagctgcacaaacaataatagctaatactttttgagattttattgtttgtcaggaacttcttaactctttacatgagttaaatatttaatccttataacaatattttatgcatagagaaactgagacacaggcaaatttagtaacttacccggggtcacatagctactgggtggcaaagtcagggttagcacccaggacaaatgcctccacagctggtactgtgctctgctttactgtagctaatagtaaaaatggtagcaaaaatcaatagcagtagaacagtgcaacagatattaagcggaagaggaagactcacaacaatgacaacatttgtgctgaaatttttagaacacatggaatttcttcaggcaggtagagagaagatatagaaaatgtaaacagcaaagattgatagtttctctgtatgcctttcagggtcagtgtggttcctgttgggcttttagctctgtgggtgccctggagggccaactcaagaagaaaactggcaaactcttaaatctgagtccccagaacctagtggattgtgtgtctgagaatgatggctgtggagggggctacatgaccaatgccttccaatatgtgcagaagaaccggggtattgactctgaagatgcctacccatatgtgggacaggtgagattgctccacacaattatacagctctgttggctcctccttccccagcatgatgttttgtactggaaacaattccagaaatactgttttctgttatcctatcctgctttcttgatggaataatttcccacagaaggccaagaagatttccacaatctgggggaatttagggagcttaagctactatagctcctatttgcatctctgccatggagagaaaacagaggctaggctacctaccccatagacttccgagctgggttctataaccctctgctcaattcctcactcccacaacaaacccacaaacccaccatgctattttcacaaattgtgtggctttattttatatgatctcagtgtgagttttcagaacatttcagcaaattatgtaagtttacatgctaacatctataaaatgagagaaaaaacaagttgcttcatataagagataagggattaactcagttcctcctgcatgatcctctagtcataggaaggaaatcatatctgaaagggaggcaacctgaggggttttttatacacatagggctgggtctgatagacaatataatgtagggccttcacaacagaaacctctgaaacagggacagcaagtttgagaataaaaatgatggctactgtgttctaagccgtgtccttagtgcattttttctttttctttttttcatttaatctcataacaactctgttaggtagacttatcttgaatgtataggtgaggaaatggacacttaaggagataagacagtataattcataccactagtatgtaacaatgtaagatgtatctaccagggatgtttatcttctgcaaacattcctaggtatatctcccatgcacatgtgcaagaatttcttactaggatataatgccttggaactgaattgtctgggtcttagggtatgtctgtcttcaactttactacacaatgtcaaattgtttgccaaaatatttggaaaaatttatacctgcaatgtgtaagaaatccccttcaatcacctttttatcagtatgtttatctggccatttgcatttcttcttcagtgaattaactgtttttatctcttgctcatttgtttttctttttatttttttgaaatagggtcttactctgttgcccaggctggagtgtggtgatatagtcatagctcactgcagcctccacttcctgggctcaagcaatcctctcgcctcagcctcccaaatagctaggatataggtgcatgccatcatgcccaccaatttcaaaaaacctttgaaatttttttttgtagaggctaggcatggtggctcatgcctgtaatcccagcactttgggaggctgaggtgggaggatcacttaagcccaggagttccagatcagcctggtacaacatagcaagacctcatctctacagaaaaaatttttaaaagtagccaggtatgatggcgtgcatagttctagctactcaggaggctggttgggaggacaacttgagcctgggagttcaaggctgctgtgagctgtgatcatgtcactgctctctagcctgggtgacagagtgagaccctgtccccaaaaacaacaaccgttttttttggtagagacattgtctcgctatgttgccaaggctagtctcaaactcctaggctcaagcaatcctcccacctcccaaagtgctgggattatagatgtaagccaccatgcctggcctacccttttttttttttttttgaaatggagttttgcttttgtcacctaggcttgagtgcagtggcgcgatcttggctcactgcaacctccacctcctggattcaagcaattctcctgcctcagcctcctgagtagctgggattataggcacccgcaaccacgcccggctagtttttgtatttttagtacagacagggtttcaccatgttggccaggctggtcttgaacccctgacctcaggtggtccgcccgcctcggcctcccaaagtgctgggattacaggtgtgagccaccatgccccaccccttactcatttttaattggattgttttttctctttcttagcgattcttaaaagtttaaagagaatatttggatacaatactatgtatttaaaagttgaggtttgtcttttcattctttttatgatgtctttcaatctagaaaagttaattttaataggcctggcgcggtggctcacgcttgtaatcccagcactttgggaggctgagatgggtggatcacaaggtcaggagatcaagaccatcctggctaacatggtgaaaccctgtctctactaaaaatacaaaaaaattagctgggcgtggtggcaggtgcctgtagttccagctactcgggaggctgaggcaggagaatggcgtgaacccgggaggtggagcttgcagtgagccgagattgcaccactgcactccagcctgggcaactgagcaagactgcgtttcaaaaaaaaaaaaaagttaattttaatatagtaaaattagtaaaatgattaattttcctttgcaatttttgtaatgtgttttattcgtttatgaatggagaaaggtaagaaaaaataaaatttaaaaaagaagagatgtggccaggtacggtggctcacacctataatcccagtagtttgggaggctgaggcaggcagatcacttgaggtcaggagtttgagaccagctgggataacatggtgaaaccccatctctactaaaaatacaaaaattagccaggtgtgattgcgcacgcttgtaatcccagcaggctgaggcaggagaattgctcgaactcaggaggcagaggttgcagtgagccaagatcatgccattgcactccagcctgggtaacagagactctgtctcaaaaaataaaaagataaaaaagaagagatctgatagggcggccagataacattttaaagggatggtattataagtttgttccagcataatgcaggttattctgactttaaagtatcatcacataatatctttttgagtcaatttccaagatattctgtttcacttgtaattctgtgtaatttttggcaccaggaggcatcagggatttggagcacatggcagaaacaaaggcatcttgaaaaatatcaaggcagtagaccactgtaatcttaaaatggcatatcaaatgctgctattgctgttaatatttagataatgttagataatgtatttttttagagggtatctcactatcttgcacaggctggagtagagtggctattcacagcatgatcacagtacactaaaggctcaaactcctgggcacaaacaatcctcctgcctcagcctgctgagtagtagataataagttcttgtggatgcaaccttagggttctgaaggggtagtctgtaggaaaatgaattgctgaaaagaatacaccaccttaacatgggctattattcgattccataattgtggcttgccaatgaaacattgctaactacctgtaaaatatagtgttggaagtcataggctaaattgctaagttctttaatctattttagtgtcttgttatgtacttttatattttgtctttgatgagagcacaaggatcacaccagttcccctgatataggtgcagagggcccaggtcttccctctagctaagccttggccttggcctcctacccacacagcagctggtgccttcctgccccctgaggctaatacatactatgtggccagaagatggtttatgctttttaaaaaaatcttatttcagaaatctttccctactgttttcctcccacatttatgtcttaaaacacctgtagttgattttttttttttttgagatggagtctcgctctcgcccaggctggagtgcaatggcgcgatcttggctcactacaaggtctgcctcccaggttcacgccattctcctgcctcagcctccccagtagctgggactacaggcgcccgctaccacgcctggctaatttttttgcatttttagtagagacagggtttcactgtgttagccaggatggtctcgatctcctgacctcgtgatccaccctcctcagcctcccaaagtgctgggattacaggcatgagccaccgcacctggcctgtagttggtttttatgtgtggtggaaggcgggaatcctcttttcatattcgtttttctgaggaagaacagaccctctctagaaaccctagactgctgcctctgttagttcactggcatcactcaaaatattggttgagtttcttactcactgactcattgcctattgctttgtcctagtcctattacaatcttgtttcttccaggaagagagttgtatgtacaacccaacaggcaaggcagctaaatgcagagggtacagagagatccccgaggggaatgagaaagccctgaagagggcagtggcccgagtgggacctgtctctgtggccattgatgcaagcctgacctccttccagttttacagcaaaggtaagaagctgctgatcctatacagcactgtcttttatgatacaaacttgatggtttctcgaaggaccttgggtattttcagtacttagtttttgtattcacatggaggtggccagagagaaattaacaactgctgcagtatggagcagcatctctgtggtaaaccctcctgacacggatggaattcttcaaacagtctcctagactgggagatcccacagggtgacccttggattgcatagagcctcacgctggtagtttgtattctaggtgtgtattatgatgaaagctgcaatagcgataatctgaaccatgcagttttggcagtgggatatggaatccagaagggaaacaagcactggataattaaaaacaggtaatgatgggaacactacttttgttattcagtcacccttttaacactcaacctcacctccagcttcccgatattcctttctctgtcccaaatcaagaaaaaattatctcagagttctcacttctatcttctcagtcagaggctcttaattctcagtctgacacttaatggccagtgtgttagtccattttgcattgccacaaaagaatacccgagactgggtaatttataaagaaacgaggtttgtttggctatacaaagcgtggcactagtatctgctcagcctctgatgaggcctcagagcttttactcatggcagaaggcaaaagagggagcaggcatgtcacatagtgagagagggagcaagagagagagggaggtgccgactctttaaagaaccagctcttgcatgaactaatagagtgagaactcactcatcaccaaggcgatggcaccaagccattcatgaggaatccactctcataacccaaacacctcccactatgccccacctcccacattggggatcacatttcagcatgagactgggaggggacacacatccaaaccatatccgccagacaatagtgctcaattatgtgctgggcagatgctccctgtgtgcaaggtgcttagtgacatacataaaccaacgagcagatgacaccttcagtgagctcagagcccaataagacagacctaactaaccatgagataaagcagtacaaagaaccagcaggagctttggaattacgtatttttactttcttttgtctctaatgtgatcagtttcttagatggtttccattagcaatctgtctttaacagtaggggaacagcgtaaaggtttaatattcctttgaacagtttttttccttcaaaatacacttaagatacacgtatataagaacttgccaaagattgtgaagagaaacattttttagaaataagatataaacaaaaaaagttagtgtttactttcctatgttggggaacaaagaaaactccagggtaccttgcttcccatttctctttagcaccttgtgacttttggggaggggcagattgataacaattatagttttcctttcctggctgatcaccattaacctggcagcagcactggctaaatctcctgtccttagtgccctccaaggagcaggagccctagactctgggtcgctgacagactcacgcagtggtgttgttcaaacctgaagcaactttttatatcacagttccaactcaaggtgaacctgagcatcttcccaagtctcccacagcttctgtcctgtgttgtcccttctcttgactcccaggtccaagcacttaccctgttctttcatgatcaggtaccatgtgtggagatagcttccaagagagctgggaggaagaaaggacacacccgggcaggatcaggaacactgggggcccctggagaaggggagagtgggggagggtacaggttttaaataaaatgtgttgggtaattagagaagttgctggttggggaaagaggactgaaaacaattcaggaagataaacagacaatctctcctctctcctctttctcacgtcgtctctcttgtcttctagtctcgctactcatttccttagtaatctcatccactctcatagtttcatccatctctcctatggggtttactcccaaatcaagatcaccagcttcagcctctttcttatgctctaaactcacattttcaagattaatattccccaaatacagctctgatcatatcactctcccactcaaaatccctcactggctcctcacgatgatgggtcacagagtaaaggtgaagctttttaaccttgcagtaaaggtaattcaacctgatctcaatctgcctttccagacatctctcccactacaccctgttaggcacactgcttttcagctacatgatcctaacagtgccccacactttcctgcctctgttgttcatttcacacccttccactggcatccccttcccacaggtcgaaattctacttagccttttggctcagctcaaatgccacctcttacatcaagcctctaagattctcttgatcagaaggaatctttccctcctttgatacctacagtattatgccttctccctatttcttgactttaaactctttaaagttaaaaaacatcatattcatttttgtgtaccatcagtacctcgcacaatactcagtaaatattttaatgaataaataaactgagagtactaagtatttttcttgattggtcttacagctggggagaaaactggggaaacaaaggatatatcctcatggctcgaaataagaacaacgcctgtggcattgccaacctggccagcttccccaagatgtgactccagccagccaaatccatcctgctcttccatttcttccacgatggtgcagtgtaacgatgcactttggaagggagttggtgtgctatttttgaagcagatgtggtgatactgagattgtctgttcagtttccccatttgtttgtgcttcaaatgatccttcctactttgcttctctccacccatgacctttttcactgtggccatcaggactttccctgacagctgtgtactcttaggctaagagatgtgactacagcctgcccctgactgtgttgtcccagggctgatgctgtacaggtacaggctggagattttcacataggttagattctcattcacgggactagttagctttaagcaccctagaggactagggtaatctgacttctcacttcctaagttcccttctatatcctcaaggtagaaatgtctatgttttctactccaattcataaatctattcataagtctttggtacaagtttacatgataaaaagaaatgtgatttgtcttcccttctttgcacttttgaaataaagtatttatctcctgtctacagtttaataaatagcatctagtacacat

SEQ ID NO: 36169 - DNA, 42133 bp, Homo sapiens
tgacagcggaggcggcggcggctgcaggctccgagccgtaggagccggatcgggggaggggccgggcccaggagcctcagccccgccggcagccctaagggcaaggtaaccgccacggggtccccgtcgcgaccccctccctcccggagctcccgtccccgggatcccaagctccgccccgccgacccccgtctcccctggaccccggctctagcctgacgagatccccaacctcctgaggtgctctggccccggattctcccgggctgcattctctgctcctcctcgcctgcgaagcatcacgtccgcttcccgacgctgagggcagccccgtccagggtaggtcccggaccccgggccaagggacgtacctgcgtcctcctccttcgcctcctgcctacggggcctaagcatcgccgctgcaaccactctctgaggtccatctccgccagtggtgggagggttcctttctctatccctgccgccaggtctgagaatcgtgtctttaaaactgagctcccttcctccagaaagaaaatgacgctctgtcgtttgcccctacaagatgggggatcggtgtagggctgaaagggccaccctctgcccctcctacctgttggatgagcttaagttcccccagagaagtgcttagaagctcaaggacgacttggattctggatcagctcccaaaagggatgacacaaagtatagggaaatccaacagggtgaggttgcaaccggagggccaagggagcccgacaggtgagttgatagtgaaactgactgtgctggccactatagctctctgggtggaacttgtcttggctgctctttgaccgaaagagcccaagatttccagtctttgcctgtgtttgtcagtccattcgttttgttttgttttgtttttctttaaatagagatggggtctcactatgttacccaagctggtctcgaactcctgggctcaagtgatccgcccgctccagcctccaaaagtgctggaaatacaggcatgagccaccgcgctcagctagtgcatttgatttttaagggggaggggaatggaatgtctgatgtcttgggaaaatccttccatatatgatctttcacagaatgtttctcttcagacttcaaactggttaggatgagcataaaagcatagccttgaaaagggtcacgggaggctatacttagagcagaaagtggtggccaggggtgaagggcctcgctactttggttcatttgttcattcagcaaataataaacatgatatgtaaggaggtaataagtggtttggagaaaaatagagaaggaaggaccatggggaaggagttgggagttgtcattttatagagggtgttcagggaaggtctctagtaaggtgacctttgagcagagataagtgagggagcaagccaggtagttctcttgtggcagagcattccgcagcaaatgcaaaggtcctgtggtcatatgcctggtgatttgaagaaacagcataagggctcacgcttgtaatcccagcactttgggaggctgaggcagccggatcacctgaggtcaggagttcaagaccagcctggccgacatggtgaaaccccatctctactaaaagtaccaaaaaaaaaattagctggccgtggtggctcatgtctgtaatccaagttactcaggaggctgaggcaggagaattatttgaacctgagaggtggaggttgcagtgagccgagattgtgcccattgcattccagcctgggtgacaagagtgagactctgtctcaaaaaaaagaaagaaacagtgggaggatgggggactggagcaggttgaagaaagggaagagtggttggcaagaaagtcagagaacagtggggaccagaaaaaggtggggaagacatcaggggctgtccttgtgatacagggtcacagggtgtctaatgggacaccctttcagaaccgtacttgttgaagtgtctggtggttggagaaaatacagatttgttttagatgacaaatggccattgtgcttggggcttcggttgtaagtacccttcttccatctttgtaatgaccattgatggaacaaatacaaagaatcatggtcacagagaactgcgattaaatcaagttaagttatgccgctgcttcctggttgtgagaaggtgggcacgggacctttttccacctcaatcttctcatctggaaaatacagcaggctgggtgtggtggctcacacctgtaatcccagcactttgggaggcaggtggatcacctgaggtcaggagttcgagaccagcctggccaacatggtgaaaccccatctctactaaaaatacaaaaattagccgggtgtggtgacgcatgcctgtaatctcagctactggagaggctgaggcaggagaatcgcttgaacctgggaggtggaggttgaagtgagctgagatcatgccactgcagcactccagcctgggcgacaggagcgaaactccatctcaaaaaaaaaaaaagaaagaaagaaaagaaaagaaaatagggctgttggattagataaaatcatgggctgaagtgcttaatgcagtatttcacacaaagtgctcaatacatagcggtcacgctgatgaggatgatgtgatgatgaggaatgtgggcatgtatgtctgcctcagagccgttcgttttagcactagctggtggtgtcaccagctctagctgcctccatcaactagtaggatttgaggaaatattggggaaagcaagacagaaacttcttgacacccctcagaggtaactgggttaatattctgcagagaagacgttagcttggtcctggcttttctgacagcagcggagggtgatggggacttttaaaaaagagcccagcactgccagcgctttgggaggatcgcttgaggccaggagtttgagaccagtctggagaacatagggaaaccctatctctaaaaaaaaaagaattaaaatgagcccagcaaatttccattctaccacgtaaaataggcaaaatgagggtgttgaaatgaatgtgacttggagacaggtggggaggggcagtgtatgctgggcctagatatgtggttggagtgtgcgtggctgatctacgggtagaggctggtgatccggaagtgcccggcagaggctgagactttccagcctgctttataggaagcagaaccacagttgatctccctccttataccccaagcccggactatatcctcaggcctgggacacaggctgagcagggcaactgggccagagaatttgaaaatgaaaggtcagagcacttaggagctgagagccagcatgttggggtaggctgttgtgggtagaaccccaggctggtgacctgcggacctggttcaaatcccggctctgctgttggcttgctgtgtgagttaggcaggttccatctcctctctgggcctcagttttcctatttgtagattaagaataatggccttcccttgcctccgactaactctaaaggctgttgggaggatgaaatgagacacagcttgtgaaagaattaggtgtgttctgaagctctctacaaaggtattatcattagtaccactaggattatgcagacacgttttgggggcccactagctggaagactgctcttggcactctggtttttttgcttggcttcagtacctcatctgttctggagtcctgagaggtgagtgcagagacccctgtctggttatctatttgtggaccactgtcttatatctggcgcaatcgctgaaactgattttccagcttcagagatgcagaagggtctcttgaagcattattctcaggaacatcactcttcataattattggttaccaccttcctgccatcctttcatggcatctcctcagcaaccctgttcacaacacgcgcaacacagcgtgtgccactcgcaacatgctgacaggtaaggaccttgataaatattgaggctggaaaacattggctggggatcttgtggagccgaggccctgtcactggcattgagccactcacatactctgtaatggagaccccagaaatcacatagggtccctgccctcaggaagctttcaatgctgtggccaaaaaatgacatgccacggagtggttaccagcagtactggatcatgtgagctcagtgcctgagttgtaaggaagcggcggaggctcgtggaacagaagggaaagctgaggttggagaaatggtccctccccatagcataatggcaaggggctcgaactttagggtcacacacttaccggaggaacaactcattgctcatctttcaaccattgtttccttatctgggaaacaaaatgataatgtattatcatattgataaaatgttatctgtggcagctgggtgcggtggctcacacctgtaatccagcactttgggaggctgaggtgggcgtattgcttgagcccaggagtttgagacaagcctgggcaacatggtgagccctcatcgctacaaaaaataaaaaaattagccaggtctgttggtatacgtctgtagtcacagctactccagaggctgaggtgggagattgcttgaacgtgagaggtggaggttgcagcgagctgagatcgtaccactgcactccagcctgggtgacagagtgagaccctgtctcttaaaagaaaaataaataaataggccgaccgcagtggctcacacctgtaatcccagcactttgggaggccgaggcaggtggatcacctgaggtcaggagttcgagaccagcctggccaacatggcaaaaccctgtctctactaaaaatacaaaaattagcctggcatggtggcgggcacctgtaatcccagctacttggttggctgaggcaggagaattgcctgaacccaggaggcagaggctgcagtgagccgagattgtgccattgcactccagcttgggcaacaagagcaaaattccatctcaaaaaaaaaaagaaagaaaaataaataaataaataaataagttatctgtgactttgatgcgaactgcttggaaagctggacacactgggtctttttttttttttttttttttttgagacggaatcttgctctgtcacccaggcaggagtgcagtggtgcaatctcggctcactgcaacctctgcctcctaggttcaagcgattctcctgcttcagcctcctaagtagctgggattacaggcatccgccaccatgcctggctaatttttgtatttttaatagagatggagtttcaccatgttggccaggctgggctcgaactcctgacctcaggtgatccacctgccttggcctcccaaagtgctgggattacaggcgtaggccactgtgcccagcctgacacactgcgtcttgaactaatgaactacctgtgtacatatctgtctgttcagatccatagtctctggcaaattgcatagccatagccccttccttccagctgccttttctgtaagttgtagatggtaactcctgccttgttgggtgttgagagaattcaattaattaacacatataaaatacttaacagagttctttttttttttttttttttgagatggaatcttgctctgttgccaggctggagtacagtggtgcaatcttggctcactggaacctccacctcccgggttcaagcaattctcctgtctcagcctcctgagtagctgggactataggcgcccgccaccacgccctgctaatttttgtatttttagtagagacagggtttcaccatgttggccaggatggtctcaatctcttcacctcgtgatccgcccgccttggcctcccaaagtgctgggattagaggcgtgagcctccacgcccagccagaattcttggtatatacttggtattcagtatgggtaggatcattaatacatttggttacaagaatagaacccaaccagtctgattactagccgaatgcagcctcctcaaggcctctctgtctccagcatcatgagcagccacctagctgtgaggcacactccccaattattgtgtgtctgcatctttctgacataacccaactcatagatttaatctctgcagacttttcagagccaggtggcgtctggttttcacctgtttcccgaccacctggagatccccacacttgctgtgactcccctcacacccccagtctctggcccttgatctgctgcctcctggaaagcgtctagcctctgtaaatagggcatttgtttgggttttccccccagctcctaggttaatatttcacagggtgagtactgctccaaggctcagagcttctggctcccccaacctctctgtcctctgggtatcaggacactggtgggatcccatgctcccacctccagacttcagtttctctttccctcccattgtttggatggatggactgaagaccaaatatttggtgagaagcgggggtctgctttaggtttgcatcccactctcatcagttttgtgatctcaggcaagcttctgcttagttgtgtatgcgtcagtatcttcatcagaaaatggggtaataatctctatcttgcagtactagagtaagggaattccagccacagcaaacctttgttctattaaacaccaggcataaattgggcaccgaagtcagacaccaaggatacaggtgcgtgcgcgcttgcgcacgtgtgtgtgtgtgtgtgtgtgtgtgtgtgtgtgtgtgtacatgtgcatggatgcaggcatgcaagcaagcatacagcttctgtcctcccagagctcacaggcagtaggagggtgtcagttgacaaattgttatgtaaatgattaattagttgcaagtacagggtactaggaaatattttgtcggttgagtaagagactcgagggagtaaagcctgtaaggagcttaggaccacatctggaagcagccaacatggacgtggtatggcggtgccttctgctgctgctgctgctggtgctgtttttctctctcttctctcccacttccttcattccccaggatgtcgaatgttcatgatagacctagtattagagaacatgcaagaaaagggatggagaaagacacagggttctcccagtgtggtggtcggtcataaccagagctccctctgtcctcagttgctggaattccagatggcctgtgactgccctgagaatgacaatccctaaggaatggagtaggtagagtggagtaggtagagatggctgcctctggcaggtgccaggcccgcagctggatgggtctcagggcatggtagccccggggcccttcagtctctgtgccaggatgtaagatggctgcttcctcttccagctcattccagccctgagtggcaaggtcaacactgctaaggggaggctagcagatggcgccatctacctggcttatgttttgggggcttttggtgaccgtgacaactgacgtggtggtgtttcttccacttggggagcatggtaagggcagagcagctgcctaggtaactgggctcagacctgcagaaaaggcaaaaccccagtggctctccctcattcagagcctccgagccaagaggcatcatttgcagccactgggcgcccagcagtgtcctgagtgcagcaagcagggagaatgcgagagtgtactatacctcccaggcctcgtgcagacctctgatggcgagtactttgtcattccttccacaggcctttgttgaaacctcaccttgtggcaggccccacattgagtgttcagtgcttcctttgttcatttagcaaatagtcatggacctgggcccgtagtgccaacgtcccatgcaccccctctccttgcagcttaggtacttctttgcttcctcccaaagcgccttccccttctctcccctccaccagagttaactaggacttatcttttgggtcccagctgaaatgtcacttctttttttttttttgatggagttttgctcttattgcccaggctagagtgcaatggtgtgatcttggctcactgcaacctccgcctcccgggttcaagcaattctcctgcctcagcctcccgagtagctgggattacaggcgtgcgccaccagcccagcttatttttgtatttttagtagagacggagtttcaccatgttggccaggctggtctcgaactcctgacctcaggtgatccacctacctcagtctcccaaagttttgggattacaggtgtgagccactgcacctggcctgaaatgtcacttctaaggatacctgctctgactccccagtccagggcaagtcccctgattgggcatccagagccccaggccccttctcctgcaagacactggtcccagttacgcgacaggcgcttatgggccctgtaggtggatctgtctccctccggagccagtacgctccatgtggtcaaggaccttgtccggctcgctcaccaaggacccccagtgctcagcagggactgagtgagcaggtccagggaggtgataccaaacaagacagcctggttttgccctcatggacctggccatccatcaaggatgctgaatcatcaaagccacatcgtaccaagtgttcattgctgtggtagatcgggcctgtggggggactcagcaggcacaccctggtgggttaagcatggcttcccagaggaagtaactttgacactgggaccataggtatcagctacgtgaaaggagagttcaaagatcatgtgggctggagtggccaggagatacttcctggaggaaggacatggagtgtatttgggtaggggaggggagaaggcagtatttaaattagaaagtgcagtaattagttgaatttggatggtcctggttgaaagagaacagactgggcaaaggtctgaaggtgacctgtgccgagggccttttgccaggacagtgaatgatgaggccaggctggctggagtaggggggcagtggggaccaagtaggccagaaagctggctgtaattccggtgggcttgaaaagagttgctttccaagagtggggactctctgccagcagtgctccctctggttccagtttcccaggcaagagaggctgctgggctcttaaagatcttgaagcaaatgaaggcaaaggaaggccatgcccggggcccaggcatcctggcttttgtgccttccctcgagggtgccatgctgccagtgggacagctgacacaatgagccttgttgtgggagacccaggccggggagcacaggcccggagctgggagccagggcagatgaggtaggagaaggtaatgattataacaacaacataataacggttgtctttattgagcaatgactacatgccagacaccgttctaagcccttttgatattattccatggaatcttcacaccgtgctggggatgaggtattgtgctgcttctattttagaggaaaagtgactgaggcacagagaggtggagacacttgcccaagtttgtctcctcgtgagcagcaaggctgaaatgtgagctatgcctgcctgaatccacagcccatccacacacagtccccagtagacagtggtgccacagttgaactcagaactggctgattccaaagcccagtgtgccctgtggcttcccgctggatttcctgagcagtctggaaggtttacaaatgggcacagagggaggctcccagaagctgggacaatgctgggccccagaactccagaaccctctaagtcaggggtgtccaatcttttagcttccctgggccacactggaaaaggaactgtcttgggcgacacgtaaaatacaccaacactaacaacagcagatgagctaaaaaaaaaaaaaagtccataaatgtcataatgttttaagaaagtttacaaatttgtgttgggctgcattcaaagctgtcctgggccacatgcagcccatggaccacaggttggacaagcttgctctaagagatgtgagggattccacgagaccaggttccagtctagtttacacagctccctctgtttgaccttgagtttcctcctctataagatggggtcagccgggcgcggtggctcacgcctgtaatcccaacattttgggaggctgaggcgggcggatcacaaggtcaggagttcgagaccatcctggctaacatggtgaaaccccatctctactaaaaatacaaaaaattagccgagcgtggtcgcaggcgcctgtagtcccagctacttgggaggctgaggcaagagaatggcatgaacccaggaggcggagcttgcagtgagccgagatcgtaccactgtattccagcctgggtgacagagtgagactctgtctcaaaaaaaaaaaaaaaaaaacaaattatggggtcatagggctggacatggtggctcatgactgtagttccaccattttgggaggcgaggcgggtggatcacctgagctcaggagttcgagaccagcctggctaacatagcaaaaccccgtctctactaaaaatacaaaaattagccgggtgtaggggcaggtgcctgtagtcccaggtactcaggaagctgaggcaggagaataacttgaacctggaaagcagaggttgcagtgagctgagatggtgccgctgcactccagcctgggtgacagagcaagactctgaaaaaagaaaaaaaaggtggggtcataaccaccatgttgtgtacttagtctgttgggctgggactaagcatttcttcaacattatctcatttagtaccacagccctgtgaagtagagattattatccccccctccctttttttttttttttgagacagagtctggctctgtcgcccaggctggagtgcagtggcgcgatctcggctcactgcaagctccgcctcccgggttcacaccattcttctacctcagcctcccgagtagctgggactataggtgcccaccaccacgcccagctaattttttgtatttttagtagagacaggtttcactgtgttagccaggatggtcttgatctcctgacctcatgattcgcctgcctcggcctcccaaagtgctgggattacaggcgtgagccaccgcgcctggcctattatccccatttttcagatgaggaaactgaggtctggagaggttaagtaactttttttttttttaaacggagtctcgctgtgtcgccaggctggagtgcagtgtcaccaggctggagtgcagtggcgcaatcttggctcgctgcaacctccgcctcccaggttcaagtgattctcctccctcagcctcttgagtagctgggattacaggtgtgcaccacaacacccagcttttttttttgtattttggtagagacggggtttcactatgttggcctcaatggagaggttaagtaattttacagtgaattgtataactgggtcaaaacatagatctgtctgaccacagagcctgcacttaaaagaaaacttttggggctgggtgcggtggctcacgcctgtaatcccagcactttgggaggccgaggcaggcggatcacaaggtcaggagattgagaccatcctggctaacacggttaaaccccatctctaccaaaaatacaaaatattagccgggcgtggtggcacacgcctgtagtctcagctactcgggaggctggggcaggagaatcgcttgaacctgggaggcagaggttgcagtgagctgagattgccccactgcactccagcctgggtgacagaacaagactccgtctcaaaaaaataaaaaacttttatgaagtataacatacatgagagaccaggcacagtggctcacgcctgcaatcccagcattttggaaggccaagatgggaggatcgcttgagcccaggagttcgagaccaacctgggcaacacagaaagaccctgtctttactaaaaattaaaaaatttactgggcgtggtggcacatgcctgtggtcccagctactcaacaggctgaggtgggaggatcgcttgagcccaggaggtcaaggctgcggtgagccgtgatcataccaccacactccagcctgggcaacagtatgagactctgtctcagaaaaaaacaaccaaccaaacaaacaaacaaaaaaatacatacataaggaaagatgcacaaaatatgagtatagagtctgattaatttttttctttttttttgagacggagtctcgctctgttgcccagactggagtgcagtggtgccatcttgggtcactgcaagctccgcctcctgggttcacgccattctcctgcctcagcctcccaagtagctgggactacaggtgcgtgccaccacgcccggctaattttttctatttttagtagagacaaggttttactgtgttagccaggatggtctcaatctcctgacctcatgatccacctgccttggcctcccaaagtgctgggattacaggcgtgagccaccatgcccagccgccattttcttaactttctattcaattacaatattcgggccaggcacggtggctcacatctgtaatcccagcactttgggaggcagagatgggcggatcacctgaggtaaggagttcgagaccagcctgagcaacatgatgaaaccccatctctaccaaaaaaaaaaaaaaaaaaattagctgggtgtggtggcaggcacctgtaatcccagttactccagaggctgaggcaggagaaccgcttgaacctgagaggcggaggttgcagtgagctgagatcgtgccactgcaccccagcctagatgacagggttagactccgtctcaaaagaaaaaaaaaaacaatattcactggctgggcgcggtggcccatgcctgtaatcccagctactcgggaggctgaggcaggagaatgacttgaacccgggaggtggaggttgcagtgagccgagatcgcgccactgcactccagcctggtgacagagcaagactcagtctaaaaaaaaaaaaaaaaattcacttgaaaaagtacacacatcatgatacacaggtcggtgaagattcacacagtaagcgagcctggatacccagtactctgatcaaggagactagaagctcctcagcacccagaaactcccttccaatcacctccccgggtaaccacagtcctcacttctcccaccacagatgagattcccctgattttgaacttagtggagtgacacagtgtagatccttttgtgtctgactcctctcattaaatgcagtaagggttggccaggtgcagcggctcatgcctgtaatcccagcactttgggaggcgggggtaagcagattgcttgagcacaagagtttgagaccagcctgaataacatagcaagatcttgtctctacaaaacaaaaaacaaaaaacaaagaaaccagaaagattagccgggtgtggtgatgcatgcctgtagtctcaggtactcaggaggctaaggtgggaggatcgcttgagcctgggaaatagagggtgcagtgagccaagatcacaccactgcactccagcccaggtaatgagattctatctcaaaaattaaaaattaaggccaggcacagtggctcacacctgtaatcccagcactttgggaggccaaggcgagcagatcacctgaggtcaggagttcgagaccagcctggccaacatggataaccctgtctctactaaaagaaaaaaatacaaaaattagcccggcgtgatggcgcacgcttgtaatcccaggtattcgggaggctgaggcaggagaatcacttgaacccaggaggcggaggttgcagtgagccaagatcatgccactgcactccagcctgagcaacagagcaagactctatctcaaaaaaaaaaaaaaaacctaaactaaaaattaaaaaaaaaaaacattgtaagccttatccaagctgttaacaggagtttgtgccttctcattgccatgcagtatttagtagatgaatataccataattatccattccaatgccagtggacatgtaggttcttttctggttttggccattacaaatagtgctgctgtgaacattctagtgtagatcttttggtgcacatttacttatgcatttctgttgggtatatacctaggagtcaagttgctaagtgttgaacgtatgtacgttcagctttagtaaatagtgaatagtgttaaacactgttcccattgtattcccagttcacaccaatttgccctgccgccagccctgtgggagatttcccactgttccccgtcttccccaatgccaggtattgcccatgttgttgttgctgcagttgcgttcagttgagccagtgggcgtgtggaaaatggcatctcattgtggctttactgtgcacttccctaatagtaaagaagctgagtgcttttcacatgtttgttgtctgtttcactatcttccttcatgaaatgcctgttcaaatctttcactctttttttttttttgagacagggtctggctttgttgcccaggctagagcgcggtggtgcaatcacagctcactgcagcctcaacctcttgggctcaggtgatcctcccacctcagcctcccaagtagctgggactacaggcacatggcaccgtgcccagctaattttttttgtattttttgtagagacagggtttcgccatgttgcccaggctggtcttgaactcctgggctcaagcaatttgcccacctctggctcccaaagtgctgggattacaggcttgagccactgcacccaggctctgtgtggtaacttttgatgaacagagtttttaattttgaggcagtccaatttatcagtttttttctcttcatgtgaaatcattgcctaaagtcataaagatatactcctgtgttttcttctagaaaccttattgttttaactttcacatttatatctatcatctatctcaaattaatttttgtgtatgcatgaacagaagtttctttgctttggtgtagataagtttatgattttctacctcctggttagcacctcttgagtcctagttaggaaatctttagctgtgctaaagtcatgaagctagtaggagacttcacttttttaaataacagttttactgagatatatataattcacatgtcacacaattcatccatataaagtatataattccatgatttttagtatattcatagagtgcacccatgaccactgtcaattttagaccattttcatcaccccaaaaagaaactccatacacactggcagttactctcctttttcccaaccacaaacctacttctgtctctatagatttgcctatcgtcactggacatttctatcagaggaatcatacggtatatgactttttttttaaactgatttctttcactcaacataatgttttcaaggtccaacattatagcatggatcactactttttatgactgaataatattccactgtatgaatatgtaacattttgttgatccgttcaccagttgaaggacatttgggttgtttccactttttggctcttacaaataatgttgctatgaatggtcacatctgagtttctttttttgagatggagtctcactctgtcgcccaggctggagtgcagtggcagggtgtcggctcaccgcactccgccattctcctgcctcagcctcccgagtagctgggactacaggcgcccgccaccacgcccggctaatttctgtatttttagtagagacagggtttcaccgtgttagccaggatggtctccatctcctgaccttgtgatccgcccacctcggcctctcaaagttctgggattacaggcatgagccaccgtgctcggccacgtctgagtttctatgtggacatatgttttcattgctcttgtaaggagccttcatttttaatcagacaccatgagattcagtgatatcatgtctatatgtctattaagccctggcacagcctaagtgctcaatcaatcatagctgtatacaggttaggaagtactgcacagcatggaacaccccagtgtagctcttcagactgtgggaagctgaagagtgaaaatctgtattatccccacccaagcactgggtccccagcacacacgtctgctcacaggcaaataagtgcttggacaaggctccatgttctttgcaggtcaaattgtgcatagatagtggcacagcagaggcgggtgaaagaaggagtcaggagacctgggcctggccctgctaagctgctaattggagtgtggtctcagtttccctactcagagcgtggacatgggaccactgatagttctagcccttgtgtgtggctcacttggcatcttgtccactccccaggcagtggctctgccaatgatcctgtgagtattcaggaatcactgttgcccctggggatccttgtcctggagtggcccacctgcttgcccccagcatggcgtccgacactcccgagtcgctgatggccctctgtactgacttctgcttgcgcaacctggatggcaccctgggctacctgctggacaaggagaccctgcggctacatccggacatcttcttgcccagcgagatctgtgaccggctcgtcaatgagtgagcagacccagggctgaggaggggcaggggtcttaccatgaatgtgtatagagagattgggaccgtgtgtgcactatgtggggagtagctatggagatgaatgtgtgagggtgtgtgtgtgtgcacatggatgttcatggctgcaagagaatagtggtgtatccataaccgtaaaggtgtatatgtgtgtgtgttggtgtgtgtgtggaggggtgtgcacgtgaaggcatgggtgtgtgtacacatgtaagcttatgcagcacaggttatttctgactgtgaaactgcatgtgtgcatttagagatgtgattgtgtcaaaatctgcatataaatgaaggaattaagtgttgccccacacgtgtatgtacattcacatgcacatacctgtgcttgtgaattcagtgagcatggccacatatgcatgtacatgccggtgccagaataacggatccatgatcagggagtgaatcatccagaaaatctgaatggccctccgagggcctccccactcctaggggctcctagaagcatgctatgcagtcactgaatgctgggagttcaatctacaggcccagatggtggccaggcatggtggctcacacgtgtaattccagcattttgggaagccaagacaggaggatcacttgagaccagaaattcaagatcagcctgggtgacatagcgagaccttgtctctaccaaaaaaaaaaaaagaaaaagattcccagaagggaaattattagacagctgcataggaaactagaagcctgtgtgggcctgaggacagaggtggacctgtaataacgtcctgagcatttaccgtgggtcaggctttaggttggacactttgcaggccatagttatatccactttacagatgaagaaactgaggtctgggaaagttcatttacttgtgtgaagttgcccaggtaggaagcagccaagccaagatttagagtctaaagcgtttgaatccaaagcatttcccagcagaccaggattcttgcatgagctgatgtctcaacagggcttcattaagggcttgtcctgtacccagctgggaactctgaactacttggcttagtttgcctgtttaaaagggtcgcaggaggggcttaaagaaggtgacgagagtggccatgccagtggggctgctgcccctgcagtgtgcgtgcgtggaggctgtgtgacaggcatgtgcactgggagagatggcgcctgcatcacctagaaggtctcccagagagctgcctttagattcctggttcctgggcacccttaatcttactggtagtttagtcaggatctgaccagatactcttaggagaaggaggttgctacttggggtgatccaagaaagcttcagggggaggagggcttggctttgaagcgaggatgagagtccctgtggccctctcctgagccaggcttttttctctcccaggtatgtggagctggtgaacgctgcctgtaacttcgagccacacgagagcttcttcagcctcttttcggacccccgcagcacccgcctcacgcggatccacctccgtgaggacctggtgcaggaccaggacctggaggccatccgcaagcaggtgagacctgccccgccacagcgccaggagggcccacaccaagcaggggccaggctgctcgcctccagcccagccatccccagcccagccagtgtgcaccgtgactgtgcacatccccctttccaacccacctgtagcccagggcaaggcctggggccgggggaaggggcaagggtggtgatgatgatggagctgtgcccactcccaggacctggtggagctgtacctgactaactgcgagaagctgtccgccaagagcctgcagacactgaggagcttcagccacaccctggtgtccttgagcctcttcggctgtacaaacattttctatgaggaggagaacccagggggctgtgaagatgagtacctcgtcaaccccacctgccaggtgctggttaaggatttcaccttcgagggcttcagccgcctccgcttcctcaacttgggccgcatgattgattgggtccctgtggagtccctgctgcggccgcttaactccctggctgccttggacctctcaggcattcagacgagcgacgccgccttcctcacccagtggaaagacagcctggtgtccctcgtcctctacaacatggacctgtccgacgaccacatccgggtcatcgtgcagctgcacaagctgcggtgagctcctggcccagagctcaccagggtggggtttggggggcaggtggggaggagtagaggtgggtgttgtcacgccctcagggttcaggagcgcttggctaggcagagggtggggatgaagacacagtcccattccttaaacccagtgtttcagctggattggggctgtttggggtttcttcccagaatgccctggggaagttgtggcaggaatgggccctcccctgctacagactaaaggagctgggatctgcaaggcagccccaccctgtacccagctcctaacctgcaccccctaccccaatcttcagacacctggacatctcccgagaccgcctctccagctactacaagttcaagctgactcgggaggtgctgagcctctttgtgcagaagctggggaacctaatgtccctggacatctctggccacatgatcctagagaactgcagcatctccaagatggaagaggaagcggggcagaccaggtggggccccagcctccatggctactggtagggtgtcattcaacaggcatttaggctggcgcagtggctcacgcctgtaatcccagcactttgggaagccaagatgggcggatcacttgaggccaggagttagagaccagcctggccaacatggtgaaaccccatttctactaaaaatacaaaatttagctggacatggtggcagacacctgtagtcccagctacttgggaggctaaggtatgagaattgaagccgggaggcggagcctgcagtgagctgagatcgcgccactgcactccagcctaggcaacaaagtgggactttgtctcaaaaaaaaaaaaaaagaaagtatttgccaagtacccctctgccaagtgctgtgctgggtgctagagataaagaaacaaatcaggtcctgccctcttggaggctgtgtgagctggtggggacaatcaagtcattacaagggctatggtaggggcaatccagggccccggtgtggcctgaggatcaggaaggaaggaggaggagggacgcatcctggctgtcctgaaagctcattctgcctctgccagaggaagcgtgttctagcagagggaacagcacctgcaaaggccagtaggtgagagcatgaggagcgacaggggaactacccaacactcagcctgaccagagcacagtgccatggggggaagaggcaaggctggcagtgtctgccacctatggagtattgctggacataggtcggttcttggattggttggttgagaagtttgaccaaaccctaccagctgtaactggccacccataagccctggccccagcctgctttaatggtgttcagttgagcttgtccctttgtgattgttggtgagacctaaaggtgccatgtccttactagaatggcaggtggtttctaaaggtggctgcattgcccatcctatgtgttcccctactatgtggctttgccatgcttccatcaggaggtggtgcttatgtcccctaccattaaaaacaaaaggagtaggggatgaggttggagggcctagaagagaaagcaaggaaatgcctcaccacccccagtggggaggcccagctcaggcctgggtcccaagccactgacaccggcaccctctttccccagcattgagccttccaagagcagcatcatacctttccgggctctgaagaggccgctgcagttcctcgggctctttgagaactctctgtgccgcctcacgcacattccagcctacaaagtgagcagtggaagtgggatgggtctgggccagggagccttgggagagagaaggagctggattctggggctggagactgagctgggatctggcatcccagcccttggcctctgctgggttgttctgagcgtgtcccacccgcaggtaagtggtgacaaaaacgaagagcaggtgctgaatgccatcgaggcctacacggagcaccggcctgagatcacctcgcgggccatcaacttgctttttgacatcgcccgcatcgagcgttgcaaccagctgctgcgggccctgaaggtcagctccaagcctggggccttggcctcctgtccctccccacctggaggttgccgggcttggctgagccgtgtccccagagcctgtgtccttctgcaccctgtccccagggccccaggacccgaaccccagcctgggcctcacagcacttgacttgcttcagcactggccttgtttggtccccaccctggtgtctgctccccaggccccacttctgcctttagagagcaagaccaggctaaaccttgccccagagagcctgttccagccccttgcagagcccaggcctctccctgcacttgccagcccaggtcccccttgtcttcatacagctggtcatcacggccctcaagtgccacaaatatgacaggaacattcaagtgacaggcagcgccgctctcttctacctaacaaattccgagtaccgctcagagcagagtgtgaagctgcgccggcaggttatccaggtggtgctgaatggcatggaatcctaccaggaggtgacggtgagcccccacccgccacggccccgcatgctctggcccagccacccctttcctgcttcttgcgtcccgctagggctcccccggctctgggctgcatctgtcccagctccctttcccacagcagcactccctgactcttgggacctggcccttcccacagtccatcactcctggctgccctccatcctcctccctgccccatgtgggggtgggggcccagggaccctgcccttctccctgcctgtgccgtctcctcagcccttctgcccatacactctgctgggggatttcttaccaacagctgcttttaatataaaagtaataaaagcctttattatagaaaagttataattacagatatacagaaaataaaaatcacccataaacccactacccagagacaggcaccattaacatgggatatcaattgtgaattttagcctatgcacacatattttgtaaatgggatacacaaactgcatactgtttgtatatggtggatttttacttcaactgtgttgtcacatgaatatgaacatctcccttatccgccaacaatttttttcttttttgagatggagtttcactcttattgcccaggctggagtgcaatggcacaatctcgggtcactgcaacttccacctcccgggttcaagtgattctcctgtctcagcctcccgagtagctgggattacaggcatgcgccaccatgcccggctaattttgtatttttagtaaagatgggattttaccatattggtcaggctggtctcgaactcctgacctcaggtgatccacctgcctcagcctcccaaagtgctgggattacagatgtgagccactgcgcctggccagccaacaaatttttttttcagatggagtcttgctctgttgcccaagctggagagcagtggcgggttcaagtgattctcctgcctcagcctcccaagtagctgggactacaggtgcatgccaccacacctgcctaatttatgtatttttagtagagacggggttttgccatgttggtcagtctggtgttgaactcctgacctcaggtgatccacctgcctcagcctcccaaagtgctgggattacaagcatgtgccaccacacccagccaacatatttatataacaaaaactttttttcatttcagatgggcaatatgccaacgtcctaacatggtttgagggaggcacatttcacacatgagcatgaagacctaatcatcactcttataaactacgaaaggatcaaacaataatttttatttatttattttttcgagatggagtcttactctgtcgcccaggctggagtgcagtgcacaatcttggctcactgcaatctctgcctcctgagttcaagtgatcctcctgcctcagcccccctagtggctgggactacaggcacgtgccaccatgccaggctaatatttgtatttttagtagagacagggtttcgccatgttggccaggctggtctcgaactcctgagctcaggtgatccacctgcctcggcctcccaaagtgctgggattacaggcgtgagccaccgtgctcagccacaatatatatatatatattttaattaagacagggtctcaggctgggcgtggtggctcacgcctgtaatcccagcactttgggaggctgaggcaggcagatcatgaggtcaggagtttgagaccagcctggccaacatggcgaaaccccatctctactaaaaaatacaaaaattagctggccacggtggctcacacctgtaatcccagcactttgggaggctgaggcaggcggatcacctgaagtcaggagttcgagaccagcctggccaacgtggtgaaaccctgtctctactaaaaatacacaaattagctgggcatggtggcaggcgcctgtagtcccagctacctgggaggctgaggcaggagaattgctggaacccaggaggtagaggttgcagtgagctgagatcaagccaccgaactccagcctgggtgacagagggagactctgtcacaaagaaaaacaaaaacaaatacacagggtctcactttgttgccaaggctggagtatagcggcatgatcacagctcactgtggcctccacctctcaggctcaagcaagcctcccaactcagcctccccagtagctgggacaacaaggcatgtaccaccacacccaactaatttttttttttttttttttgagacagagtctcgctctgtcacccaggctggagttaagtggcacgatctcggctcactgcaagctccacctcccaggttcacgctattctgcctcagcctcccgagtagctgggactacaggcgcccgccaccctgccacgctaagtttttgtatttttagtggagacggggtttcactgtgttagccaggatggtctcaatctcctgacctcatgatccgcctgcgtcggcctcccaaagtgctgggattataggcatgagccaccatgcccggcccacagtcagctaatttgtatttgtgtgtgtctgtgtgtatgtggtgacggggtctcgctgtgttgcccttgctatcccctagctcaagtgatcctcctgccttggtttcccaaagtgctgggattataagcatgagccattgcactaggcccaaaaattgtttaataatgtttcttttctgattacaaaagatatctaatgcttaagccaggtgtggtggccctcacctgtaatctcagcactttggagggccgaggaaggcagatcacttaagatcaggagttccagaccagcctggccaacatggtgaaaccctatctctactaaaactacaaaaattagccgggcatactggcgggtgcctgtagtcccagctactccactccggaggctaaggcaggagaattgcttaaactcgggaggtggagatttcagtgagctgagatcgtgccactgcactccagtctgggtgacgaagcaagactctgtgtcaaaacaaaaccaaaaacaaaaaaaagatacctaaatgcttaaaagatgaaaaaattcaagtgatacaagaatgtattaaatagagcgaaagccacttacaatctcacctctcctcctctagatgcagctggtgttaaggctcactttcatgactgctgacaccagcatatgttcagtgtcctcatccagggagaggccactgtgtggaggactctgctggagcttggagggagtggccaaggtcaaggctctgcccagtgtgtgaaacagcccccagggccaaataatttaggttgctgtttcatcttttgctctctcaagcaatgctttgttaattatacttaattagttatccttataatacatttctgtaagtagagttgtagaatttcaggggcagtatgtgtgtgtgtatattttttcttttctttttttttgagacagagtctctgttgctcaggctggagtgtagtggtgtgatctcggctcactacaacctctacctcccaggttcaagcgattctcctgcctcagtgtcctgagtagctgggactacaggagcatgccaccacgcctggctaatttttgtatttttaatagagacaagatttcaccatgttggccaggctggtctggaactcctcctagcctcaagtgacctgcccacctgccccttctctacaaaaaaatttttttaggccggcgcagtggctcatgcctataatcccagcactttgggaggccaaggtgggtggatcacctgaggtcaggaattcaagaccagcctggccaacatggtgaaacccggtctctacttaaaatacaaaaattagctgagtgtgccggtgggcacctgtaatcccagctactcaggaggctgaggcaggagaatctcttgaacccaggaggcagaggttgcagtgagccgagatggtaccattgcactccaacctgggtgacgagagtgaaactctgtctcaaaaaaaaaaaatttttttttaattagctgggtgtggtgctatgcgtctgtagccccagctactcggaggccgaggtgggatgattgcttgagcctgggaagtggaggctgcagtcagtgaactaagattctaccactgcactctagcctgggcaacagaggagaccctgtcttaaaaaaaaaaaaaaaaaaaaggaaaagaagagagaaaaagaagactagttggagactcccaaatgaattaataaatctgtcacagaaatggaaatcaaaataagaggaagtcacatttcatctcaagagcttggtgatacccagtgttgcaaagatagggaagagcaccctcacaccctgtctactggtaagggatgaatcgtgcaacctttgtgaagggcaaccagcagaacctgccaaaattctaaatgcatctatcttttgacctagccattctgcaattagaactgttcttagaggaaaaagatatatcctcacttgtaaaatttttttgaaaaaggccgggcacagtggctcatgcctgtaatcctcacactttgggaggctgaggcagatggatcacttgaggcaaggagttctggaccatcctggccaacatggcgaaactccatctctaccaaaaatacaaaaattagccgggcgtggtggtgtgtgcctgtaatcccagctactagggaggctgaggcaggaggattgcttgaacccagaaggtagaggttgcagtgaaccaagatggtgccagtgcactccagcctgggtgacaaagtgagactctgtctcaaaaaataaataaataaaataaaatttaaactgaaaaaaaggcggggtgtgatggcacatacccagaaatcccagccaccttggaagctgaggtgtgaaaaatttcttgagcccaggagttcgaggctgcagtgagctatgatggcaccactgtactccaggctgggcaacagagagaccgcgtcttaaaaataaataaaaggccaggcaaggtggctcacacctataatcccagcactttgggaggctgaggcgggtggatcatctgaggtcaggagttcaagaccagcctggccaacatggtgaaaccctgtctctactaaaatacaaaaattagccaggcatgatggtgggtgcctgtaatcccagctacttgggaggctgagacgggagaatcgcttgcactggaaggtggttgcagcgagccaggatcatgccactgcactccagcctgggtgataagagtaaatgagactccatctcaaaaaaaaaatttttttttaattggccagatgtggtgatgtgcgcctgtagtcccagctactcaggaggctgaagtaggaggattgcttcagcccaggattttgaggctgcaatgagctatggtccagcctgggcaacagaatcagacactgtctcaaaaaaaaaaaaaaaaaaacccaaacaaatcaataagcaaataaacctgcagacagtacaaagaaaactgaggatgtagagcaactggagagctcctacactgctggtaggagtgtaaactgctaaagccactgcggaaaacagtctagtgttacctaaaaaggttgaagacatgtacatcttgtgacccagaagtcataccaggcatgtgtgccctaaagaaacccatgcttatggtcaccaggatgcaggtataatacatggctcacagtagccaactcttagagtcacccagacatccatcagcagtagaatggatgaaaaaattggggtgtcatgatggaatactatactgtaatgaaaaatgaatgcatttcagctacgtataacaacagttaatcttgcaaacctatagaatatctctataaaaagcgggggccagccaggcatggtggctcatgcctgtaatcccagcactttgggaggctgaggcaggtggatcacctgaggtcaggagttccagaccagcctggccaacatgacgaaaccctgtctctactaaaaatacaaaaattagccaggcatggtggctggagcctgtaatcgcagctacttgggaggctgaggcagaagaatcacttgaacctgggaggcagaggttgcagtgagctgagatcacgccattgcattccagccttggcaacaagagtgaaactccatccaaaaaaaaaaaaaggccctgcacggtggctcacatctgtaatcccagcactttgggaggctgaggctggtggatcatgagatcaagaccatcttggccaacatggtaaaaccctgtctctactaaaaatacaaaaaaattagctgggcatggtagcacgcacctataatcccagctacttgggaggctgaggcaggagaatcgcttggacccgcgaggcagaggttgcagtgagccactgcaagattgcaccactggactccagcttggcaacagagcgagactccatctcaaaacaaaatgctgggcacagtggctcatgcctgtaatcccagcactttgggaggccgaggtgggtggatcacgaggtcagaagttcaagaccatcctggccaagacggtgaaaccccatctctactaaaaatacaaaaaattagctgggcgtggtggcagttgcctgtaatcctagctactcaggaggctgaggtagaaaattgcttgaacgccacaggcaggggttgcagtgagctgagatcacgccactgcactccaccctgggcgacagagtgagactccatctcaaaaaaaaaaaaaaaaaaaaaaagcaggggccattggaggcgcctgtaatcccagctactagggaggctgaggtgggaggatcacttgagcccgggagggggaggttgcagtgagctgacattgtgcctccacactccagcctgggtgacagagtgagaccctgtctcaaaaactaaataaaattaaagaaagcaggggccaggtgcagttgctcatgcctagaatcccagaactctgggaggctgaggtaggaggatctcttgaacccaggaagtagaggccagcctggacaacatagtgagaccccatctctacaaaaaacaaaatagctgcgcatatggtggcacacagctgtagtaccagctactcaggatgctgaggagggaggatcacttgagccccagaggttgatgctgcagtgagccatgatggtgccactgtgctccagcctgagtagcagagcaagaccctgtctcaaaaaaaataaataaataaaagaaggctgggcgcagtggctcacacctgtaatcccaacactttgggaggccaaggcaggcagatcacttgaggctaggagtacaagaccagcctggccaacatggggaaaccccatctctactaaaaatacaaaaattagccgggcatggtggcacgcctgtaatcccagctactcaggaggctgaggcaggagaattgtttgaaccagggaggtgaaggttgcagtgagccgagataggtccactgcactccagcctgggcgacagagcagcactccatctcaaaaaaaaaaaagaaagaaaaagaaaagcagagatattgtagtggttctctctaggggggtcgaagggctaagggtcttatgatcaggaagggacagtggggacttcggggtgctgacagtgttctgtttcttgacccaggtggtggttacattgagttcactttatgtcatttataaaactatacatttgtgttttatgcattcttctgtatgaatatttcacatttttaaaaaacattttttagagaagacttgtatagcctcctcttccagaaaaccgggctggactgccacaactctggatgagctcatacctctagatagttcctagagccctgctcctgagtctgaccctgaatgtgccccacttgtgtcctgtcccggcccaggtgcagcggaactgctgcctgacgctctgcaacttcagcatccccgaggagctggaattccagtaccgccgggtcaacgagctcctgctcagcatcctcaaccccacgcggcaggacgagtctatccagcggatcgccgtgcacctgtgcaatgccctggtctgccaggtagacaacgaccacaaggaggccgtgggcaagatgggctttgtcgtggtacgtgtggggggcgctgcccccttcctcctgagcctcactgctctcccccacccctctaccctgagcgagagtctcagagcagggcctggggctgggagtcggagagggagagtgtgctgaagcatgagggatttaggctagaccaaaggaagaatttcttaatgctgaatgttgctgatgccctcatagatttcttccacctagagcatgctgtcatcctgtcccagtccctgcgctcatcctgctttcataagctctgtagggaaagatgccatgctgtccttccgtcattgtgtccccagcacttcttggcatgggccctggaggccagtggggagatgataaatatcactggtgaaaggaaggaaagaatgacaaaggagctcaagagcttctggtctcatttgatggcagcgaagctcaagccccagcgggaagggctgtgcccaaagtcacaggggagtcacccgagggccaggaacggcacccgggcctgctaatgccaataccaaggggctgaggcgtggatgccttcaaatagcctcccccaaatatagggagacttgatctcgtcaagactcctgaactagccatggcgttgctgagcctcccctccatcttgggttcgtgggggtgggagttcttcagccccagcactctagcagactcttgtccctgcctgcagaccatgctgaagctgattcagaagaagctgctggacaagacagtaagtcaagtcttcacgaagccacgctaccctttccccacctcgcaaggggcctgggctgcccctgggggaggtctgtgttttgtcaggggcccccctccccgggtaccaggagccttggctgagccctgccctgccctcacagtgtgaccaggtcatggagttctcctggagtgccctgtggaacatcacagatgaaactcctgacaactgcgagatgttcctcaatttcaacggcatgaagctcttcctggactgcctgaaggtagtgtccacctcctgcagcagcagctgcctcagctgcccacatggcccctcttctgtccctaggctccccaccaaccaaatccgcagcacccctcacccatgcttcctggagaagggcagtggggacagactcaggcccacccacccaggatttgctgctgacagaagctccagacccagatggcctggtggggcctcctgagagcccccactcccagggaaagcccctccctgtctcctcggccgttgttctcaggctgcccacagctggccagagcccactacgctacgagctggacagcgggtctgttcatccttaaacacatgctctgttttcctgctttaatttctaggagggtcccttaaactagtattttgagctttggtgaacagaaccacgtctgtcccataggtcagatctctaatcaacctttgtctttgtggcaagcaatcccacccctttaattccttagtgtgtgtacccagcactgacctaggagcattggagggtaggagggcagcatatatgccccctctttgtctagttggcatggccagatgcccatgaagctttttggttaacaataccagatactaagtcattaagtactaattgatgcggcccattggctctccttttcccaggaattcccagagaagcaggaactgcataggaatatgctaggacttttggggaatgtggcagaagtgaaggagctgaggcctcaactaatgacttcccagttcatcagcgtcttcaggttggtatttttaatcctttccctttttgccttagctgccacaatgctcagagctctagcgtttgctcagttgcacaactgctcttagcctaggtttgctataaatgtcattttccctcgataatgtggtttcttattcattcaatccttcgtaagtggtccttttgtaattatatctttttttttttttttgagatggagtcttgctctgtcacccaggctgaagtgcagtggcacaatctaggctcactgcaagctctgcctcccgggttcacgccattctcctgcctcagcctcccgagtagctgagactacaggcgcctgccaccacgcccagctaatttttttgtatttttagtagagatggggtttcaccatgttagccaggatggtctcgatctccggacctcgtgatccacctgccttgacctcccaaagtgctgggattacaggcgtgagccactgcgcccagcctgtaattatatcttaaatgacctcaaatccctttagaagtagtctgggtatatagacgatatgggataaagaaataagtagcacctcttgcttctggttttaagttggggtcctgccgctggtatctgaagagaaactgggggagtgggactccatttttctgtctttctcctggcagcaacctgttggagagcaaggccgatgggatcgaggtttcctacaatgcctgcggcgtcctctcccacatcatgtttgatggacccgaggcctggggcgtctgtgagccccagcgtgaggaggtggaggaacgcatgtgggctgccatccagagctgggacataaactctcggagaaacatcaattacaggtgtgggcagggcagggagcggggatgcggtgtggaatatggggtaagtgctgggcaggatgctcataccattaaggtctgctcagagctcccaccttccttctggtcttctgtagggttctgctttcactcattgatacgtagccgcacacagcacagagcatacataagggcacgatctcatccgtgcagcctggagcatttgtcatacatgccaacatctgcatgtacccaaagcctgctctttgcaaaccactaatacctactgatttgtggggaggggtggggagaaaatagacacacaacagaaaaccatacaggtgggccgggcacagtagctcttgcccataatcccagcactttgggaagctgagacaggaggatcacttgagcccaagatttcctttcttttcttttttttttttttttgagacagagtcttgctctgtcgcccaggctggagtgcagtggtgcaatctcagctgactgcaagctctgcctcctgggttcacgccattttcctgcctcagcctcagagtagctgggattacaggcacccgccaccacgcccggttaatttttttgtatttttagtagagacgagttttcaccgtgttagccaggatagtttcgatctcctgacctcgtgatccgcccacgtcggcctcccaaagtgctgggattacaggcatgagccactgcgtccagctgagcccaagatttcaagaccagcttgggcaacatagtgagacttcctctttacgaaaaattttaaaaatcaggccaggtgcagtggttcacgcctgtaatcatagcactttaggaggctgaggcgggcagatcacgaggtcaggagttcaagaccagcctgcccaacatggtgaaaccccgtccctactaaaaatacaaaaattaacctggcgtggtggcacatacctgtaatcccagctactcaggaggctgaggcaggagaatcgcttgaacccaggaggcagaggttgcagtgaaccgagatggcgccactgcattccagcctgggcaacagaccaagactccatctcaaaaaaaaaaaaaaaaaaaaatgagctgggtgtgatggtgcacacctgtagtcccacctactggggaggctgaggcaggagggtcacttgagcccaggaggtcgaggctgtagtgagccaacatcatgctactgcactccagcctaggggacagaatgagaccatttctttaaaaaaaagaagaaggtcaggcgcggtggctcacacccgtaatcccagcactttgggaggcagaggcgggcggatcatgaggtcaggaaatcgagaccatcttggctaacgcagtgaaaccccacctctactaaaaatacaaaaaattagccgggcgtggtggcatgcgcctgtagtcccagctactcgggaggctgaggcaggagaatggtgtgaacctgggaggcggagcttgcagttagccgagatcgcgccactgcactccagcctgggcgacagagcgagactccgtctcaaaaataaataaataaaaataaaaataaaaataaattaaaaaaacaagaaaacaaaacagggccgggcacagtggctcacacctgtaatcccagcactttgggaggcagaggcgggcagatcatgaggtcaggaaatcgagaccatcttggctaacgcagtgaaaccccacctctactaaaaatacaaaaaattagccgggcgtggtggcatgcgcctgtagtcccagctactcgggaggctgaggcaggagaatggcgtgaacctgggaggcggagcttgcagttagccaagatcgcgccactgcactccagcctgggcgacagagcgagactccgtctcaaaaataaataaataaaaataaaaataaaaatgaataaaaaaaacaagaaaacaaaacagggccgggcacagtggctcacacctgtaatcccagcactttgggaggctgaggcaggcggatcacctgaggtcaggagttcgaaaccagcctggccaacacagtgaaaccccatctctgctaaaaatacaaaaattagccaggcatggtggtgggcacctgtaatcccagctacttgggaggctgaggcaggagaatcacttgaacctggaaggcagaggttgcagtgagccaagaactcgccactgcactccagcctgggcaacagagtgatactccatctcaaaaaaaaaagaagaagaagaaaacaagaatcgttcataatctcactccctgaaagagaactcctgttgacattttggtgtgtctccttccagcagtgtttctatgcacagatttcattactttaagtcaagctggcatcaattcctactgttttgtgactgactggccaatcaccaggcatggatctccctcgtcattttaggacggagtcactttctttgtgccatcctgtacagatggacatttcagttgaaaacccatactgggaggaacaggctgacattggtagcgttgccagtgtgccaagtactatagttcttggggagaaaggaagcggaatcgctggcccaggagttttgcacacacgtgtttcaggcttttggaccatgactccaggctggcccacagaaggccctcgtcagaagagcagtcacaggccggatgcggtggctcacacctagaatcccagccactttgggaggccaaggcaggaagatcacttgagctcaggagtttgaaaccagcctgggcaatatagtgagccctcacctctacaaaaaaaaaaattttttttttgagacggagtctcgcactgtcacccaggctggagtgcaatggtgtgatcttggctcactgcaacccccgtctcccaggttcaagcgattctcctgtctcagcctcccgagtagctgggattacaggtgcacgttaccatgctcaactaattttttgtactttagtggagacggggtttcactgtgttgcccaggttggtctcaaactcctgagctcaggcaatccacccccctcagcctcccaaagtgctaggattacaggtgtgagccattgcacctggccaaaaaaaatttttttttaattagccaggcatggtggctcacacctatagtcccagctcctcaggaggctgaggtgggaggaacacttgcatggcctggaaggtcaaggctgcagtgagctgtgatcatgccactgcactccagcctgggcagcagagcgagaccctttctccaaaaaaaaaaaaaaaaaggccaggcatggtggctcacgcctgtaatcctagcactttgggaggccaaggcgggtggtcaggagttcaagaccagcctggccaacagcaaaatgatgctctaaccaaaaattagctgggcatggtggcatgcacctgtagtcccagctactcgggaggctgaggcaggagaatcatgtgaacccaggaggcagaggttgcagtgagccgagattgcaccactgaactccagcctgggcgacagagtgagactccgtctcaaaaaaaaaaaaaacaaagaaaaaagggctggacatggtggttcacgcctataatcccagcactttgggaggccaaggcaggtggatcacttgaggtcaggagttcgaaaccaacctggccaacatagtgaaaccctgtctctaccaaaaatacaaaatttaggccgggcgcggtggctcacgcctataatcccagcactctgggaggctgaggtgggtggatcacgaggtcaggagatcgagaccatcctggctaacacggtgaaaccccgtctctactaaaaaatacaaaaaaattagccgggtttggtggtaggcgcctgtagtcccagctactcgggaggctgaggcaggagaatggcgtgaaccagggaggcggagcttgcagtgagccgagatcatgccactgcactccagcctgagcgacagagcaagactctgtctcaaaagaaaaaaaaatgcaaaaattagctgggtgtggtggcacacccctgtagtctcagttactcaggaggctgaggcaggagaatcgcttgaacccaggaggcagaggttgcagtgagtggagattgcaccagtgcaccccagcctgggcaacagagcgaaactccgtctcacaaaaaaaaaaaaaaaaaaaaaaaaaaaaaaaaccaggtcacacgtgcttctgttcccagggtgcctctcccctcttccccacaggctgggtctctgctccttgctgaggtctccagctttctgctcctcctaatctgggtcccttgtgcctccctcatgtgcttgtgcctttatcctctccaagggaaccttgttgtgcagcctgccagtgggatgcagggccagctgtcccttctccctggcatcctgccagcctatcatggttggtcactaggattctccagtgggaggaaacctcagacaagaaaagacacactccccaccctcagcatccacagtgaccttgatttcttttcctgcaggtcatttgaaccaattctccgcctccttccccagggaatctctcctgtcagccagcactgggcaacctgggccctgtataacctcgtgtctgtctaccgtgagtgccaacttgtcctgggttcagacactcatccagctgaaagcagatgtgccctcagggagtttgtagtccaggaggggggcattaattgctgctgtcagcttttgtgcctcagagcagaaccctccactttccagcgtttgtgggacacccagcttaagggctcactcctgcctcatcaccagaagcaggcctggcaggcgaaatacctgtgcagagttcctagacagctttcttaatgcttcccgcttccatgtgcaggaacagtccaaaatctccatgcctgctgggctcagtggtgcacaccagctattcaggaggccgagacaggagaattgcctgaggtctggagtttccagctgcaatgacctatgatcatgcctgtgaatagccattgcactccggcctgagcaacatagtgagacccccatctccagaagtaaaataaaagtctccatgctgtctgcatgaaaaaaaaaaaaaacacataccatcagctggttccaacctggcaggtcaccagaatcacctggtaaaaatacagataaatcttagtccttggatttgttgaaaaagaatatccagagacagggcttagaaatctatatttttacagaaattcctcaaaggatcaccatctttaggagccactggtttcactggtttgggtgacatcttccatagaatgagcgctggaggccaggcatagtggctcacacctgtaatcccagcacttagggaggctgaggtgggaggattgtttgagcccaagaggttgagaccagcacaggcaacacagcgcaaccctgtctctacttaaaaaaaaaaaaattagtccgggtgcagtggctcatgcctgtaatcctagcacattgggaggctgagacgggcagatcatttgaggccaagagtttgagaccaccctggccaacatagtgaaaccccgtctctactaaaaatacaaaaattagctgggcttgatggcacgtgcctgtagtcccagctactagggaggctgagacaaaataatcgtttgaacccaggaggcagaggttgcagtgagctcagatcgtgccactgcactccagcctgggtgacagagtgagactctgtctcaaaaaaaaaattatatctattatatatatatatatattttttttaagattttatatatatatatatatattttttttttttttttttgagacggagttttgctctgtcgcccaggctggagtgcagtggcgcgatctcgactcactgcaagctccgcctcccgggttcacgccattctcctgcctcagcctcccgtgtagctgggactacaggcgcccgccaccatgcctggctaatttttgtatttttagtagagacggggtttcaccgtgttagccaggatggtctcgatctcctgacctcgtgatccgcccgtctcggcctcccaaagtgctgggattacaggcgtgagccaccgtgcccggccatatatatatatattttaagattatatattttatatatatatatatataatttttttttaaaaaaaagaatgagctctggaaataaatgcagcaacttcaaaccaaggagtcacctcttgcctcccctacatggacgcagaactcccacccatggggctgggcccacgtcttgcccccatttctagcactgcccccaccaagggctgtgccttcacacccccgacaccaggatagtcctcacagacagggtgggtttctgggcctcgggctgataagaagacccatcctgatcctctgctgtctgctcctatcccacagcggacaagtactgccctctgctgatcaaagaaggggggatgccccttctgagggacataattaagatggcgaccgcacggcaggagaccaaggaaatggcccggtaagagaccagcagtgtgtttctgcctggaaccttggtttaggggagtaagggcatagcgggcgccctctggaggttaggaatggctgaaattcccagggacagcttagagttgagtatggaggttgacagtgtattgatgtccacctggggcctctccaaatgtcatctcgaccacattgtggctggaaattagatgaccaagctcggaacggagcatcagggccctcgtttgtaagcttagttttcttttattcccaacaaattccatccttttatcactgggtattagcaagtcaggtcagaactattcattatttttggccaaagacattcccactaaagaagggacacagtgtggtaaaatacattctagagataagatgaggcagagtgcgagtgagtttgctgaatgtgaagatcacaaacatggtggagtctcggccttccgtggctctgtggctttcactgcagcatctaaaatgtcaccgcctccagttctcgagttgatcaggacacgagagactctcagggatgcgacgtgtcgaaatcgtcgaacgaccttgttttctccaggattcattctagaagggagaacagtcaagctgacccgagcacactttttcatggctctgtatagagcaaaagttcacatggaggaggggcctgaaactcagaggctcctcagccagccacttcctgggccaggggagggaagtgtcagctggttctgctattatatctggccaaaggcgctactggccaggcgaagtggctcacacctgtaatcctagcactttgggaggctgaggtgggtgcatcacttgaggtcaggagttcgagacctggctaacatggtaaaaccccgtctctactaaaaatacaaaaattagctcggcgtggtggtacgtgcctgtaatcccagccacttgggaggctgaggcaggagaatcacttgaatccaggaggcagaggttgcagtgagccgagatggtgccactgcactccagcctggtcaacagagcgagactctgtctcaaaaaaataaaatttaaaaataaatggacggggcccacccctaggttttcttttccagtacatccgggaggtgggaggtggccctggaattttcatggttaacaaggattcccgggaaatttgagaagcactgggtaagactgaccagttacctaccacagtcactttgaacatttctccaaggcctgtgatgggaatctgaggcactggcctgtctgacagcaaggagtaaatgaccctggacaatgcttaggagaaggccctcggcctgtccactgacctctctcccactctgggtatttgtttcctaaaaggtattggggcatccctttaacacacagaggctgcagtgaagcccccaaaccacaggcttggtgttgaatgggcaagctgtccggggtccaaggtgacaaccaacagtgatgggtggcaggggtcaggctggggcgggcgagactcgaaatctgagctggagtgctgagccctggctgccacagggtagtgggggcccttgtgcgagcacagctgcccctgcccgaccctggacctgccactggatccgggcctctaggggaatctgatgtgcagtcagtttggggaccactggtggacttctggaaagagaagggtctagtgtgcagggaaaatgaagaagaggtcgctaaagaaacttccaaagggttttggaggtcgggcctgagctgatttggggaccccctatccacagatgccctgggactgggggtgggagaagaggggcatggaaaggaaggaagcggaggatggctggtgatggcattcacggccacaggtgccattccctgagtcccctgcacatgccagccactctgccagcccctctgtccacatcattcggtcagcatcaccatcactatgaacacgtgtttacccagctgcctaatgatctcggaggggctgggctcacccccacccaagcccaccctccaatcctgtctcccccattgtctccagcaaggtgattgagcactgcagtaactttaaagaggagaacatggacacgtctagatagaggcctccgtccccatggccgccaccgctctggaccacaggcggggaggaagcatgctcaagcagcccagcgggcgggccccttccgagggagcctcccacggagtgaagagacatgggggacttttgcacaaccgacgcttttccttaatgttagtgagatatatatatattatatatatatattttttttttggttaggaagtgtgaagttttgtgtgtatgatttctgtgcaaaaacaaaagcaacactcctgagtccttgcagcttccttggccattctcaaacccactcagccttcatcgctgacacacacactcctaccccaaccagactaaatgcctataacgctgtgagtgtccagtccttgtccaggaaactcagatcccggcctggcttcctttcatgagaggagcaggccttggacagcgtatcgagcatcctgacccactgcccctgcctgagaacgccatctcggctcccgggcacagctgatggggtttggggattagaacttaccccactgggtctcccaaaagccttggtgctcccggctgtgggccatctggggcaggaaagtgagccattcctaggctgaggtccaggcagccctgcccctgaagaccctctaggagcagggcacccagtggccctgctgctgtccagccaggcctgcctgaggccacgctgctatggaggctgcctcctagtctcccaccaggtcccaggctgtggaaagccccagcccagggatggtcagaactcaggggcagattccactgccccttctgccaaacacatccagaacctgccctcagccctggaagctagcatcttctggggccaggggcttgcttcctcgctccatagccctcaactgcccaggcgctcccaccagcagaactgagcctgcctcctcctcccagcctgccccgctgcccagaggaccccacgcctctcagaggcagaggtcccatgacagcctttgacccacaacggccacacagccgcctccagaccagcactcggactgccctgcagtggccgcttgggcctccctggcggtcccgccctgccctaggctttaccttggaagcctgagaggcgccggctctcttgctcctccatcgatggacactgcattgcttctcatcggacacttgtggagcgcaggggcctggggagcagcgctaaccctggaggcagcctttgggtgatggctttttcttcccttttcctcccgcgggcctgttttcaggtgttcctagcatttctgcctccaggcaggacggcaggggtgagcagctttgggagagacacctggcctttttctcctggagcctctccctcccggccctgggaagtgggcgcagccctgtgttcccccagcttggcagatgggctgcatgcggcgctcccttccttcccacgctcagcggccccggccagaccctggcagacttcacacctcattgctttaccccctggggcctggggaaatgtctgtactttgggaagtcacagaaatacatttttgtgcaaaatggaaa

SEQ ID NO: 36170 - DNA, 323767 bp, Homo sapiens; identical to SEQ ID NO: 36162

SEQ ID NO: 36171 - DNA, 10709 bp, Homo sapiens
gcgctgctcgccagcttgctcgcactcggctgtgcggcggggcaggcatgggagccgcgcgctctctcccggcgcccacacctgtctgagcggcgcagcgagccgcggcccgggcgggctgctcggcgcgggtgagtgcgggcaccgactggggcatccgcccgggcgcgggagaggcgaggcgccgggaggagcgggacaaagggccgggtatgcgcggggtagggtaactgcgggctgccggaggcaccgcaggacttcgccagggcagtcctcggggttccaggacacgggctgggggcctgaaggagctctggggagacggcgggggctgcaggtcatttggattcatgcagtgtcacccatgaaacggatggggaaagaagatcctgctgtcttgggtgcaggatgttggttgggaagcagagagagccggctctcggcaagctgtccttcggcgggggcgatggctacacccccatgcacccccccaacacaccaccaccactacttcttttccttgagttttgcatataccggattccatcaagttctgaatattaagttttaaccctgggcatgtgattgtgaacacacctaagcaagcaagagaagtgcaaaagtgcagcaaatacaggctgggaaatagaatcttttctccggagtggttgtccgtgtgcgttccgggggtgctaaccctagacactacagtctgaactaacaacagttgttgtaagcaaatagttcttctgcctgtaggcattcatcacgagttaacttttaaataaaagttttaaagttttaaaaggagcgggagaagacttgttcagatgaaggaacaccaccactcctctccagaatacaaattaggtttgctttccagcacctcaggagaaagcagctgataaaaatcctgtttgttttactgcccactgggtgacaccagtaagaattaagcagctcagtgtaggtattggaatagggcttgcttctctcagctcctgaaactaaatttgagggctccctgtgcactccttaggaacaggtaggccagtgccagaatcctcatcacatggtcatgtgagaaagaattgaatttatagatgaggtcagctgtggtcaaaagccctatgtcaaagtagtatcaggatatttattgcatgttgtttcaagatcctacttgtgcatgcgagtatttgtgacaggtttataaccgtgcctaccatgaagtctgtcaggagtggattggaggtgaagtggggagaaggaacttagaaaatgcccccagaagccactatgtttatttgtgaaagtgtttgcaccccatctgcgtacgaaaaggttgtttcacttgcagttttcctagttaaataaagtcaagcggtaacttgtcctttcctgtgcctgaactgggaaggaagcctttttccaaggtgcctaatatggatctcatttttgtaacactgacgacttattcagctggatggttaacatggatgcattttctggttgtagcataagtgtccattaatgcatctgagaacatttttgtccccagtctgcaatggttaatagtctcaggttctcccagtaactcttctcatagatcccttaggatttcatccaccaggcattattcatgcctaactcccacagactccagggaatttgtttctcatgttctcaatattagcaggtttttttgcactctgttcttgttctgccaggtttgtcccaggctcaatttagtttacctgaaatccgatagagaagaggctaaacttcatttgaccacaagattgtgtttagggttgcttggacttgtaagtgccttgtagtttcctgtacaagactgtaattcttaaacgattatgtgattaggtctgttttgccttaatagggtctgtgattcaggaaaacgagaacaagcccgactgcagagtattcacagagcttggttcattcttaagcatttgctttaggatttagcatgatttcaccgttccatatcactgaccactgattccatggaagaccctttgtcatctctccaaatggtgtccaaaacctgtatctttgcaaactttcctgccgtttctttctgtcattactgtttatagcggctgcaggaattcacaatttgtacaatagagaatacatgacctaaggattaggttttccctcccagcacttgtttgctataggagttaaatcattctctcaaacagtggccctcttgaggagacctgtgttgttgcagttttcaagactaaggtgccgtgcaggagacagtagtcactgcatccagtctccaaagagattgttgtttgcatatctgttaattatgcaaagtcccaccaccaagggcctatgaagtggcagcatcctcaaaaagtataaatattttcagacagtggctcatattgagtgatggagggtggactgtgtaacctatttatgaatcagatacccaaagctggaaaaggaatagtttctgtattactaagcatggtgaaaaaatattttcttaccttcattttccattcttccctgccagttaggtgaaatgatgcacggaaacacttggttggaaaccttaaaagataatttatgtataccaggaatctttattcagcaaaagtttattcctagaaatgaaacgttatagacctaaattttcttcatccagacttaggtaaaagggtgagatttgaaaatcttcattccatttttaaggtgtgagtcttccaggcagctctgcaaggataaggtgattcatttataagggtgagagagaatttaaaatcatgtaactcattagttacctttccaggtgtgggattatgaatgttttcattacatctgtttataccttagatgagtgtttatgtttaagtaaacttaaacaggtatagcacaggcttacccagggtttatacagatggtaacaataattatttgtcttctaaggaattactccattatcatgtgagttgagaaatgaatgtaaatccaccaacctaattttaaagcatcacagttttgcatcatttgttgttttattaatgcggatgagtcagggcaggctgcgaatgcctcaggaaagacccttaatggacaggagggttgtttccccctcaggcttttctttggggcctgtcttaagagcatacacacacagccatccctccactcagttcttgaaagctgccttctgctggagtcacaatttgtacaatagagaatatatgacctaaggattaggttttccctcccagcacttgtttgctataggagttaaatcattctctcaaacagtggtcctgttgcagactgatcagggaaatcttgtctgccagatagatgagaaattagcatgattcattttccttttccttttcctttccccctcctttgcctccaccctccataattccatgaatcaatggtcctgagaagtaaatgatagtacagacactatagtcagcatcgtccctgacctggacttacgtgattctggaaaattataatattagggaatcctggacctaaagaccagagctaaaaagaccagctaaagcaatcatctggttgaggatgctattcagaagaatttctaaagcaccctaaataaacatttggtaaaggactaagcaacttaagaagcttgtagctttaatacagacatcagtttaaacccatttaagggcttgagaacccacagctgtatcttctaatttctgattagatattttaaaaatatctaagcctaatcagtttgaagtaatttgatgggcattagtttctaaaagtctgcattcatttctaaatctgaattaaacttttttaaatgcaattttataacttttagcgttacatggaagctttaagcaagatatataatgctgtcagaacaaagtcttatcacacaagttagtaaatagggtttagtaatgtggagaacttggaagcagagttgcaaactaatagaaattaggacttattaagtctctgaaaaatttattcttcaaagttaaagcttcacactgtcctgttgggttagcagtttgtttttttcttatagatggctggcttctccttcactcctggctaaatgaacagaattcaagttgtaagaactctgaattagtaatattctatcatgcagtagactctttagcattctctaacaggattctgtgattcataactgatcccaaagtttcttgagacataatcattcatcattttgccaaagaatacatttgatcctctatattgagaggttggagtaaggctgtggctcatgaaagaggatattgtaactgccatgttcttcatgcacattgaaaatattatctgtagctgatgataatacatactataatactacctcatctcctactctttctcccccaagaatcgtattttaaaaacaagaacgcttggcaggttggacctccgcattctgtgttttctttcttaagataagctgaagtaaaacttggcttaccatgtgctcaatgtaagtcacattaacattccccacattactcaaagggaggagagaatggtgcgttgaagcccaagatacagccatgtgggagatatatgactcctcctagtccctgtcacatttggcagggattctggtgtgagtggggcatttagtcacctagacagcaacttatatagagaaaaggctgctcaagtcctcgataagcccaagggatgactccttagccagtaggtgggaataatcagaaccatgccccacagatctcctaaagggttgtcatcaccacacccatttcactgccaagttctccattggagaggaggactcagctagcattggcatccccttcctagtccacttaaaacctttagtcttggcaatattcccaacaagcacatacaaacacgtgtgtgcacatatgcgggcaccccatgttttcaaggatttaaagaaataattaaatgtatttccttcctacaaaagggctcagggacccttcctatttggaaagatggagacaagtagaatttcaaggaattagggagtcccaaggaactggcttttccaggaccttatttctttcttttcctatccctattctccctgactgaagtggaagccaagagaaaaagtcaagcaaaaaggtcccagaggtgggtggggcacacacatatgttagaaacacagtgtggatattgggaatgagaatgggcatgctcagctatactacatcagatcattgggattttctacttttatataaaagggagcaaaaggcacccaaagttgccagtagatctgtactttcaaacaggaagagaatgagaataacaaaacagtttcttcctaacttctgctgtgttcccagagcctcttgagacccaccccttccgggtccttgtttttggatgcttggttgtgaatgagttaccctacctgctgagtcagcttctattgaaccagaagagtcagagccactgagagccaactgatgcttaaacatttatgaaagcactttcagtattcctcgttgttgtttttcttgtgggatgattgatctgggcatttaaacataccttgcagtataaaatccaaacttctttgtttagtacacatagcacttcacaatctagctcttgcctgctgcctccaccacttcctctactccacccttgctgagctaagtgtgattccccaaattactcacatggttgcatgttgctgtgcccttgcacagactcttgtttcccttccctaagtatccccttctctctgtcttatgttatcagacttcttttctacttcagcacccatctgaaacatcaggtgatgcctggaaaatttctaggcaatttgttcatttagagggtaaatttaaattacatagcttactgaatgaccgaagcatcaaggagggacagctccacggtgtcacctttactaggactcctattgcttctaaatggtgggtacatttgaaaagaacgggtgcatttgccaaataatacatttggtcctctatattgagaggttggagcgaggctgtggcatactatttctcaagcatcacttctcctagaaggcctctcttgttcttactcccacaattggcctcaagctgtttctctgagctaccgcatcatccatgtacatcattgtcattagcgtcagcatgcaacattcattcacttttccattaatacaagcatccatttaacaaatctttgtcgagtgctagcacaggcccaaatttaagagatttagttggtaatacagatataaacaactgaaaaagtaaccaatggtaacagttcatagtgttatagctgatgcaatattagagctttagatattgacaaagatcctggtagtgtacaacataatccaaaggaagaaggaatattttattagaagcctagccactctggaactcaatatatataatagtaaaggttgttgtaaattcaaagcaaaaaacaaaacaaaacaaaaaatctcataccctttctcgagtgcaccatcatttaaaaaccacaggagtggtggtaattgtgacactgtggagctgtccttctttgatgtctcagtcactcagtaagccatgtaatttaaattgaccctctgagtgaccaagttgctctgaaaattttccaagtacatgttacaatgagaatgagagaaggaggagggaaaggcggggacatcatgaaggtagaagaggaggaggtttagaatcaagcacaaagagggctcaaaattacgtggaaattggggctggtcagtcagttagccaggggactaatgactttatgcctgctactctgcagtctaccatcattagggacatcttaaacatagaaaggaaggaacacccaatttcacttcaggcacccagccacaggaactttcctaaggttgagcctttgcgttgaaagtgagaccgttatctaaggattcctctccacaccctgattcctgaggagtgttcaaagactcagaaacaatgacaggcctgctgctgagctttgctgtctgcagtaaatgaacgttcagcccttgccctcctgacctgcttgtctttgtttctacagaacagtgctcggcatggcagggattccagggctcctcttccttctcttctttctgctctgtgctgttgggcaagtgagcccttacagtgccccctggaaacccacttggcctgcataccgcctccctgtcgtcttgccccagtctaccctcaatttagccaagccagactttggagccgaagccaaattagaagtatcttcttcatgtggaccccagtgtcataagggaactccactgcccacttacgaagaggccaagcaatatctgtcttatgaaacgctctatgccaatggcagccgcacagagacgcaggtgggcatctacatcctcagcagtagtggagatggggcccaacaccgagactcagggtcttcaggaaagtctcgaaggaagcggcagatttatggctatgacagcaggttcagcatttttgggaaggacttcctgctcaactaccctttctcaacatcagtgaagttatccacgggctgcaccggcaccctggtggcagagaagcatgtcctcacagctgcccactgcatacacgatggaaaaacctatgtgaaaggaacccagaagcttcgagtgggcttcctaaagcccaagtttaaagatggtggtcgaggggccaacgactccacttcagccatgcccgagcagatgaaatttcagtggatccgggtgaaacgcacccatgtgcccaagggttggatcaagggcaatgccaatgacatcggcatggattatgattatgccctcctggaactcaaaaagccccacaagagaaaatttatgaagattggggtgagccctcctgctaagcagctgccagggggcagaattcacttctctggttatgacaatgaccgaccaggcaatttggtgtatcgcttctgtgacgtcaaagacgagacctatgacttgctctaccagcaatgcgatgcccagccaggggccagcgggtctggggtctatgtgaggatgtggaagagacagcagcagaagtgggagcgaaaaattattggcattttttcagggcaccagtgggtggacatgaatggttccccacaggatttcaacgtggctgtcagaatcactcctctcaaatatgcccagatttgctattggattaaaggaaactacctggattgtagggaggggtgacacagtgttccctcctggcagcaattaagggtcttcatgttcttattttaggagaggccaaattgttttttgtcattggcgtgcacacgtgtgtgtgtgtgtgtgtgtgtgtgtaaggtgtcttataatcttttacctatttcttacaattgcaagatgactggctttactatttgaaaactggtttgtgtatcatatcatatatcatttaagcagtttgaaggcatacttttgcatagaaataaaaaaaatactgatttggggcaatgaggaatatttgacaattaagttaatcttcacgtttttgcaaactttgatttttatttcatctgaacttgtttcaaagatttatattaaatatttggcatacaagagatatgaattcttatatgtgtgcatgtgtgttttcttctgagattcatcttggtggtgggtttttttgtttttttaattcagtgcctgatctttaatgcttccataaggcagtgttcccatttaggaactttgacagcatttgttaggcagaatattttggatttggaggcatttgcatggtagtctttgaacagtaaaatgatgtgttgactatactgatacacatattaaactataccttatagtaaaccagtatcccaagctgcttttagttccaaaaatagtttcttttccaaaggttgttgctctactttgtaggaagtctttgcatatggccctcccaactttaaagtcataccagagtggccaagagtgtttatcccaacccttccatttaacaggatttcactcacatttctggaactagctatttttcagaagacaataatcagggcttaattagaacaggctgtatttcctcccagcaaacagttgtggccacactaaaaacaatcatagcattttacccctggattatagcacatctcatgttttatcatttggatggagtaatttaaaatgaattaaattccagagaacaatggaagcattgcctggcagatgtcacaacagaataaccacttgtttggagcctggcacagtcctccagcctgatcaaaaattattctgcatagttttcagtgtgctttctgggagctatgtacttcttcaatttggaaacttttctctctcatttatagtgaaaatacttggaagttactttaagaaaaccagtgtggcctttttccctctagctttaaaagggccgcttttgctggaatgctctaggttatagataaacaattaggtataatagcaaaaatgaaaattggaagaatgcaaaatggatcagaatcatgccttccaataaaggcctttacacatgttttatcaatatgattatcaaatcacagcatatacagaaaagacttggacttattgtatgtttttattttatggctctcggcctaagcacttctttctaaatgtatcggagaaaaaatcaaatggactacaagcacgtgtttgctgtgcttgcaccccaggtaaacctgcattgtagcaatttgtaaggatattcagatggagcactgtcacttagacattctctgggggattttctgcttgtctttcttgagctttttggaaggataattctgataaggcactcaagaaacgtacaaccacagtgctttcttcaaatcatatgagaaatactatgcatagcaaggagatgcagagccgccaggaaaattctgagttccagcacaattttctttggaatctaacaggaatctagcctgaggaagaagggaggtctccatttctatgtctggtatttgggggttttgtttgtttttgctttagcttggtgaaaaaaagttcactgaacaccaagaccagaatggatttttttaaaaaaatagatgttccttttgtgaagcaccttgattccttgattttgattttttgcaaagttagacaatggcacaaagtcaaaatgaaatcaatgtttagttcacaagtagatgtaatttactaaagaatgatacacccatatgctatatacagcttaactcacagaactgtaaaagaaaattataaaataattcaacatgtccatctttttagtgataataaaagaaagcatggtattaaactatcatagaagtagacagaaaaagaaaaaaggactcatggcattattaatataattagtgctttacatgtgttagttatacatattagaagcatatttgcctagtaaggctagtagaaccacatttcccaaagtgtgctccttaaacactcatgccttatgattttctaccaaaagtaaaaagggttgtattaagtcagaggaagatgcctctccattttccctctctttatcagaggttcacatgcctgtctgcacattaaaagctctgggaagacctgttgtaaagggacaagttgaggttgtaaaatctgcatttaaataaacatctttgatcac

SEQ ID NO: 36172 - DNA, 5807 bp, Homo sapiens
tatcctgctgctgccgccaccgctgctgctgctctgcaaaattcagctgctgcctctgtcttgaggaccccagcgcctttcccccggggccatgctgcctgcagccacagcctccctcctggggcccctcctcactgcctgcgccctgctgccttttgcccagggccagacccccaactacaccaggtaggtctcttggcatcttccagacagctccagtgaacttcagacccccgattcctttggggttatgcctggagatattttgggttcccttgctgacacaccactccccagattccccaccgcctcacccttctctggcccccaaatcctccccatctgctgcaagaccttggtctcctgcaggccaccactgctcccattcccccaccttcgtcctctggtctcttaagtctccccacccacccagatccttgaccccccatagaacccaagagagagccaagctcctgaacttgcctggtagctggattccaggaaggaattcgagagggattgtagggggaggagggggcagtgagtggagacttgggagtcagaatctgaagtagtttggaacaggggcagggctaaggtgtggagctcgcggagcctggcctccaggttcaatcagagggccatcgccactgcagctccctccatctctccaccccctcccccccaccgcctcgtggctgtgtccacatctggaagtagttaggcggctcctgtccctggactgccaggcagagtgaggcgggagtctggaaggggggccgaggaggattccgggaattcctgttggggtgggggtggggactcttggggttggagggatggtcgagttgccaggcccacttttcccttatctttgtgggagtctgggacaccccagccctgtcctggctggtggaagctgccccaggtctctcaaggcctttccatttcatcccccagcttccctccttggagtttcatcctcatcacctcatccccatcttgccagtgctcccccgtcccacccgtccctgctctttcctgaccccttttctgttctccagacccgtgttcctgtgcggaggggatgtgaagggggaatcaggttacgtggcaagtgaggggttccccaacctctacccccctaataaggagtgcatctggaccataacggtgagaaacccctctgggcactaccccttgttaaagtctcagaggcaaaaaggcctgactgcgaagggaccccccccccgtcccccccgcaccaccttctcaacctggggcagctccaagtgtcttccctctgtcactgaaggcatcattcccaccgtaacacgcatcatcttaacccttccctcaaatcttcattctccagtccccggccctccctcctcttccaaagcctcagctcttgtcccctgcacaggctaccagcagagctgcagagaccaggccctctgctctgcactcacatggaggccccttcccattcagtccgtttctgcaagaaacgcttggggcaggggagctgccctctggctgggttgtgtggggcctgactctgtgggtccccgcctctgtccccgctatcaggtccccgagggccagactgtgtccctctcattccgagtcttcgacctggagctgcaccccgcctgccgctacgatgctctggaggtcttcgctgggtctgggacttccggccagcggctcggacgcttttgtgggaccttccggcctgcgcccctagtcgcccccggcaaccaggtgaccctgaggatgacgacggatgagggcacaggaggacgaggcttcctgctctggtacagcgggcgggccacctcgggcactggtgagaactccctcacctccgccttccccccctccaggccccgccccggccgcagccccgcccccagccctaacctccgccccgcccaccccgcgccccagtgcctagggccccctacctccctgacccattttcctcactaaccgccccttcagtccctcctccccgtcttctctcccctcctcccgcacccacccatccctcttccagggccccccccaggcgcgaggcggaaatgggtcaccgacccgcgggtggaatgggcggcctggggttactgggacggtgagtaactgccggcccccgtccgcaatcgggctccctccgtcgggcgcgagggggcaccccagggctggggggactaggttcctccaaccccggggggcccctacacccagccctgggctcccgattgcggtcccatcaccccctcctggcggcagaagtctcccttgcaatgtttcaggcggggacctccctaaaggggtcctcgggggctgtgccccaagtcgaggacaccctctccagcctgaaaggggactctgctgcagggccggggagatgggatctcctaggggaagaggcgcggtgcggccgcgggtcggggaggggccagaagggggcgtccagccagttcctcctcccgcttccaccgcccgccagtgcgccctgcggccccagacttccccgagccgcgctcctcccggccgctctctgttaacctgcccccatcttacctccccttcttctcgtcccctcatcctgagccccagacatccgagctgcctgccggggctcccagcctagagttctcctgaagctgaccgagggtctccaccgccccccacccccgctcctctctcccctccccagagcaccaattttgcggggggcggctggagaaggcccagggaaccctgaccacgcccaactggcccgagtccgattaccccccgggcatcagctgttcctggcacatcatcgcgcccccggaccaggtaccgaccctcctccccgggctgccctaggggacccaggcggcgccctccagcttgcagccagcagagatttattgaagatctgctgtgtcccgagcactgcgcttgcgctggtgggcacccaaaacagccccaacccctgcatgcacgcaaacaaaaatgtaaaaattacaactgagacaagtctcaggagagcgaggtacagggtcctggtataacacgcgggcctgtcacttgtgagtgcgccaggacttgaccttgccaaccacgacgaccgacacccctgcagggtcccatgggtgtgtgtggtcctccgtgctgtggtgtgaacgccttcaggaggggggcccagaggacgcgggaggtgggagtgggagctgctgcaggcacccagtaggagatgaggtgcaggcgcccaggggtgtcccgccgcgcagtccccgcctccgcccgccgccaggtcatcgcgctgaccttcgagaagtttgacctggagccggacacctactgccgctatgactcggtcagcgtgttcaacggagccgtgagcgacgactcccggaggctggggaagttctgcggcgacgcagtcccggggtgaggggcgggacctgggcgagtccgggagagagtcggcggaccgcacgcacgcggctgtttggaggggcggggttcagctaaagggacgggatctgaaccccagggctccaaaccggcgaggggagcaggttggaggccaggcaaagaggagatttggccccgggtctggggtccgcggatagagaggcgactggggctctgcgaagttgggacgaagttaaaaggccacctggccaggggtagtggctcatgcctgtaatcatagcactttgggaggctgaagcgggaggatcacctgagcttaggaattcgagaccagcctgggcaacatggcgcaaccttgtctgtaccaaaaatacaaaataattagctgggcatggtggcgtgcctgtagtcccagcaacttgcggggctgaggcaggaggattacttgaacccagaaggtcaaggctgcagtaagcctagatggagccactgcactcaagcctgggagacaaagtgagaccctgtctcaaacaaacaaaaaaggtcatggggctgagaagagtgtggtgcacgcccgccctgacacttcccccaatgctcggtggccacctgcagctccatctcctccgaagggaatgaactcctcgtccagttcgtctcagatctcagtgtcaccgctgatggcttctcagcctcctacaagaccctgccgcggggcactgccaaagaagggcaagggcccggccccaaacggggaactgagcctaaagtcaagctgccccccaagtcccaacctccggagaaaacagaggaatctccttcagcccctggtgagtctgggataggggaggaaggggaaacagactgaagggggccatttcaaaaagttctgacctgggctgtggctcacacctgtaatcccagcattttgggaggtccagacagcaggatcgcttaagcctaggagtttaccatagcaagaccctgtcttttcaaaaataaaaaattaggctgggctggtggctcacgcctgtaatcccagcactttgggaggccaaggcaggcagatcacctgaggtcaggagttcaagaccaccccggctaacatggcaacaccacatctctactaaaaatacaaaaattagccaggtgtggtggtacacacctgtaatcccagctactcgggaggctgaggcaggagagtcgcttgaacctgggaggtggagattgtagtgagccgagattgtgccactgcactccaacttgggttacagagtgagattctgtctcaaaaaaaaaaaaaaaacttagccaggcgtgtggtcatagctactccggaggctgaggtgggaggattgcttgagctgggaaggtcgaggcttcagtgagccatgactgtgccgctacactccagcctgggcaacagagcaaaactccatcttaaacaaacaaaaaagttcttccttggctacattcactcattgattcatctggtactcactggtgcctccttcctgccgatgacccctactgggtgctaggaccggaagcctgacagagctctgaacagttcaagtcaatgaggctgttatggggacagtgctccctcctacctgctgagcaggtcaccctccaccctcctccctcctagatgcacccacctgcccaaagcagtgccgccggacaggcaccttgcagagcaacttctgtgccagcagccttggtaagaatacccccaaccccattccagctcctcgaaccacctcctgcttctgtttccagtcctgccatctggaacctcccatctcctcatctctcactcccattctcccacagtggtgactgcgacagtgaagtccatggttcgggagccaggggagggccttgccgtgactgtcagtcttattggtgcttataaaactggaggactggacctgccttctccacccactggtgcctccctgaagttttacgtgccttgcaagcagtgcccccccatgaagaaaggtaacagagatgtggggaaatggggatgggtcaagctaagccacacagaaatgatcaaggtgtggaatcttgagacctgctgacaggtctcaagaataagagatctcaacccctccctccttcttccaggagtcagttatctgctgatgggccaggtagaagagaacagaggccccgtccttcctccagagagctttgtggttctccaccggcccaaccaggaccagatcctcaccaacctaagcaagaggaagtgcccctctcaacctgtgcgggctgctgcgtcccaggactgagacgcaggccagccccggcccctagccctcaggccttctttcttatccaaataaatgtttcttaatgag

SEQ ID NO: 36173 - DNA, 1887 bp, Homo sapiens
caggccctggccgtggcgaaagagccggcggagccggagacccgctcccggagacgccgcctcgcgatccccgcgcgggcgggaccgggcggccggcatcatgaccctgtttcacttcgggaactgcttcgctcttgcctacttcccctacttcatcacctacaagtgcagcggcctgtgagtgcgggaagggcgcggggcggagagggcgcggggcccgggccgaccctcacctcccgcttctccaggtccgagtacaacgccttctggaaatgcgtccaggctggagtcacctacctctttgtccaactctgcaaggtgagggccaccgggaagccacgtgttctggcccccaggctctgcagacccagggacccgcccccgttgcctatccgcgcccccgccgccccacggtgggaccgccctcgggactccgcactgggaggcgtcaggatacctagagaggatggactttaaagagggcacgacctgagaagagacctagaagcaacttttgcgtagcacttagtaaaactgagaaaacctcagtagtgtggttggctaacaggttttttttggtgcggttaagagtgatcactgattccgtacgtgctgctaacactgcccaaggagcagcaccttcagacctgactcagatgccctgtgatcacccagaactcaaacttccagccccctcggggacccggggacctatcctctatctccccgattcctgtaattttgccaccatctggtggttcctcttccagatgggcccccagaacctgtcctgccctcttcctacccacgaacttcccacaaatcccacgtggtttatcttgatcccctcaccttgaagtgacctctttctgctttctgttctcagatgctgttcttggccactttctttcccacctgggaaggcggcatctatgacttcattggggtgagaggggccagggaagggaagggagttcaggaatggggctccctgtccccctgtgcttacttaagcctcaacctgacccgcaggagttcatgaaggccagcgtggatgtggcagacctgataggtctaaaccttgtcatgtcccggaatgccggcaagggagagtacaagatcatggttgctgccctgggctgggccactgctgagcttattatgtcccggtgcgtacagcagcctggagcccagacccctgagaagggacacctgggttccacgggggtgctggagggcaggggctcaaagcctggtgctgaaggtgtctgagtactggagaatcccatcctttgccttcctcagctgcattcccctatgggtcggagcccggggcattgagtttgactggaagtacatccagatgagcatagactccaacatcagtctggtaggcagtcgtgctctcccacatacacatttctgctggcggccatactcctccccaaggcctggccccgactttctgcctccctctaggtccattacatcgtcgcgtctgctcaggtctggatgataacacgctatgatctgtaccacaccttccggccagctgtcctcctgctgatgttcctcagtgtctacaaggcctttgttatggagtgagttgggtggggtttagggctgggtccaaagtggggtgggttatctagtctcccttccttattgtgacattttcctgcaggaccttcgtccacctctgctcgctgggcagttgggcagctctactggcccgagcagtggtaacggggctgctggccctcagcactttggccctgtatgtcgccgttgtcaatgtgcactcctaggcttggtgtctcagacattgatgtaccttttccctgcctcactccaggttttagtgaagtaaacagtatttggaaagtt

SEQ ID NO: 36174 - DNA, 32704 bp, Homo sapiens
taaaatcaactttaactagaaaggcagacggcacaggtgacgctagaaaggcagacagtacaggtcatgctagaaaggcagacggcacaggtcatgctaggaaggcagacggcacaggtgacgctagaaacgcagacggcacaggtgacgctagaaacgcagacggcacaggtgatgctattaaggcagacgcctgggttgtgactgaagcaactgcaagtgagactctttccatcccactcagacaatgaggaaaagtgagtggtgcttggcattcctgcgcttcaatggctcaaaaacagagtatgcgagagaaactaagttattcacaggacctgagatatctggactttcttctctggcggaagccgattttcttacccagcgttacctttctgaattcagtatgagaagagctgcggcccaggtgcagcccagaatcctcagcaccgaacacatgttgagaacgggtttcagaaagagctcagacactgacctatgtctgtagatccgcctctcacctgccggtgcaggggaggctgccacaggctcagagcagatttccatggcctccccttctgaccgctctccactgtcccctggggcttctgctgaggctgggctgcggggagagagcagtgagtaactgccctgcacggctcccacagcccctgtgttccccagaaatgaacatgcaagaaagaaactggatttccctgtaagtagcatattttcttactattttggcatagtctgattttatagtgtggtttaagatactgggaaaaggagaatgattacagcaaggccattgtttatataatagagtctgcatcttataaacttaactgtaacaatcatacttttttttgaaaatagtatttttatggtgccaacggtgccacgggtctttttatgagtgtgagaaatttgctaaagttaaccagagactataaactagtctcttccataatacgaatgtcttaatccagcattgcacggtttttctccttaaaatgatccctcggaaaggagacaattactttacacgtaagtctttgtaaagcctcccacattgcagtgggttctcccagttcttttattttaaagagcaaattactacttgagaaaatgtagagtctgaaaaactctgatcaataaaattgtagatgattatgaaagttcacctcatcagttaaaaaaagaagaaatataacacaatttaaaaattgttccggctggacatggtagctcatacctacaatctcagcactttgggaggctgaggcagatggacggcttgagcccaggagttcacgaccagactgggcaacatagcaagaccctgtctctacaaaaaatagaaaattttgccgagtgcggcgatgcgtgttggtagtcctagcactttaggaggctgaagtgggagaatcgcttgagcctgagaagtggaggttgcagtgaacctacatcacaccactacactccagcctgggtgtcagagcaagaccctgtctcaaaaaaaaaaaaagattgttcctggaagtatttcccagagtgcactctaggcaggaacatgttaatcaacagctttgtcatcaagttcatatgcgcacaaccaaccaggacaaaaggaaagccagggctgcatgatgtgtgagcacggccgacggctgcaggaggtacagacacggccccgaggggtgtgagtgcggatgaccacggccgactgctgcaggaggtacaggcatggcccagaggggtgtgagtgcggaggcgctgcgcccgctcattcccacaccccctctgctgcctccaccggcacagagctgggcagccaggggctcccctccagcctcccttcggcagggtggccgctggcacaaccacctgtagctgtgttgccagggcttcaggtacctgcaggtgaacaccccattaggtgacacacaagtgcttaataagtctgaccgtctatgcattccggctagttggaaaccttttcctaaaatcaaaagcagacacgtgctgagcctggcggctccctaccttctgcttttctttggcttatcaaaccggaagtccgcggggtacaggtgcatcctcaccatgtgatccttccggtctctgctggtcttgaacttctctgtgcagccttctaccaagcactgatactgaaatggagaccgtgtcacctccctctgacccctggccctcccccaccgccatgcccccgtagcagagctgccaagggcggaaaggtgtccccggccttgcccgagcacccgagagctgggggcagcactctgagcccatcaccaatggggggtggcctcggcggctgtgcagttgtcacccaccatgtcctgcctctcagacaggatctggaagagcgaatcgtgccactccaggatgtgggcgtccagcaggtgtccggaagggaaggcccgcttgcaaaaggagcaaacatttccgtgcagcgtgtggtagtggtgctcgtagtcgtccagggcatcgaacacctggcagcagccggccacctggcaggcaaacgcgggcaccctgccaaggagacgtgcttcaggagcccttcctccggtgcgaggaaccaagctggactttctgcacagtttccctttgagacgtccaataaagcccctatgcatcttttgcaatcccaaaccctctttttatgaattaagtttcacaaacaggctaggtggtggaagagtcggccacgccaaagctggacaggcacagcgcctcggtggggcggccgcacatggaagagcggcagcacagccccagggaccaggcaccggtcagggaggcggcgcaggagtagcactggctaggcactgcccattcgcttacctgggcttctcaggcacgtcggccacctgcatgatcacgtcctggaggtagaggtggcgctgcacgtccccatcctgcaggaaaagtgcgccgtgggcggggccaggtgactcgcggcacgcccaccgcgtcaggcctcgcccacacccgtggccccagtcatcccgcgctccggtcccgccccacagcctcaggccccgcccactccacgttccggccccgccccaccacctcaggtcccgcctgtcccaggctccggccccgccccgcagtcgtaggcccctcccactccaggctccggccccgcctcgccgccgtaggccccactggatcctacaactactttttccctcttttgctcacgcacctcgaagaactggtgctcccgcgggaagcgcacggggcgcgcaacgaagcgaaagggcgcggccccagccgcgggatcccgctctacaggcagcggctccgccgccccgggccccgcagcgaggcgggcgcacagcgcggggggcaactgcatcaccccgggcgcgggcgggcgcagcctgtcggccaccgtccgcgagccgagccggacgtgacgtcacgctcacttccgccgccgtcgggggctgcgcgggggctgtggctccgggactgcggtgagtcctggccgaacgcgggcgcgggcgtgatgagggggttgggggactgccaggcccgggggggcccacgaggcgacggggctggcgggacgcggctcttcccgcgcgctccctctggctgtgcagcggtccccgaactctggggccgaagcccttcgggcctgcaccggccaggccagcgtcttgccccgcggcccgacactcagccggggcggggcggagcgggcctccgggtcgtcccgggtgtcccctcccagccctgggaagccgggtcgcaggtccccctctcgcacgccctctcccgtccgccttgccccgcctgtcgtctcccgctgcagtccctggatcttgttccctctaaaccagtcgcgaactggagccaaagtgactccagttttattgtaaccgtttttaatttaaagcccttgggtgacttcccgttactttagttcaaaggccctttcctggtttgtcggggtcctgtcgacctctccagtccccgcagctcccgtgaaacacaggacctgtgctaggtgctcagggcgtgtgggggaaggcatcacaggagggcgcggcagccttgtaggagagacagacgtcagagtaaagagtcacctaattaaaatggtgaatgacaacacacgcgggaagcagtggacgcttcagatctactgcagagaatgggcccagtggcggatagaggctttagctttctcgtctgtcacccaggctggagtgcaatggtgcgatcatagctgatagatcgctgcggcctcaaattcttgggctcaagtggtcctgctgcctcagcgttccaaagagctgtaactgcaggcgtgagccaccatgcctgcccctgtactttttccatgtttagatacacaaatatctctgtgttacagttgtctagtgttcagcaccgccacctgctgggcaggtttgtagcccacgagcaagaggctcctctaggtggtttaggtgcattgtaggccgtacaccatccaggtctgcgagtgactctgatgatcgcacagaaggaaatcatgtaaccatacgtttctctttttttcttttggagatagtgtctctctctgtcgctcaggctggagtgcagtggcgcgatctgggctcactgcaacctctgcctgctgggttcaagcgattctcgtgcctcagcttcccaagtagctgggattacaagtgtgcgccaccaggcttggccaatttttgtatttttggtagagactggttttcaccatgttggccaggcatttctcagaatgttgagtgatgcatgactgtactttctgtctctgtaaaagcctttgggctcttgacattttccacaagttgtaaaataacatttttcaaaccaatttgtacagttagctttgagctctcaacagagactctttttcacgtccctctgtgttttaatcacttggagtgtgtgctcactaggagtgtgtgccccgcttgtccgtggtggagtgtgacatgcgtgcattgcttccctcagcacgcgtccctgcggtagctcacagcctctgtgaggaggacgtcagtccctcccagtcacagttgctgggcctgtcagtttgtgtgattaatagtaagaattcaggagcatcaagaaggccaagtcagcggccatggctagacgttcctccaagaagcagccacggctagatgttcctcagagctgtgttttcagtgggacgctgtgcatttctggcgggacagctctgttgatgattagcatcccccgcccttgccctctaagtagcgagagcacccttccatgaccgtgacaccccagagttgccctaggacttttccaaaggtcttctggggggagggactctgtgcgagtacgggctgccctcttggaggcccggtccccacattcagggagagcagcaggctcctcatgggatgaacactcatgacgtgcgggcatctgtgcttctatttctagaagagatacgaagtttcctgaaggtagtttttattttttttattattattttttgagacagagtctcgctctgttgcccaggctggaatgcagtggtgtgatcttggctcactgcaagctccgcctctcgggttcatgccattctcctgccccagcctctggagtatctgcgactacaagcgcccgccaccacccccggctaatttttttgtatttttagtagagatggggtttcaccatgttagccaggatggtctcgatctcctgacctcatgatccgcccaccttggcttcccaaagtgctgagattacaggcgtgagccaccgtgcccagcatgtagtttttaaataaatactcagatgatttttcttcataggtagctttctctcctgacttgtgtctggtgggggagtgctttgttttggtggcaaatggttttcttgccacctagcatgaccaaagtgtttctcagaccagcagttataggacaacctgcagtcctcggggagccgagtagaatgtgggtgaaacaggccacccttggatttgaaggggccgctggccggaaagtttgggctgtcttttctgcttcacaagtagtttgcagggcctcgtccagggctcccatgactgttaaaaaagcatctggtagtttaagatgttgtcagtgattgggacccaattttccttttgtaaacctaaccatttcccagataacagagttaacacctccagggagcaatggtgccgcatgtttgtttctgctttcctggtaacaacagtgtaagaacttaccacgtatgggcccttctgtgctttctcagggtgatttcacttctctctaccacagctctacgcaggacctagggcttccccttttcagaagaagcttggagaggacgtgtccttgttcagggtcccacagcctagaagtagccacgtcagtgtccagactgcatggggctccatggcgcgtgccctgctggccttgtgcttgaactgtagttaccgtgagcacctcctgggtcaaaagcatgtgtgtgagcaactcagcaccatgccttcttatcgctctccttccattttcggagataccctgcctgtgaccagtatttgatgttcatctacagataaactgtcttccatcacacaggattagaatctcggtgtcgagtcccgtgctaataatcgttagtgaattagcatattgtgggagtatgtgctgagtcttctgtactctattgtagggaccagccccacagggtcggtgggtttttctcctcgtgtgcggagatgagagattgtaaaaataaagacgcaagacaaagagataaaagaaaagacagcgggcccggggaaccactaccaccaagacgcagagaccggtagtggccccgaatgcctggctgcgctgttatttattggatacaaagcaaaaggggcagggtaaagagtgtgagtcatctccaatgattgataaggtcatgtgtgtcatgtgtccaccagacatggggcccttccctgttacgtagccgaggcggagagagagaggacagcttatgtcattatttcttctatgttcttttcagaaagatcaaagactttaatactttcactaattttgctactgctatctagagggcggagccaggtgtacgggatggaacatgagagcagaccaggagtgtgaccgctgaagcacagcatcacagggagacagtcaggcctccggataactgcgggcgggcctgactgatgtcaggccctccacaagagttggaggcgtagagtcttctctaaactctccggggaaagggagactccctttcccggtctgctaagtagcgggtgtttttccttgacactgacactaccgctagaccaaggtccgcttggcaaggggcatcttcccagacgctggcatcaccgctagaccaaggagccctctggtggccctgtccgggcatgacagaaggctcacattcttgtcttctggtcacttctcactatgtcccctcagctcctatctctgtatggcctggtttttcctaggttatgattgtagagcaaggattattataatattggaataaagagtaattgctacaaactgatgattaatgatattcatatataatcatatctatgatctagatctagcataactcttgttgttttatatattttgttacactggaacagctcgtgccctcggtctcttgcctcggcacctgggtggcttgccgcccacactcgatgttttgttgagctcatccttgtctccctgaagctgtcagcagagtggttgtttaccttttttgggtcatagagcctttgagaatttgttgaagggtcatctcctcagaaaataaaaagttattttgcccataactttcaagggctcatctgttactgattactcatggataccggcttaagaacccttgtgtagatgaaatgtttgtgaagcatgtaaagtttgcttatatttgttttgtaatctatagccagttgccttgcctgtgttttttgttttgttttgttttttgttgagacagggtctccctctgtcgcccaggctggagtggctcaagcgatcctcccacctcagcctcccgagtagctaagactacaggcatatgctaccatgcccagttaatttttgtattttttgtagagacagagtctcactgtgttgcccaggctgtcttgactcctggcctcgagtgactcacctgactcagcctcccaaaatgctgggattccaggcgagagccactgcacacagccatgtgtttgtcttaatggccttgtatcggaactcttggtgacagaggctaatgagcagccactggtgggagagtaggggcggcgctcaccctgccccctgacccaggggtgggctcaccctacaccctgaccccacgcagtgttctgctgcccacttgggtgtctgtgacgccttcgatctcatatgtgttatatgtctcctggtgagcccctggggcagctggagctgcagtggaacttcacctagctcaaacgtgtagggaacgtgtagaagtcctaccagaagcgtctctgtcggtagccacgcttgggcaagaaaaggagatgtcacgggtaccagagtgaaaaagtaacgcagagccggccaagtgaatggagctgcggctgagcaccgcgggctctgagaaccagtgtgggcctctccggtagaagctgggatgttactgtgtgtgccggtagctggcacagtgtcaatggcttgggcctgcacagagctccctgtgtagaccccacaggcctcacgtctgggaccagaaagctctgtccccaagccgaggcgagcagcagagcattccctgctggcccagacccatgtgtggagggaggtgcaggggaaagggaacctgggtctcaggccccattcatgctgcccacggggctggctcccggagctgcggaggccgcctggaagctggaggcaggtgaatcccaggcccacccagaggaccctctgagaggctgctggggtgtcggggaggggccctaatcccaggcccatgcagaggaccctctgagaggctgctggagttcagggaggggccctaatcccagtcccgtccagaggaccctctgagaggctgctggggtgttgggcaggggccctaatcccaggcccatgcagaggaccctctgagaggctgctgggctgttgggggaggggccctaggccaggcaggccaggtgataacttggtttgtcaaagcctgacattggccagtcttgagtgtttaaaaaaatgttttttatttctacagtttgaattttatgaatagctgtcttcttacctataggagaacatattgtgatgttcgtgcctcagagctaaaactatgagtgaatttcggattcaccatgacgtcaatgaactgcttagcctgctgcgtgtccacggaggagatggggctgaggtctacattgacctgcttcaaaagaacaggaccccgtacgtcactaccactgtctctgctcacagtgccaaggtgagcactgcccttggtgtagcgctgtgcagggtgagcactgttcctgggtcagggtggtgcagggtgagcccacccctgggtcagggtgcagggtgagcgccgttcctgggtcagggtggtacagggtgagcaccattcctgggtgagggtgcagggtgagcccacccctgggtcagggtgcaggatgaacactgttcctggatcaggatggtgcagggtgaacccacccctcagtccatgtgcaggatgagcgtcgtccctgggtcagggtgcatgatgagcaccgcccctgggtcagggtgcagggtgagcgccacctctggtgcagggggcagggtgagcgccacctctggtgcagggtgcagggtgagcgccacctctggtgcagggtgcagggtgagcgccacctctggtgcagggctgtgcggggtgcagggtgagcgccaccccggggtcaggatggtgcagggtgagcactgcccctggtgcagggctgtgtaccgtgcaagatgcagggtgagtgcccgttcctgggtggcctcaatggtaccggcaacgatggcagacagcacttggtctgtgtgtgtgttcagctctgattctcctgactccccccagcagctcctgtgattcaccccactgtgcagatgagtaaatggaggcctatggagaaagctgggcctagaaccctccctcttccccactctgtcccctgcagccatgaggtgggagagtcctgacatgtgcattcctgtggataaaaagggagggactgggccaggcgcggtggctcacacctgtaatcccagcactttgggaggctgaggcaggtggatcacaaggtcaggagatcaagaccaccctggctaacacggtgaaaccccgtctctactaaaaatacaaaaaattagctgggtgtggtggcgggcacctgtaatcccagctactcggggggctgaggcaggagagtggcgtgaacccgggaggtggagcttgcagtgagccgagatatcgtgccactgcattccagcctgggcgtcagagtgagactctgtctcaaaaaaaaaaaaaaaaaaaaaaaaaaaaaagggagggactggtattaaccatgttgaaatgcctttaaggtattatttctttattcagataatatgtaattcagaagtatagattttcagtaaaaatgattttgaatttgaagtctattttaaaaaatacattatgaagcttcagttatttaaacaggttaacaatggcacaaggataattaggcaaattagccgagtggaatagagacttggggacacccatgtttagttcattctgaaggaagcattgtaaatcactgagtaaaacataacccctgctgggcacggtcgctcacacctgtaatcccagccctttgggaggccgaggcgggtggatcacctaaggttgggagttcgagaccagcctggccaacatggagaaaccccatcgctactaaaaatacaaaaattagggcgtggtggtgcgtgccagtaatgcagctactcaggaggctgaggcaggagaattacttgaaccagggaggtggaggttgcggtgagcctagatcacgccattgcactccagcctgggcaacaagagcgaaactccgtccaaaagaaaaagcataacccctagggttgcacataataacaaattccagagggaacatagtgaggtgtatacaatgaacgcataaactactgcggggaatacagtgagatgcagacaatgaacgcataaactactggggggaaaaggtaagtcgctactctccagtacaaacctgaagaagcataaaagggaacacagtgagatgcatacaatgaacgcataaactactggggggaaatgcaagttgctactctccagtacaaacctgaagcagcataaaagggaatacagtgaaatgtatacaatgaacgcataaactactggggggaagtgtaagtcgctactctccagtacaaacctgaagaagcataaaagggcgggcgcaggggctcacacctgtaacgccagcactttgggacgaggcaggtggatggcttgagcctgggagtttgagagcagtctgggcaacatggtgaaatcctgtctctagaaaaaattaaaataatacgaagaagcacaaaaggaaaggaaccataatgggaaatacggataaggtttgttttgttttgttttgagacagagtcttactctgtcacccaggctggaatgcatgtggcacgatcttgtcttactgcagtctcaacctcccaggctgatgtgatcctcccatctcagcttcccaagtagtgaccacaggcaagtgccaccacgcctcgctaatttttgaatctttttgtagaaatggggttttgttattttggccaggctggtcttgaactcctggactcaagcagtctaccagcctcggcctcccaaagtgctgggattacagtcatgagccactgcctagctcaaaacatggataagtttaacacaatatggagatgagttttgttagtttatttcagagggataattatttaacctacccaatttaattccattggcttattgtgttcaattttcgtaaaggtttttttttacagtgctttattaattaccgtcattaaatcactcatgtttgtgcttttgaggttaaaattgcagagttttctcgtactccagaagactttctaaagaaatatgatgaactgaaatctaaaaatacaaggaaccttgacccgctggtgtacctgttgtcaaagctcacggaagacaaagaggtaggtgcccatgccacgtgccacactgcgcccgtacggcccatgttgggagtggggtcgcgtctcctgctcactccacgccatcttcctgtcagctcttcctcgctcacaccagtaacgcttctaggccatgtaggaaatttttggtgaatcagaatgaaagataacccatgttgggtgtaaacatgagaagcagcctctggggcactttgagcttcccgcatgtgtcacgctcagttcctgcctgtcgcacgcgtcgctttgctattaatgggtgcctgtcagggttggggagccgtcctggtggtgtcgtccctactctccccctatggccaaagaggtgctggcccagtgtgaacacacagttttacatgttttcagactctgcagtacttacaacagaatgcaaaagaaagagctgagcttgcagccgctgctgtgggcagcagtaccaccagcatcaacgtccctgccgcggcctccaagatctccatgcaggagcttgaggaactgaggaagcagcttggcagcgtggccacaggctccacgctgcagcaggtactgcgtccatggctgtccacaggctccatgctgcagcaggtcctgtgtccgtggcgtccacaggcacccacactcagtgctgtgccgggcccctgctggaaggacatgtctctctgtcatttattgaaaatgaatcccttagagaggccaaggcttaatgcttgatcatgacctagctctatatgtttagttttttttttaaccaagaattctggaccacaagaatcaatagcagcaaggttctgacccacgtgggagttgtgctgccaggtggccacgtgactctgagcctacccaatcctgactccccatttccctcctccaatttttgacaattttgagggaatgctttcagatcattatattttcaagattctcgaaaatacagtaatttttattattccttctgtatttgctacttgctcttggttttgattttatgccctaccctggtcttttgacgtaagtcatctcccagtctctctcattagagctgccacgttcctgcctttgtgacctttaaactccctttggagctgtgtccctgaggcgtcctagcctcctgggtgcgtgttgagtgcagcggctcccaaggacccagccggttcttgctgggcacgttctgtgctggacatggtgctaggcctctgtccacgtctccctcagccgtggcagaagactgggtcttactgccacgtgcagagacagtttgcatctgcccgtgtccctgaccagccctgagtgggagtcagtgcttccgaaagctgggccagcccaggccgaccccatcagcctctggcggccactggcgcaggagggcaggctctctgaccacatgtcaggagccatcctgtcacgctggggcccttctccggcagggtaaggatgcatgtctgttgctgaagcctgtcttcacccatcaagtggtgttcagacctagtcactgccagaaagaagcaattcagcttgttcacagggcgccctcctttgaaacagcggctctgtgcctaggtgcaccctctcccgtggttcccactgctggtgctcatgttttcccaggggggcccttgcaggacctgcactcctgagaagaggggctagggctccccatctgccctgttgtccccagcccctcacgttgtggcaggcagggatgtcgaggcgcatttcatttctatgtggttgaccctttgtgggtgttgaattgagtaatcatctttgccgtagatgctagcttctatgcatgtctttagttgagtgtttgcgctaaagtgtatctttctggttttgttttttaaaatgtccttgctagtctctggaacttaaaagaaagatgcttcgagacaagcagaacaaaaaaaattcaggccagcacctccccatcttcccagcatgggtgtatgagagacctgccctgatcggggatttcctgattggtgctggcatcagcacagacaccgctttgccgataggtacgtgatgcgttgatttccgggctctgccgataggtacgtgatgcgttgatttccgggctctgccgataggtatgtcatgtgtttatttctggcctctgggcaggacactttgcaggcccagccctcccccgggcctgcctttcctcaggttgtgaggctcaatgctgactggctgccgcctccatattcccatcccaggatggcagcagagaacggctcacccgggtccttgagggttcttctcctgtcccttctgccagagctgtggggcagcctgcagcaggcccctccccagccggcatcctggtgccctggtgcagacctgcaggcatcagaattgtgtgcagcacttatttctgaacagcgattcatgactcccatagattctgttacagcagtattctcagaggcctcttaagtagtgttcgtgtaaacaagatgcgggtgagaccacacagtcatttcaagacgttgttattggggacctgggatgtgttcatctgtcacaattcatgggtacatttttatttttatttatttttagttcttttgagatggaatctcgctctgtcgcccaggctgaagtgcagtggcgtgatctcggcacactgcaacctccacctcccaggttgaagcgattctcctgcctcagcctcccaagtagctgggactgcaggcgccaccacgcctggctaatttttatatttttagtagagacggggttttgccgtgttggccagactggtctcgaactcctgacctctggtgatctgcccaccttggcctcacaaagtgctgggattacaggcatgagccaccacgcctagtcaagtacatttttagattgaaaaatgagatttcacaaactaaggacagagcatacctgcttatcttgccccatccccgttagtccaaactcaagaggcagcatggagcgtggtctgcttccccactactcacggctctgcaatgtgggcaccaaggggccaacccttgcctttgccggaaaccctggagaacggtgacgtgaaatccacctgttttcctcatccccaagcaaacagaaccctgctgtaagttaatgaaaagtatagaaaaaccctgctgtaagttatgagaagtatagaaaaccatgctgtaagttaatgaaaagtatggaaaacagtctacttcggccaggcatggtggctcacacctgtaatcccagcacttagggaggtgaggtgcgtggattccttgagcccaggaattcgagaccagcctgggcgacaggacgagactagtctctacaaaaaatgtgaaaattagccgagtgtggtagcgtgcacctgtagtcccagctactcaggaggctgaggtgggaggatcacttgagcctgagaggtcgaggctgcagtgagctgtgatcgtgccactgcactccagcctgggcaacagagcgagaccctgtttcaaaaaaaaaaaaacaaagcagtctgctttgtgcagtgttttcagtaataatccaactgtgaaaacccaactgtgaagacttagggagagagagctgctcccttagcgggtactcagcaggcagccggggagtggtgggcacctgagagctcctgatggtacccaggcagacttcggagaaggaagcgcggggccctgctgcctgggatcccagcagtggagccggctttttggagcaggaggcactgagggggtgttcaggctttccccccatgtttccccattcagggaaggggttgtacaaaagaggaacgcactgtccagtaacgctgcggcgccgtgggcagctctgagcgtggcggtgattggcagcaagtgtgtgagacttggctgtgaaccctgcagccagctctcaggtcagggtgcaggtgccctcagcacactcagcatcccaggaaaggggcggcctcgccccacctccctcccacggccacataccacaggtcccaggggtgcctccggtattgaggctgccttgcctccctttgtccgcactgtccctgtccccttgtgccacctgtgcagacttgagaatggagctcactgtggtgttcatgccggggcctgtctagctcctcaccccacgatttgaccagtgccacaccacgggaccttgtgtgacctcgggcctgcgtcctctggaaaacagctgtggagtggtgtgatgaggacaggtgccttggaaagcatcaggaccttgtgagcacgaggcagctgccagcactccacgttcccgccatgctctcctcaccgtgtgggcatccacctggccagcgccgcctccgcagtgcccctccctctggtcgctcccgcgcagcatgcgaaggtgttatctgcccgcgtcctgccttttccccacaccggcacggaggagccacgtgttcggtggtcgttcggacgtggtgatttgcaggtgacatcgcaggtgttgagatgacactgaggatgttgaatattggggaggtgaagcaactgactctttttttgcttgagacagggtctcacttcgttgcctaggctggagtgcagtggcacaatctcagctcactgcagcctcgacctcccaagctcaggtgattctcccacctcagcctcccgagtagctgggactgcaggtgtgcaccatcacacgcagctaatttctgtattttcagtagagacggggattcgccgtgttgcccaggctggtcttgaactcctggagtcaagcgatctgtccaccttggcctcctaaagtgatgggattacaggtgtgagccaccatacccggcctaaagcaacccttgaggtccctccacagccaggcggctggatccacactaacccccaccccacggcacctccaccccaccgtgaggcttctccccacaagggcattggccgaggcttcgtggctgtggatgaatgaggccaacatggtggaaagtaagtgatgcagagtcagaggcagttcctggaagatgcactcgctgttcccaaaacgccaagccacacccactcctttagggatggtagacattggggtctcggttttattggtcatcctgagaaggccactggagtaatagaaagaaatggaatttgaagttgaaaagtgtagatctgccagcctgggcaacacggcaagaccccacctttacaaaaaatttaaaaattagccaggaatggtggcacgtgccagtggtcccagctccgagggagactaaggatacaggatcgcttgagcctgggtgctcaaggctgcagtgagctgagattgcaccactgccctccagactgggtgacagagtgagatttgtctcaaaaataaaaaaaggaaaaaaaaaaaacaaggacagtgtggatctgcatcaggattgaggctttcgctgaagggcttgcgttggtgacggattgtagtcttgaggcctgcagtcacaggacacttcccagcagatgtgtgaggctgacagagtgattttgtaaaccgaaagcctgttgtacggagccttcctgagctgccagggcctggtttgggtatggtctggctggcacggggccctgtcaggccctcgtggggacagtttcaacatcctgctttcgtctggtgctcctcccggccccccaggcatggcccgcctgaggctgtggactgagaacttggtcctgggacctgaggggtttggtgggtggcggcccgtggccgtcctcgtgaggaagcttagctgtgtgtcctgcagccgtctcatcctctctggatagaaattatcaagagtttcttaacgtttaagtgatagctttttaaagacaaggttttttgtcccagagtaactcagacttaccaagttgtacttaccaatgttgaaagtgcagcttctgctggagtcgccttttcaactcctaacttcaccttttcaaatgtcagccatgtatctgagcattgcggagccgagtgtggtgagatcttgacaccagccaccacgcctcccaggccggccccgtcctgcggcggttggaactcagcctgtggctccccagtggggtcagtcaaagccaagtgcagtggctgaccttttatacccataaacaaagatgagcaagagtgagactgacccgcagatgagggcacgtggctgtgggggcatgggagtgggggctgcagagccacagcgctgtctgtgcccgcaggcacgttgcccctggcctcgcaggagtcggccgtggtggaggacctgctgtacgtgctggtgggcgtggacgggaggtacgtcagtgctcagcccctggctgggaggcagagccggaccttcctcgtggaccccaacctggacctgtccatcagggagctggtgcacaggatcctcccagtggccgccagctactccgctgtgaccaggtgggcaccgggcgcggtccctgggagcctgcgctgttgtgggggaggggttaggtcccatcctgatgaccatggggacgtctgcatcgcttctaaagagagcgcccgccttggtgacaactccgtgcccaactcagttttggagggtctgtgagtcaccatccagggtcctgactcatctcctcctggggcaaaagttcccctctgggatgtggggttcaagtgagtcatttgcttcctgtttgggatgagactcagaatatcggacattgtatgtgcctgcagcttgcctttttgaggaagtctgacagcttttcttccaggttcattgaagagaagtcttccttcgagtacgggcaggtgaaccacgccctggcggccgccatgcgcaccctggtgaaggagcacctgattctggtgtcacagctggagcagctgcacaggcagggcctcctttcgctgcagaagctctggttctacatccagccagccatgcgcaccatggacatcctggcctccctcggtgcgtgcccgcccggggggcatggggcagtggtgggtggcaggtgttgaacatggcacccagtgtgaggagagactctgcaggggccgtggagcagctgcccagggcaggggcgtgtggccaaagctcatgttgctccatgtgctattaacttgcaagaggaaagccctggaagctcttactggtcagctgaaatcagcaactacaaccttacagttaatacgtatcccaaagaagcagcaccgtcccaggaagaaggttggagaagcatgaggggccccagcagtgttgttggcagaggctgggcgtgcgcttccttctcagcagtgagccctcctttctccccacagccacctcggtggacaaaggcgaatgtcttggggggtccacgctgagcctgctccacgacaggagcttcagctacacaggggacagccaggcgcaggagctatgcctgtacctaaccaaggcggccagtgctccctacttcgaggttctggagaagtggatctacaggggcatcatccacgacccatacaggtagggctccccgggacacggggacacggagggacacggggacacggagggacatgggggacacggagtgtgcatgctgccctctcccgtacaggtagggctccccgggacacggggacacgggggacacggagggacacgggggacacggagtgtgcatgctgccctctcccgtacaggtagggctccccgggacacggggacatgggggacacggagggacacgggggacacggagtgtgcatgctgccctctcccgtacaggtagggctccccgggacacggggacatgggggacacggagggacacgggggacacggagtgtgcatgctgccctctcccgtacaggtagggctccccgggacacggggacatgggggacatgggggacacggagggacacggagggacacggagggacacgggggacacggagggacatgggggacacggagggacacggagggacacagagggacatgggggacacggagggtgcgtgctgccctctcccgtacaggtagggctccccgggacacggggacacggagggacacggagggacatgggggacacggagggacatgggggacacggacggtgcatgctgccctctcccgtacaggtagggctccccgggacacagggacacggagggacatgggggacacggagggacatgggggacacggagggcgcgtgctgccctctcccgtacaggtagggctccccgggacacggggacacggagggacacggggacacggagggacatgggggacacggacggtgcatgctgccctctcccgtacaggtagggctccccgggacacggggacacggagggacacggggacacggagggacatgggggacacggacggtgcatgctgccctctcccgtacaggtagggctccccgggacacggggacacggagggacacggggacacggagggacatgggggacacggacggtgcatgctgccctctcccgtacaggtagggctccccgggacacggggacacggagggacacggggacacggagggacatgggggacacggacggtgcatgctgccctctcccgtacaggtagggctccccgggacacggggacacggagggacacggggacacggagggacatgggggacacggacggtgcatgctgccctctcccgtacaggtagggctccccgggacacagggacacggagggacatgggggacacggagggacatgggggacacggagggcgcgtgctgccctctctgggggctctggccttcctttgcttgtggtctcaggaaagcacaccccgggcagatgtccgcctgctgcccatggggcccagggcaggaatggcccagctgcttatggccttattcttttgtgtgcaggacattaaattgcctccaattaggtccttcaacctctttggtgcttggatttcctgatctggtggggtctgtcggcttctcttcagtgcgatatatttaaatggataaaaatatgttagttcccaaagaattgtattatgtctattacgtcaagataccgttgttgaaatattttcaaaaaatacattagtgatgtggaaatgttatttctttactaatggaccaaataaaatctggtataatgggcacctttaaagaaagcaccttcacacttgaagtgcgtaaatgatgtttgaagttgttcagatgatgacgtggagatgtctggtttctgtcaatgttggccccgcctaccccacacgagcatcattttgggtgtcagggccccacgcaccccacacgagcatcattttgttgcctgggctcatcatggaaggaaatgctaaattccaaaaagaggtgggtgcagataaagacaaatcagtttcccacctatctctgcggaccgtacattctccctgagcccaggttaaatactccgttccagagcgaggtttgtaggtttgttggttttcttttttttttttttctttttttttttgaggcagagtctcgctccattgccaggctggagtgcagtggcatgatctcggctcgctgcaacccccacctcccaggttcaagcgattcccctgccttaacctcccaagtagctgggactacaggtgcacaccaccacgcccagctgattttttgtattttagtagagacggggtttcactgtgttggccaggatggtcttgatctcttgacttcgtgatctgcccacctcagcctcccaaagtgctggggttacaggcgtgagccactgtgcccggcccctaggttcgttttagccgagaagtgttggggttacaggcgtgagccaccgtgcccggcccctaggttcgttttagcccacagttgagaagtaactggtagattaggctcggcccttgtggaacgttacttggaagtgtgctggcctctgttaatgtccctgcgcgctgccggcctggagaagtgtcgcctgcctcaggcgcccttgctttgcctgtgaccgaagcgctccctgtggttttagtgagtttatggtcgaggagcacgagctgcggaaggagaggatccaggaggattacaacgacaagtactgggaccagcggtacaccatcgtccagcagcagatcccgtccttcctgcagaaaatggcggacaagatcctcagcacaggtgcggcgcagcgggcggggacttggggtgcgcagcacagctctgcctggagagtctcctgcagcccaggccctcccaccgggagcctgtgcctcaccctgtggttgccctgagccctggtgtccgtgaatgcggggctgaggtcaggactggcccgtgggctgggctgcggcgctgagttaggccttgagatggtctctgttgccaggttccctcaggtttccatctccgggactctgtccctgaccctgcgaggctctctcacaggtgccttctctatttctgtttctgatttctaaaactccgctagcatgtcaggaaaaaccagcaaagacacacgcctggcggccggcagtgtttcctatctctgaccacacaggttagggcctgacctggacccagggcagtggcgcggggacttggactcggcacatcggggccgtcacgaaagggttgggaagcgattagccatccggttctcataatgcctgttcgaaattatttctgtgcccttggttagaaaattccagatgtgcagagccacggcaaagccctgccaccaccagctcagtctgtagccgctgacagtgatttaccgggaaggagcaagggtgtggagccgcctcatgcagcccagtttccattccactgccttctgtgtagacaaagacagctggggcctcagactgaccgtgtggagagcccattcaatgtccattccactgcctcctgtgtagacaaagacagctggggcctgagatcgaccatgtggagaataaaattttgaatttctgtgttttcaggaaaatatctaaatgtggtcagagagtgtggccatgacgtcacctgcccggtggctaaagagatcatctacacgttaaaagagcgggcgtatgtggagcagatcgagaaggcgtttaactacgccagcaaggtgctgctggacttcctgatggaggagaaggagctggtggctcacctcaggtgattccgtgccctgtccctgtgcgggcactcacctccctctgaaaccggaacctgtgggacgtggggctgagatcgctgggtttcttctggcagctccgccttgtctttttgaaagtgggcactgctggatggtctctagctcaaggacctggcactcacagtgggtggtgtaggcccccggtcaccttgtccaggggccccagctcccctccttgcccagggcccaccagccccttctcagctcctcctgccacagcttgcgtggtggttgcacagcccctgcctgagagccaagcgcttagcctgttgtagtgtgttttagggtgatggctatggcgagcatctgtgggtgggcacgtgctcacgcctgctccctggccgtggcgggcacctgcgggtgggcacgtgctcacgcctgctccctggctgtggcgggcacctgcgggtgggcacgtgctcacgcctgctccctggctgtggcgggcacctgcgggtgggcacctgctcacgcctgctccctggcgcaggtccatcaagcgctacttcctcatggaccagggcgacttcttcgtgcacttcatggacctcgcggaggaggagctccggaagccggtggaggacatcacgccccctcgcctggaagcgctcctggagctggcgctgcgcatgagcacggccaacactgaccccttcaaggacgacctcaaggtgggtgggggtgccgggggctgtcccctgtggcagaggcctcggaggggctgggaggagagcacagcagaggccagccctgtcccccactccccgtcccggtgaggcgaccgcagggtctgtttccttcacttggctaccggggccggcttgccgggatcgggggtctttgtgcctgtgctctggaggggcgcgggtctcgggttttcctgcagtgccctcgtccgggcctggctttcaggtcatgctggccttgtggaattgttttcacgtgtccctccatctgtcttttgaaagggtttcaggtcttttgaaagggtttcaggagtggtgttaattctttttgtttttgcctttttgttgtcgttgttttttgtttttttttttgagacggagttttgctcttgtcacccaggctggagtgcagtggcatgatctcagctcactgcagcctccacctcctgggttcaagtgatgctctacctcagcctcccgagtagctgggattacaggtgcgcgccaccacgcccagctaatttttgtatttttagtagagatggggtttcaccatgtttcccaggctggtcttgaactcttgacctcaggtgatccacccaccttggcctcccaaagtgctgggattacaggcatgagccaccgtgcccagccgttttttaaaatatatatatgttttatctgttttttactatttttaatagagacgggggtctgtgttgcccaggctggttgaacccctgggctcaagcgatccttcacctgcgcctccccaggagggtgttgattctttggctgtttggcagggtttgcctgggagctcttgggccctgggtttgtctttgttggagacttttgagggggacttggccccttgctggccacaggtctgctcagtccctttcctcttggtcggctgtctgtctcgcatcttgtctggtgcacagttcatgggtttctagtatctgctttttatttctgtaagattagtagttatatcccttctttttctgattttagtaatttgaatcttctttcgtcttagctgatgtagctagaaatttgtcgatttcattatcttttcaaagaaccaactcttgggtttgttgactgtatttttctgttttctctcttctgtcatctttgttactcctgtctgctgcttaggggttcagtgtggtcttcttttttctagtttcttaatttgaaaagttagtttacagctgtaaacatccctccgagtgcagccttcgctgatcccctagcgtcataatttctgtttgtctggaggtgtttctgattccctctgatttcttgttggagccgtgggtggtttatgtttaacttccacatgtttgtgaagtttctggttttccttctgttgcttgtttctaactttatctccttgttagagaacagactttttgtgatttcagttttgtgaaatgtattgatttgtgtagtggccccacatccatcctggagagtgttccgtgcgcgcgggaggaggatgtgccctcggttccgtgcgcgcgggaggaggacgcgccctcggtgctgttggggtggtgttctgcaggtgggttgaggccgtgtctttcctcactgatcgtctgtccggcggttctctccgtggttagaagtagggcaccgagtctccctgtcactgaagaactgcttttctccttgtcattctgtctattcttgattcagatattttggggtctcttgttaggagcaggaatattttcgtaggaaaaattcctggtagtgaaattgttgggtcacaatacatggcccttgtatgactaggctgaccttgctggagttgatggagtccagtctcaggacgctgctgtctgcacacctgcgaaagctcccaccttggctatttgatggacaagtgatgtcaggggctcatttctgcgtttgtgatggtcacgatttcgtctgtccgctgcttgtttcttcttgctttatcccctgcccttcatttcctgtcctgtcgttgtgcgatggttttgtaggaactctgttgcgggtggttggaacttagcaaatactcgagtgattaacgtgaggacagtattacttgcttataataactattatgtccctcgtcaaatatgcttcatttttcaacctgggcctggtgcttatcatggtacaaaggttttcgtcctaaggaatcacgtttctttcaccgtccttagcggtttttcccttataccacccacagcagcagtgggtatttacaaagtaattcatctgaatttttgttgttttgttctgatgggaagtggttcagttttgaatttgatttatcagtagatgtttgggtttttgaaaagcctctgatatttagaatcggaatgtagggaaccttacgtcagcgctgggtctgtgagcgaggatggcgatcgggatgcgacttcgggtcttttccttaaaactggatgctttgtttcatttccttccctccaagatcgacctgatgccccatgacctcatcactcagctcttgcgcgtcctggccatcgagaccaagcaggagaaggcgatggcgcacgccgaccccacggagctggcgctgagcggcctggaggccttctctttcgactacatcgtcaagtggcccctttcgctcatcatcaacaggtgcgggtcggctgctcgggcacctgccagatcttcactcaggtttggcagaagcgagaactgtgccacgcggtggccacctcgtcccacagaggacccaaggcggctctccccggccttcagtgtccgagagattcacgggctgtccgggggccacggtgcggactgtggagtacagacgccgtgtccacgacgccgccggtcacggaggcccacctgaggtgccgccacgtctcttgcaggaaagccctcactcgctaccagatgctcttcaggcacatgttctactgcaagcacgtggagcggcagctctgcagcgtctggatcagcaacaaaaccgccaagcagcactcgctgcactccgcccagtggtgcgttcttcctctgcccccgcatgccctcctgaagcagcgctcgctgcactctgcccagtggtgcagcgccccccttgtgccctcctggtagacagctttctaggcttctggaagtgtcatctggaagcgcacgttggtggctttagatccataatgcttcattgcttcattttcctgtcttggggctgcacggcgctgccgtccaccccacaggggatgctggctctgtccctcagccctctctggagccttgtggtgactgcacgggcatggagactgcccaggtcggtgtgcaggacactagctcctcccgagagcggacagccacatcttgctgggaccagaggtgctttgcagccggtctgtgcctctagggtgttgaaaaaaggggtcgatggcagagcttcataagaatttgtccagtcgggtgcagtggctcatgcctgtaatctcagcactttgggaagctgaggagggaggattgtttgagcccacaagttcgagacccgcctggacaatgtaacaagagctcatctcttaaaaaaaaagaaaattattttaattagccgggaatgcctgtagttccagcaactcaggaggctgaggtgggagggttgcttgagtccaggaggtcaaggctgcagtgagccaagatcgtgccactgcactgcagtctgagcgacagcaagaccctgtctctcgaagaaaaaaagaaattagaagaaaaagaactcatcttgatgatgaagcacaaatatgcatctgttgtgtggcactttcctggcgtgggctccgaggggtccgtccaccaaggagcccgcgtcccagtctccaccgtccagctggctgggggtgtccctgcagggcacaggttggtagacggtgacagcttgtgctgggcagacgcaggagcagcggccgtgagtgtctggtgtgctgggaggggcgcttgctctgcagaggaaatagccacgtccagagaacgtcctccatggctgtcctccgtcctccgtgtcacttggtgggcgctgtcggggccgcgtcctccatggctgtcctccgtcctccgtgtcactcaggtttgctggggctttcactctgcggcagcgaatgctcaacttcgtccagaatattcaatactacatgatgtttgaagtgatggaaccgacctggcacatcctggagaaaaacctgaaatccgtgagttttagctccacagataataacgtttgaaagccactttcctttcacagggagacaggaagtgcaggagaggcagggcgaggggagaggcagggagtgcaggagaggcagggaatgcagggagacgcagggagtgcaggagaggcagggagtgcgggagaggcagggcgtgcgggagaggcagggaatgcgggagaggcagggagtgcagggagacacggagtgcaggagaggcagggcaaggggagaggaagggatcccccagggcggggctgcacccacactgctggccacacacgggaccccttgctgcctgccgtcctagggggactctgagccgtctttgccccgaggttgtctctcccacattgcgcatctgaggctgaggggcctgaaggcagaatctgttggtaccaaattccagaagctgccgcagcctcccttcctgtcttctgccttaagaaatgaaaccccttcggggtgtgcccatcatttttttagtggtgtttggaagttttcccctaaaagcccaaggcccatttaagaggtagaagtgcgtaaacaggaatgcacaaagccagaactgagcacgtgcgcatgcagggcccgtctgtcagccacgtctttctgagaaggggcttggcctgttccccgcaggcctccaacattgacgacgtccttggccaccacacaggcttcctggacacctgcctgaaggactgcatgctcaccaaccccgagctgctgaaggtcttctccaagctcatgtctgtgtgcgtcatgttcaccaactgcatgcaggtgcgtgggtgtgggtagcaccatcgggtgggcaggcgcgggtgggcagaccatgtcccgaccgtggccgcacgcagcctgctcacgttttcctgcccttgtgttcgtggaggagccgctgggatctgagtgtttccagaactcctggtcttcctggccgggtgattccctcctggagcccctgccctggcagcgtgggcagggctgtgttcctcccgaaccatccctcagcctctgtggtgctggtctctgtccggggcctttgcttatggcccttgcatgctcttttcctcagcacttgagctatttgattccgttaaggacctgcaggcactagtcacaagcagctgccgactggcgatggtgcagaacctgcgtgtctagtggcagaagcaggggtctgagaatgaggctctccaggcagtgccatggggagggtccggaggagggcgagtggggaggtggaggagggcatggccacttcagggtcccaaatagggaaacaccaaaataactgttctcaggaaaatcagctggtcaccgtggaaggtagacctgggaattctgtcggcacagataagtcatttcccctgcagcctcagagatgcttgtgtacccccagccgcaggctacaacagaggtgcggagggtgacgtgcctgcaggacttgttttttctgcaaagcattgtggttgtaactaacagaagcatttccttgcgactctccccccctagaaatttacacagagcatgaaattagatggcgagctgggcgggcagacgctggagcacagcaccgtcctggggctgcccgcaggggccgaggagcgggcccggaaggagctcgccaggaaggtgcgtggcctccaggtttggccagagagagacgcttcctcccggctgggcggcagcctgggcatcctgacgcagggagaacaaacctccccccttttacttccatctcccctcagattgaagaaaagacttaaaattagcttccaagcacaagcacaagagcctctcacaatcttctcagctctctggtccccacttcagccagtcgggctcgagggaacccccacagatcttcagagcgagcgctgtgcagggcgcctgggcgagggcaggggccacacccgctgtccctgctgagctcggtcctgagttagaaccgtcaggctctcagcaggcacggacaggctgcatgtcctcggaggcatggccctgcggcgccggctccggggtggcatggtggggtgggcagtcccgtgttcacacgctggagctggagctggcagagaggagttgggtttggaagcgtgggggccggaggtgagggacactgagaggcgccccgacctccttgctgagaaagctgctgggaaagctcgttcatctcaccccaaaggagagtgaccacctcatcccacgaggcctggagtgtttctctgagtgctgggttctcaggaatgttttttgatgtcttttttaccttgaatctcctgaaaacatcatggaacccatgttttctatttaagaaaaggggaagggaaaggacaccggcctgctgggaacagtgtggagccaagaaggcccacggtgggggtgggcatggctcacgcaccccggctttctttccagcacctggctgagcacgcagacactgtgcagctggtgtccggcttcgaggccaccatcaacaagtttgacaagaacttctcagcccacctgctggacctcctggcccggctgagcatctatagcaccagtgactgtgagcacggcatggccagcgtcatctccaggtgggtgggcgccaccccggctcagcccttcctcagctcagtccagcgcctgcccctgcccagcaccgccctggctcagcccttcctcagctcagtccagcacctgcccctgcccaacaccgccctggcccagtgctgtccctgctcagccgtcccccagctcagcccagcacctgcccctgcccagcactgccctggcccagtgctgccccggctcagccttcccccagctcagcccagcacctgcccctgcccagcaccgccctggctcagcccttcctcagctcagtccagcacctgcccctgcccaacaccgccctggcccagtgctgtcccggctcagccttcccccagctcagcccagcgcctgcccctgcccagcaccgccctggcccagtgctgccccggctcagccttcccccagctcagcccagcgcctgccccggctcagcccttcctcagctcagcccagcatctgccccagcccagcgccaccccagctcagcacctgtccctgcatccaggccccatctcccctgcaccctcccctggtccacctggtgtagcctccttcagaaggtggggcaggtctgtgtcctggtgctagtgctggtcatatgccactccctgaagtcaggctagcccagctctccctggggtgtgacattctgtgcaactgggctgccccattggcaccctgcggctgtgtgtgtcctgtggggctgatcaggcctgggtcagcttccctcatgctgcactaacacctagcctgggggaaagggccaggtggccaaactgccagcctggaaggggtggtgcccttgggggtgctgtccttgggaaggtgcctatttgtgcttttggaccaccctgtgccctgtgccccccacaaatgttctgattttctgagcagggatttctgaggccaccctgcattgagaaccactgcttggttctccaagcccctgacacctcaggccccattgctaggccctgttggggtgatgggagccccaactttctggggccaggagagaagaaacctgtgtttgtgcctttgagcaggactgaacaggactgaaaaccttcctgtggaaacattagttaggagcgtgcctcaccctcacccctgcagggcctcttatggtctctgtagctgaacacttccccatggtaggagcagggctgctcaggacggacccgcagaaggagtgtgtgccccagctccactgtccttcctcacccctgctgcccagcacgcacccgcagaaggggtgtgcaccctagctgcaccgtccttccacacccctgctgcccagcatgcacccgcagaaggggtgtgcaccccagctccactgtccttcctcacaggcttgacttcaatggtttctacacggagcgcctggagcgcctgtctgcagagaggagccagaaggccaccccccaagtgcctgtcctgcgggggcccccggctcctgcacccagggtcgcagtcaccgcacagtgagccctggctgtgacaggaaggaagggtgtggggtcagcagggactggtgcaaatgggtccagaattttcaaatcgaatgctctgtgttctgtctttgcagtttaaatataaagcaggaatgattgactcagc

SEQ ID NO: 36175 - DNA, 11611 bp, Homo sapiens
gcggatggatccaacatggcggcgccgagcctgagccgagagtgaggcggaggggcggccggagtggggagagggagtcgagcgggacggggcggggccgggcggggccgcaaagggcttggggaaggaaagtggagggggaggcggtggcgacgtccagcctgagaacctcaagagagggaggtgacgggacgctgagaggtgggggaggggagctgccgaggggggcgtgcaggggagatggcaactgcgggagagggcaggggtcgagacggaggagtgagggcatggggaggggcgtaaacaagggctgagactgggcccagccaggggtattagagaggccgaggtggggagtggggctgcgatccgctcgtattgaagggggtaggagcaggagggagaggctgagggtgtgaaggggaagggggctgtggcatgtggttggagggaggactggactctgatgaggggtgttgcgaggaggtgggtaaaggtcagaattggagttaagacgtttctggggggcttcgaaagtgttaaattggaggtgggagggggaagggcctaggggagaatttgggtggaaaaggagagaacggaggcttggggaatggagagagtgtcggtgggaggaggtaatggagaaagtgagagactgggaggaagaaagtttgggaggaaggggagtggaatgggagataggacagtggagctgcacgggtgatagaggttcgggggtttccctttccccggtggagaggaggagagaacagagttaagcagcatcagttgcagccaattctaattgccaggcccttagcttttaagagggtgggaagggcagaagggaatggtcatgtgggtttgcagaattggggttggatgagaattcaactgggtttgttttccaaaagactccctagcttactgttcccttgtttttcctgcttgggaaaatggggaagccggtgtcgcccaagtgtggaggagcaaaggacttttctagtttttagcattagcaatacaagagtgggggagcagacatggctatattggaaccctatatgctaaggtggaggctctggaagtctgaggagggaaagagaaaagatagagtggcatctagacaggttaattaaatgagtgctgtagtttccagacccttttgctgttttaagtctggaagggagggggtaacatggatactgtatgtagaaaaacttttccctggtgaaacatagacgtatgagtggatgctgcgccattagatattttgttctcattgtgtgctagttaagggaaagggccaaatgtagaatttggaggatagtgctggtctgctgtaaccactttcctcccagttttttctaaaggtgaaagttaacgttaatattgtaacaaaataggaataaggaattgtggaggaagatgagaagctgccagagggtaattggttttcccagaagttcttaaatttgggagctgtcttgccgcaagccattgagactggaaattcttggagttggtattgtttttgtaaattgactaatagagagttagggaagcctggagacttgttgggggtgagttctctaaatggttttaggcttgtctgtgtacttttgcaacgagattgtctaattctatgggcctctgaggtttcaaagtaaaacttgaaaattaattattttcccctccttatttgtttttgttttgctgctggctgtgaaacttgtgctaggaagagacctgggaaattaagtttcttgcggaggtaagtctggaacttttttattgttttcaaacaatggaagggaatggaaatagcatgggagttattttgaggttgggtccattaatgaggaggagaatgccagggaaaatgagttatcattcatccatctgagtgcatgagatctgttgtaatcactgtctttagttaattggagataggaggtgaaagagaaggagatttagatgtcttgggacaatcccccagctttggtttgttattgtctagtcttcttggtcagctctgaaacattttttttttttaacatatggaaggctgtattctagtacattgtctactaaatgttgcccttggagggttgctgggacaccttccttccgtgggaaacttttcctctaactttctctttcagctgttggggggttcctggcatccttcttttgaaaacatactatgtaattctgacttccagatatttgattacatttcctatcccaccagcaagaatgtactcttaaccatctttaagattttctatgtagttttaatttaagtttcaagataccacttttttttgtagttcttctgcatgacttttcctctgaggacttctgagagagtcagatatctcttaattctatgaaattacaaatatcatccctgttcagaaaagatgactgtcattttcatttcaagacagcactcttttttatttctttcatgtcgctttcccctaagggcttctgagagagccaagtacctcaaaaactacagatattcctggttgggatgagaccagactttgcttggaagtagaaacatagtagagaaggaccaatcaggaggaaatcctgaagatacctatagactgttggcccttggctgacttggacttctctaaagaaaaaagcaaaactccaggaaatacaacaattcctcagaatcaattattcttgggaaactgtaggggagaattcatgtgttactatctcaaatacagccagaccagtcagtgggatcaggactttctgtgtgctggagtttcgtctcttggtatttggcagtgtttcagataccaagacttgagttagttctaattttctgttcagagggttacattctcctcaccattctgatacctgtcatctagaatctctgtatgttttaagttgagctcccttgcttcactgtcacagaaatacgagtatattttggttttagaggaaattggtcatgttttcttttctaattttactaatcagctgaactttcatcactttttttttttttttttttgaggcaaggtctcactctgtaccccaggctggagtgcagtggtgcgatcagagtagctgggaccacaggtatgtcccactatgcccagctaatttttgtttattgtttgtagagatggagttgtgtcatgttgctcaggctggtctcgaactcctgggctcaagcagtcctcctgccttggtctcccaaagtgttgagattacaagtgtgagccaccatgcgaggcctcatcacattcttttaatgttaaagttagatagattcttggaacccttatctgggttgcattaagtggagagggctgcctcttaacctgcatgacagtatcctcatatttctcccaagcacatggccttgaggaacttacatatttctatgtttgcttcattgaataagcaatataagtctgattagtgacctcacaaggagaatttgctgctcatccagttccaagactttaaagatgaccctgaggcttacgagcaggatcctttgtgtctgtcttgcagaggattacatttctaatatccccatagaactccagattgaactaggtcaaagtagacctcctgggatggggcagaagtggatgtagaactaccacctgttcctcagctgaatggcaacagcaggtgacagaggacccaaggttggagtggcatgaaacaccttagtgcagttggacttgggagttaaatgaacatgtatgtccgacaggcttttcttttcttctggaatgttgtttgatgggtttggatggagggaccagatggctttttctagatctagtgtggaaagtgacatgcattcttttgaccctttaccatgctccacctagaatagggtttctcatccttggcattattgacattttgtgctgcatgattctttgttgtggcagactgttctgtgcattacaggatgtttcttttttcttttgagacagggtttcactctgtcacctgggctggactgcagtggcgctatcacatcccactgcagcttcgacctcccaggctcaagcgattcttctaccttagcctcccaagtagctgggatcacaggtgcatgccaccacgccaggctaatttttatattttgcatagagatggggtttcaccatgttgtccaagctgatctcaaactcctgggctcaagtgttcctcccaccttggcctctcaaagtgcagggattacagacgggagccactgcacctgtcctataggatgtttctaaatatccctggcttctactcattacatgctgatggcagtccccttccccaccaggcataataatcagaaatgtctccagacattgccacatattccccaggggtcaaatttgcccctggttcagaaccactgacctaaaagctattataattcctagtacattgatgatctagcctgggatctaggacttaaaggtggctagtgtgtttgtttcctctcaaatgtagggagttaacttcaaaggattgaagcttatagaattacatccattgatacataattaggaccacagtgctttcctgtattttgccttattttccattgcgagggtatgtggggacagtgtttcttcatttcctggggtttaagcacactttaaattagggaactgtggagcaaccagctcttctggttggtttaatgtgaaacctacccaatctgctttatctgagagcctcacaatcaacagctggcccaagggaacaggtgggatagggaacaaagagaagttgcaggggctctgaggaggctcagttttctcatgttgcctgctatgagcaataacttattttcctttagcaccttcatttgtacccagtaacagcaacaggtgaatcgagaggaagaggcaaggaataccagtctatagttgaatagctatttcccatgctttgggtggggcatctgggctctcaaaactatatatggattacatttcctgtctacatatcagaacccatggtatagggttaagtgatcccagagtgtacctccccttttcttaagggaatgagtttctctgtgctttcattttagtttttcatctgaggaagaaaggaccagttcctacttactcttcagctttctctatcagctttgtttttccaaagaagcttattattttattgtttcctagtctagcctcagttcctttttgtataaaatggacagagcaacctgtttaattgttgagtagggtagagtggtgtggtatggtgtgggtagttctggacattgcagaggaggctatggctagttagaatatatgcatggtaactgaattacctgtatctgtttttaatggggtcctctcttggacttttgtgaatttgtttcttaattggaattgcttgaggtgatctcttggagattaagttcagttcaacagtgggttgctcccactatatttgaggctctgtccattactaggcactagggatataaagatgaatatatctctccatgagttgagtaggatctaatgggataataaatacacaaataattttagtacatggtgataaatggtgtaaaggagatatgcatagtgttccataagcgcacagaagaggactacttatctctgcatgggggtgtagaaaatgcattttgaagatggcatctgagctgactcttaaagaatgagtaggagttagccatctgaaaaagagtgatgatgggggtgtggaatagagaagggagaggggcattcaggcaaagagaagagcctgaagaaggtatagagaaattgcatgatgtatgtgaactataaacaaactgataatgttagagaataaaaagcggatgtgatgggaaatgaggttgggaaggtaggcctgatcttagaaggcttgatgtgtgtgtaaagaatttggagtgttcggccaggcgtggtggctcacacctgtaatctcagcactttcggaggccgaggcaggcggatcacaaggtcaggagttcgagaccagtctggccaatatggtgaaaccccgtctctactaaaaatacaaaaagtagctgggcgtggtggtgggtgcctgtagtcccagctactcgggaagctgaggcaggagaatcgcttgaacctgggaggcggaggttgcagtgagccaagatcgcgccactgcactgcagcctgggcgacagagtgactctgtctcaaaaaaaaaaaaaaaaaaaagagtttggagtgttcttatagataacgatggggcaatcaatgggtctgaagcaggaaagtgacttggtcagttgtggacttcagacagctaactgaactagatgtggcagtggatggatttaggtaggttaagattggtgttgcagagaacttttaaagttacagtagtccaggtgagagattattgtaatctgaaccatggcagtggaggtggaaaggtaggatagatttaagaaatatctagaagtagcattaacaggaatttaggattgattgtgtgattggagagtgtgaccagagagtgcacagtataggatggtactgtctggtggagcagtaagtatgagtgacttgagtcaaagttgttgaatttgggaattgattaatggctgcgtcattggtattacctgtagcccataacgatggaggaactttgtgaatcaagagccaaactatataacgaatgtggagctgtgattggtcattgataggggattggtaaatgacatccatgaggaaagcttagaaggtggtattgccaaggccaggtacggtggctcacgcctgtaatcccagcactttgggaggccgaggtgggtggatcacctgaggtcaggagttcaagaccagcctgaccatcatggtaaaaacccatctctactaaaaatacaaaaattagcaagacgtggtggtgcgtgcctgtaatcccagctacttgggaggctgaggcacgagaattgcttgaacctgggaggcggaggttgcagtgagccgagattgcaccactgcactccagcctgggtgacaaagtgagactccatctcaaaaaaaaaaagttgatattgccaaatagggtgaagatcaagggagtacaaatggcatagaattacaagaatgcttattgtagaaacttaatgtttattttaaatccatgagttttggtaaatattgataaactttctgagcagttatcatttcttgatgtggttggattgtaggaaaaatgtggagggatgattctgggctgcaaaggccaaggatgcttgtatctttgaaatgtttcacaaccatttatataagggttacccgtgattttctcattggattcttaacaactctgaggtgtatattcattcatccctgtttatagatgacagcactgagaatctggagttaagtgacttgcttacggtcacacagctacacagcctttcagtgatacagtcagaatttaaactagttcttttttttccgagatgggggactcactctgtcacccaggctacagtgcaggattatggctcactgcagccttgaactcctgggctcaagtgatcctcctgcctcagcctcctgagtagcagggactacaggcacatgccaccatgccttgctaatttttttcttttttgtagagatggggtcttgctatgttgaccaggctgatcttgaactcctggcctcaagccttcctcccacctcagcctcctgtgcagctgggactacaggcgtgtaccaccaagcccagctaattttttctttttttgtagaaacgggtctccctatgttgcccaggctggtcttaaacgcctgggctcaagtgatcctcctgccttggcctcccaaaatgctgggattacaggtgtgagcccctgtgcctggccagtgtttatttttaaacaaacacttcaaaaatttaataaacatgtataaagcactatactgtgccaggcattgttagcaactgggaatatgggaatgcatgagactagttcctgcccttgagtgtctcatcggttctttccctgccctttcagtacggtggggattgcagctgctgagcagggattctggaaagcattgcgtacctgagcccccagcatggcgggcctaaagcggcgggcaagccaggtgtggccagaagagcatggtgagcaggaacatgggctgtacagcctgcaccgcatgtttgacatcgtgggcactcatctgacacacagagatgtgcgcgtgctttctttcctctttgttgatgtcattgatgaccacgagcgtggactcatccgaaatggacgtgacttcttattggcactggagcgccagggccgctgtgatgaaagtaactttcgccaggtgctgcagctgctgcgcatcatcactcgccacgacctgctgccctacgtcaccctcaagaggagacgggctggtgaggaagtattaggggctggaatcagggaagagttgtgggaggccaggaaggagcagcataggcgtccaaaggggaggacacattgatcctggggagtacttagagtaagttgtgaggcccactgggggtttggactgacagaagggaagggtgtatattttcctgaatgattacttctcctcctacagtgtgccctgatcttgtagacaagtatctggaggagacatcaattcgctatgtgacccccagagccctcagtgatccagaaccaaggcctccccagccctctaaaacaggtgagaagacattaactccccctgctttccatcatcaagtaaaaggacactgatcccatcacattctgggctttgccagcttaaatgaaaggatgctgtgcgcccacatcttgccccataaaaaaaaaaaatcaggcgaggtgacatttctcctaggtcctgtatttgctctcacatgtcttgtcttttttttttttttttttgagacagagtctccctctgtcgcccaggctggagtgcagtggcgcaatctcggttcactgcaagccccacttcccaggtgcacgccattctcctgcctcagcctcctgagtagctgggactacaggcgcccgccagcacgcccagctaattttttgtatttttagagacggggtttcaccgtgttagccaggatggtctcgatctcctgacctcatgatccacccgccttggcctcccaaagtgctgggattacaggcgtgagccactgcacctggtctcacatgtcttttcaagtcacatttttccactgcttttagtgctaagtctaaatgattccttcctcattccaacagaagtgtttgaatttctgcctttaccctactgtgttttcttcccttttactttctggtcagtgcctccccactatcctgtggtgtgttgccccacttcgggtcctcagatgtgtagcaagcggccagcccgagggagagccacacttgggagccagcgaaaacgccggaagtcagtgacaccagatcccaaggagaagcagacatgtggtgaggaagttcaagggttccagagatggagcagacttgaaggagaatataaagaactgctgggacactgggcagtttatgctattcagtgtgagattcactttgattgccattgcaaagtgaggctgaatggtttggtgtctggtggaagaactgctctttatgattgtggcagggtacatttcaactcttgttagttaatactacatcacagggatgttgttatgacatccttattgtaggatgagccaagtcgagtattaaaatgaacttctatgcctggtaattaggaaaatatctcctataaacaagttgctacctgtgagtaatgggaacagtgctgacctcggcatgtcccgtttaagggaacctcctgcattcaggcaaggatttcagagatacatagaaatagtcctggggaagaggtagagaagctgtcaggtgatattccctacttttttattctgttgtgcttttcagttttcaagcttggcttgtaaactcatcccttactgtaacctcttctgctctgtatcttctgtttccaacagacatcagactgcgggttcgggctgaatactgccagcatgagactgctctgcagggcaatgtcttctctaacaagcaggacccacttgagcgccagtttgagcgctttaaccaggccaacaccatcctcaagtcccgggacctgggctccatcatctgtgacatcaagttctctgagctcacctacctcgatgcattctggcgtgactacatcaatggctctttattagaggcacttaaaggtgtcttcatcacagactccctcaagcaagctgtgggccatgaagccatcaagctgctggtaaatgtagacgaggaggactatgagctgggccgacagaaactcctgaggaacttgatgctgcaagcattgccctgacctattccctcttctcactttggggactgttcccatcacccacctctggagcttacactgttctggggtttgttctctacccttccaaccaatcacacccctgcctttttttttttttttttaaagaaaaagacaaaagaaagtggaagtggtattccccacccctccctgcacccatgtgcctgggcttcccctttatttcccttttccatttaccccgtaatgtgtctctacagctaccttaccactgagccgtaagacaaatgtataggaagaagcaaagtctacagcacatagtctttgtaagggattgatgtgaacacttttttttggatgcactaaggagttatcaatacttctggctttatgagagctcttaaattttgtctaaaaaaccaaagggctgtgagtaagggagctatgtggaaagtgggactctgaagtgtattttgaaaattaatcgccaccctcttccaaattatagaattttttaaaaacaagctgtggccctttccactctctcctggcctctggtgctgctcctctctgccgcctttcctccattccatggcttgaaacctctgcctgatgtggctccttcctttttcccatttgtcaaaccctcttcaaaggaggaacagataagactgggtcagcctagtcatgcctcccaactgtggtggtatatgtgtacacacatacacagggtggatggagaagaggttgctgattaaaatacactccccctataaaggggaagggggagtgtgacactttctttccatgttcaagtgaaaataaataatgtaccctgcagcccttttcccctttgctttcttctggcttgggcaaagggcatcataggtgtaagtgaagtaattcctttttccttccccctcctccactcctacgcccactcccatgcttgggagaatggggctgggacatgcactgagtgttgcacttttatttaggtagggaggcatgttgaatgagccaggaggtctagaactggagcttagtccagctggtacaataccaactccccttctagttcccaaaggcgatgtccagacacagactttatgattattatatttttcaatgccagtgctgctcagccctcagcagaacttcagtttccatgaaataaacaatgactatat

SEQ ID NO: 36176 - DNA, 49798 bp, Homo sapiens
tttttttttttttcttcccctccctaaactcctctgtcagtctgtaaacattacctgagaattccccagccgaaacggctgctggggcaagaaacttcttgttagaactttccacctccggcttccccctccacctcttttaccgtcccaaccttaggagacgctttttctcccccagaggagaatttatctttttttttttttttttttttctttttctcacccggtgctttgcatttgggaagaggtgatttcaagagtggccaggtgggacgcctctctcctccttattcggtttactatttattgttcggggtgttttttaattcctgtattgctcggcccggggagtttcgccccctgcccggctccgcggcgcggaggatggtgtggaaacggctgggcgcgctggtgatgttccctctacagatgatctatctggtggtgaaagcagccgtcggactggtgctgcccgccaagctgcgggacctgtcgcgggagaacgtcctcatcaccggcggcgggagaggcatcgggcgtcagctcgcccgcgagttcgcggagcgcggcgccagaaaggtaccaggcactgcgactccagggagtggggggccgcaggggcgggggtaagcccacctgctgccgctgcgggatcccgcgcccgggagctgagagtcgccggccaccccacttctccgcgccacccacgagtgctgagctagtcggtttcaccttgtaaatttcccgggcaccggactgtcttttttggcaggttcagagttgatccgctcctttgggatcggtggctggctgactggctattcacccccaccctgaaacctaagagacccaccatttcccacattcctgcctcccaaaggaaggtgttgtgccccccctcccccgccttcccccctttttcttgccgccaccctggtgagtgcagggtgtgcgcactcctgggtagagctgggagccgcctgctagctggcgcctcgtattttccttggcaacccgctacccagccccaacctgggcggctgcagctctgaagacacgagagagggtacttggtttgggtttgaaaagggaagagcggtcttgtatgcagtagtctggccggaccgacactgagaggcccaggtgtttggaaagcaggaaagaggaggccagggtaagcagctactgataaagagcccttgttctcaccttcaaccctgtcccctcccccccagtacaccccccagggatccctccccatttagctggaaggtggtgctgcaaggagggtcctgcccaccaaacacggcctttaactttttggtggtcctggcaccccttgctccaggttttggagacctggtgccagagtggggagagtgggcaggctgtcacccaactcccagcccaggccaggctgactcacgcggtgaccagagccatcaggagagggaggcaggccaggctgtctccagccagccctgtgaagaggaagagcgaaaacagggaattagtttgaaacttaaactgttgtgaactaggggggtgaaagggccgcaaagccagctgatctgacatggagccgcataccttggggattaagtaaatatgtactgtagaaaaccaaacctgcatgtaattccaggttgcttttgttttgttaaatactgccctgagatttacaattcctccggggtggctctgactgggactgaactttggagcctgaactatcagccaaagccgatccgattaactcttccctagccgggctggccggagcctgtggtggccaagctagcaggggtctggctgtccaggactccctcttctccttgggtggtttggacagccgcttgaccttgcatttggagggggagttgggaagcgtttttaacccttggacacaacgaataaggggaagtcagagttgttctcagcagtttcatttccttgaggcgatgccccataaaagggctcctgaagctctttgtgaaggggactgaaaagggcagatgagggtgtcctttggggcggacgtggggtttgggacaattgcatgtgattgtcattctttagctgtctgcatcccacagaaacttttttctgagtcttccagctggcccaagtcctgggtctcttttactgttcttgtagctgactacagtaggcagatgaggaactcttagtcaatctggaaaaactcgactgactataaacaatcctaaattgaaagaagtgtatggcattggggggtgggtgtgatagtacagagtggagcctgcaagttcacgcaccgggaaccaaaccccacctaacttggactggacgtcctcttccagggaatccagccagggccaattagaaatgtgtcttaaattggtgtcagggtcaccaaaaacaaaaacaggatccatgggggcctgtgaaacttcgagtgccattcatgctcggttcagtcatctgacttgtcaggatgaccagcagtgctccctgtaactcgccattatctgaccaattactggagctactttataatgaggcttctggagctactttataatgaggcttctggagctactttataatgaggcttctgtttgctgtcatggtggggagtttggaattgtggcttcttgcctaacaccaatgagaggactttgggacaaacccccagagccaggagtgttttgaggcctagcggggttgggaacaaagggtcaagtgtcgagggagtggggaaattatgggttggggacaggtgtgaacagtgggcttgggggtggcccaagagtactagaccagagaggtccagtgccacccgcagcctgcagtgatactagacagggggcggctgtgtggaaccacagatgacatcccttctcctcttgatggaagtggaggctgcatctgagagcttcccagcctagattctggtggctgcatctgagagcttcccagcctagattctggtgggattggatctgggagggggaagaccccaaaaagcaaaaaaaaaaaaaaaaaaaagtgtaccagagtctctgcaaagagctgacgtgtccaggagttatctgtttatttgggaaggagggagagagttgacaacccagtttcccataatgaccttgagttaaataggatttggcaatatttgtgggtggtggtgagccttagggtgcaaaggtggcccaaataagcgagggtttttttttttttaaaggcacactaaggctgtaagaatttgaaagctccggacacatctctccttacccacagtgcactgtggcaaactgaggcagggccagtcatggttagggtttctaggcgtaaaggtcttgctttttaattttctttgccctcctagaattccttccacaaaagcattcacaaaccttaaacttattccccttccctccaagggaactaacttctggctagtggtcagccccggctccagtctttgagtttgacatggtgttagcaggagcccctgagaggagaagtggaccgttcatttagaagtatttgtagggaccatccccgcctttggtctggtatccagcaagtggctggacgaaagtcttgggccatgattgcaaaccttgggaggtggggcaacatacgtgggcctaataccacgtcaggaactccaggaccttggctgggagcagtggctcatgcctgtaatcccagcactttgggaggctgaggcaggcggatcacttgaggtcaggagttcgagaccagcctggccaacatggtgactccccatctcgactaaaaatacaaaaaattatccaggcctggtggtaagcgcccgtaatcccagctactcgggaggctgaggcaggagaagtgcttgaacccaggaggtagaggttgcagtgagcctagatcacgccattgcactccagcctgggcgacagagcaaaactctgtctcaaaaacaaacaaacaaacaaaaaaactcaattcccacttccgagaggtagtctgaggggaggtatttcaggaaggtagtatgggaactggcttggagttctgtcttgctgtcagtgaatttacagcatgtgggtagatagccctgttcctacagcacccagccaggaactagcactgtgagtagatttatgaaccccattctccagcacttccattcagcaagtcctgtgtccttcccatccctagccctggggccagcccaagcttataagtcccttgacaccatctctgagagacctagcttagcaaacctacctggggtatctgttcggtgtttggcacagctctgggcctgtaagaaaatgtagcaaagatgaataaagacctagagtgtggccaggtgcttacagtgaaggcacaagtcaccatctgtatgtgcttcctgtggttaccatgaccaattaggacaaacttgacggcttactacaacaaaatgtattctcttgtggttctggaggccagaagtctgaaatcaaggcatcagcagggttctgggttcctctccactcaaaagactacgggaagatccttcgtcatctcttccagctcctggtggctcctgatgctccttggcttatggaagcatggctccagtctctcctttcatcatcccatggccttccttgctgtgtgtgtctacgtcccgtcatctcctttttttttttttgaaacagagttttgctcttattgcccaggctggagtgcaatggcgtgatcttggctcactgcaacctccgcctcccagattcaagcgattctcctgtctcagccttccgagtagctgggattacaggcgtgcgtgccaccatgcccaactcattttgtatttttagtagagatggggtttctccatgttggtcaggctggtctcgaactcccaacctcaggtgatccacctgcctcagcctcccgaagtgctcggattacaggtgtgagccaccgtgcccacccccatcatcttcttataaggacactagttattggattcagggcacacactaaatccaatgtgattgcatctcaagatccttaactagttatagctccaaaaactctctttccaaatgaggtgacattctgaagttctggatgggcgtgaagtttgggagatgctacacagtggaagcacagaggagcagttaatttatagcaggtgctcatgaaaggtttcatgaaggaaggagcattcgactgagccttgaagaaggtcaagtgtttcaaccagaaggggtgtgacaagggaaatctaggtacaagaaaccacctgatcaaaagctctacctggctggaattgcgggagggaagaggaaagggaagcaagaaaacattgtattgtgggatagggaggtaagcagggagtttacacctcagactctgagtcaggtcagtactggtgagaatagaaaaaaagagaaagagaagagaagggtccagacaggtcatctgtgggtccctagagtcatcaggccaaaacagctgcactaaccaatttacagggagagagcagtggcccatctctcccatcctcactctgtgcagcctgaaagcaggcaggtaggctacctgtcctacctgtgacatctggaagtgtttctgcttagagcatcggtcacaactgaccttacaaatgagcctgtctcatgaataaacaaacatctccttcttactcccccaggcccttcccttgggggaacaaaggtgtctacctctgggaccacgcccccctgcagtcttgctcacttgtgcaggaggccagagactgagcttttatttatttatttatttatttattttaaaaatagagacgggagtctccctatgttgcttaggttagtctcgaactcttgggctcaagcaatccttccttcttgaccttccaaagtgctgggattacaggtatgagcttccacacccagccaagactgggttcttgaccctggaaaagttactaccttctccaggttgcagctgagaagcacacctataaaatgagaggggttacaatgatccctaagatcccggcacgctcaaaaattctcgtcttacacatcagtcaacccaagaaagcaacggattgccaggcttccctgaattgcaagcaggagacttccaggtgaagaaagcatttgtccccatcactgatctcagcctttgctagtcatcagatgccaccaaatgaaaaagaagcaactcagagttggaagatgtgctgtgccccagctccgcagagccccacacccattcaaaactccctcaacaggtagctgtctgccatggatttatttcagctcttgcagaagacgttagtatttccaaactgtcgcttctaaaggaataagggacccaaattccctgactagcatgtcaaacaaaatttcctggtttttttcttctaaattcaccaacttttctatttgggctttcaggaatgcctcctccatctagcaatactgactctgagtcaagttcattttcagtgcacccagcccttctgctaattctcatttcgacttcaagctcttctgagcttccatcttttcagatgaagcgcacttgtttatggctgcacagatcccttccaagcccttctgatctctgtatctttgcagttactttctctggttcatttccatcttggtatttgccgaggccgtctgccttgagaaagtgatctcggctgtatttatgaggtgtcctttctaaccaggaagtgtatctggttgtcacaatcgctgtaacaaaagcccttgtcttaacctgccactaccagcgatatcctaccacagttttgagcatcagtgcgggatgggtcccacaccctacacgttctcccttatccttggacaaaagcatgaacacacccagaattttataaggctgtgctcaccgttgtcttcaggagacacaatccaaaaatataagtccataagatacttgaaacatttcaaacatattattcagatgaaccacgaggattacgaaaccattgaagcccattggaaatgagaaaagtgagtctatttagacactagcatgcccaaatgtgtgctcattgctgtggcacccctgaaatgagtgagatcttagaatctgaaaatgagcacatgcctagattctcaacaagaaagtgccgggttagcaaatgaatgaatggttggtgggaactcattcatttattcacttattcatacattcagcacatttactgagcacctactatatgccaggcactgttctgggcactgaaggcatgcagggagcaaagcagatgaaaatccccacccatgtagtgagagctggcattttagtaagagagacagataaaaagcaagatcagtagaacagtacattctcatgcctgtaatcccagcactttaggaggctaaggcaggcggaacacttgaggtcaggagttcaagaccagcttgacccaacatggtgaaaccctccttctctactaataatacaaaaaaaaaaaaaaaattgctgggcatggtagagcgcacttataatcccagctacttgggagtctgaggcacgagaattgcttgaacctgggaggcggaggttgcagtgagcagagatcatgccactgcactccagcctgagcaacagtgggagactctgtctcaaaaaataaataaataaataaaacagaacattgaattgtcattataagcaatgaggagaaaaccaatgaggcaagaaggatgggaatgcgagggcctgagattctaggtagggtataaggaaggccacactgagaaggagacacgaggaaagacctgaaggaggcgagggcatggtgggaagggagcagtagcattccaggaagaggacagggcaagggctctgaggagagagtggagtgtctgaggaccaagaggtggccagtgtggctgaagcagtgagtgagtggggaggaagaactgagggagacaggttcccatgtaggacaggtagacctagctggccccacgactcaagcatcatgccctcacccaagccttagcaggatcccctggctgctgtgacaggcaggtggtggaggtgtcaggccaggggtgggggacctgctaggaggccgccaggtttccatgcctcctccaaaaatatcacccagacttgcttcgccaccttctttgagagcttcccagagctcagggaatgctgtcagcattgcactagagttttggaggatgctgagggcctcctctgatatcttttactgtcaagatggaagtgtctgggctgagggtaatggagaatctaggcagtccggggtgccactgttggagggggtgggaggcagctggcacccagccctcagggctctgctgggcagccctgctcccagccagatcctgatctttcttgctggtaacttaggtgaggaagtgacaaccagcttcagggtgacacggctctgaggaatcgtgactatgttggctctgttcattgattcagcaaactaggccttggagatgcggcagggaacctcataaacaaggttctctccttgtgacacttagtgttcttggagtgaccaccatccccagactgaaaaatctcctaacactgtggaaggatgagttggcaccaacaagcaggcttctaatggcagtagtgcttaacccctctgaataaaatcagataattgtgctggtgcttagaatgaaggagatgcttttcagtcctactttgtcaaacgacttctggggtattgtgtccatgtgggccagcactttgacagggcccttgaccaactggaaggtatccagggagcaggctgggtgacaagggctagaagccatgacttaggttgggtggcaaatccatgggagtatagttgactgcttaagaggcaagagagggtatcagctgcattccagtaccacagaggcatgggacctgttctagatggttctggaggcccatgctaggcccgtggggagggctcgaaaatgcagacctgggccctgcaagaggaacaccttcctgccctttggaacaggttgctctttaagcaaacatggtgtcgagatttctgcactgggggaggttaggttctggacaacctcctaggtcccttctaccctttgattctgtgagtcattgtcatgaagtcagtgagggcaatgacacaggcaggggcaggggcagggggcaggaggaaaagaggacaccagcatcgatcaaccaacacttgaaaattaaaagaaggcagcccttctcagcatgacttcagcaggatcctccagcagtgatgtcattcctttgtccaggctttccagggtgctggggagcagggaggaggcaagagggtgcagggtgggcacagactcacatccttcactcaggcttagattcctgtggcttctgaactggatgctgatggcttccttgcgttcgtagtaatattcatgaccgtggtactctacatgtctgtggtaccatacacgattggtaatatacgtgactgtggtaatatacaaggggacttcaaaaaggtggtggaaaatggaattaaaggatgaaaataaaaaatataggccaggcacagtggctcactcctgtattcccagcactgtgggaggccgaggcgggcagatcacttgacgtcaggagttcgagaccagcctgtccaacaggatgagaccccatctctactaaaaatacaaaaattatctggcatggtggtgcatgcctgggatcccagctactcgggagactgaggcaggagaatcacttgaacctgggaggtggagtttgcagtgagtggagatcgcaccactgcacttcagcctgggcaacagagcaagactgcgtctttctccctctctccatatatacacacacacacacatacacacacacacatatacacaaatatatatattttatttctcaacataaacttcatcaagttacaagacacttttgtaagcgatgataccagccatctagtccatccctaaataactgagggtcctgagagttcagccatgtcaatacagtctttttttttacatcattagctgaagagaaatggatgccctttgtcttagtcctttctcacattgctatagagaaatattagagactgagtaatttataaaggaaagaagtttaattgactcacagttacacatggctgaggaggcctcaggaaacttaccatcatggcagaaggagaaggggaagcaaggcaccttcttcacaaggcagcaggaaggagaatgaacttagaaggaactaccgaacacttataaaaccatcagatcacgtgagagctccctcactatcatgagaacagcatagaggaaactattcccatgatccaattacggccacctcatctctcccttggcagatggggattatggggattataattcaagatgagatttgggtggggacacaatgcttaactgtatcaccctttaaagattttttaagattaagaaacaaaaggaagttagaaacagccaaatcaggactgtaaagtggatgcctaatgatttcccatcaaaaccctcacaaaattgtccttgtttgatgagaggaatgaatgcgaaccttgtcttagtggagcaggaccatctggtgaggctttcctgggtgtttttctgttaaagttttggctaactttctcaaaacactctcattataagcagatattattgttcttgtccctccagaaacttaacaagcaaaatgccttgaacatcccaaaaaaactattgccatgacctttgctcttggtcggtctgcttttgctttgactgggccatgtccacctcttggtagccattgctttgattgtgctttgtcttcaggattgtagtggttaatgcttcatcctctcttacagttctttgaagaaatgcttcaagatcttgatcccacttgtttaaaatttttgttgaaagcagctgggcacggtggctcacacctgtaatcccagcactttgggaggctgaggcgggcggatcacctggtcgggagttcaagaccagcctgaccaacatggagaaaccccatctctactaaaaatacaaaaaaaaaaaattagcttggcatggtggcacatgcctgtaatctcagctactcgggaggctgaggcaggagaatcgcttgaacccgggaggcggaggttgccgtgagccaagatcacgtcattgcactccagcctggacaacaagagtgaaactcggtctcaaaaaaataaataaataaaataaaataaaataaaattttcattgaaagctttgctctcatctgcacctgatctggatgcagtggttttggtgcccatcaagtggaaagtttgttcaactttaatttttcagtcagaattgtgtatgctgaaccaatggagatgtctatggtattggctttttttttttttttttttgctgttaattgtcagtcctcttcagttagagcacaaacaagatgaattttttctttctaatttgatgtggatggtctggcacttcaggctttatcttcaacatcatctcatcccttcttaacaagttatccatttattaactactgctgatttctatttttttttttttttttgagacagagtctcactctgtcgccaggctggagtgcagtgacatgatttcagctcactgcaacctccgcctcctgggttcaagcaattctcctgcctcagcctcccaagtagctgggactacaggcgcacgtcaccatgctggctaatttttgtatttttagtagagacgggatttcaccatgttggccaggatgatctcggtctcttgaccttgtgatccgcctgcctcggcctcccaaagtgctgggattacaggtgtgaggcaccgcacctagccaactgctgatttctttagggcattgtccccataaacttttcataaagtatcagtgatttcaccgttcttccatctaagcaagcttcactgtaaatttgatgtttgttcttgcttcagttttaggagaatttatgttgctctgataggagttcttttcaaactgatgtcttatccttcttagtgcctcaaactagatcccatttagtcatgttataacaagttagttattttggggcaaaaaaaatctcaaatatatgcctagttttttcgtaatacgcattttccttgaactttttgaagaccctttgtacatgattgtggtaaaagcatgaatgtaggaatatacatggcactattactatacatggtactgttaatatacatgggaatatacatggcactattaatatacagggtgctattaatgactatggtactgtacaggacatggtattgtacatgactatggtaatatacaagatagatactgtatatgaccttggtaatatacaagatggatactctacaagaccatattaatatgcaagaatgatactgtacatgaccatggtaatatacaagattgatactgtacataaccgtggtaatatacaagacctatactgtacatgaccatggtaatatacatggctgtggcactgtacatgactgtgacaatgtgtgtgacgatggtaacacacgtgacttggtactctacatgactgcacagtgcttttgcacattcattgtcttccttgaccttttttttttttttttttttgagatggagttttgccagtcgcgcaggctggagtgcagtggcacgatctcggttcattgcaacctccacctcctcccgggttcaaatgattctcctgcctccgcctcccaggttcaagtaattctcctgcctcagcctcccaagtagctgggattacaggcatgcgccaccccagctaatttttgtatttttaatagagatggggtttcaccatgttggccaggatggtctcgatctcttgaccttgtgatccacccgcctcagcctcccaaagtgcggggattacaggcgtgagccaccgcacccggccagcagcatgcatttctgagatccaggtgaagtggccgtcctgggacacgtcgctgagggcagattctgaacccaggtttcccagcttcaacactccatcttttcccactgcaacaaataatctcagcctggcctggcctgcctcattcagggtcatggagaggtcaagagacaagctgttaagtaatggggcttagtacacagagggttctggagagagcggtgataagcagtgaatgagtcaacaggatgcgggcagggatgtagtgaaatccgcttttacacaaacatcatttagagcactgagtagcagtatttgcatacaatgaatgggagacttgccaaaggaataaaatagtcctcagttatcagggtttcttttaaagagtaaactgacaagcagggtaatagcacagttgaatttctttcatttgacaaccagtgtgacatcttaacatgcagagacccagctgcagaggagagagtgagtgacagctccctccagttaagcccgaggtcactgagctctgcgtggcctgagagctttgatcactgtaaattaaggaaaatcttagaagacttctcgaaggaggtggcaactgagggggttgcaggaactctccatttttctgctggttgtagagcccttcaagggtctgaagaaaatatgaactctatcccaggaagaaggtgcaactgaaagttttgtacttttaaggggtcatgtacccctgtcgcctatcccagactctgggttaagaaggcttggactagatacaatcaaaacccatccaagtcctacaggctcagatgcaggctcagggcgagagctcgtgtgagaggcagggaacgccctggtatcctgtgacactgaagccagggcaagctcagggtggagagtacagatgtgtggcttggtgcttaaggccaccaatggtcagcctggtgaaggccactgggccccagcctttcttacctcattggccatccctacttcaaggaatgtggccttaaatcctcttttcagcagcctttcggggattttgatgagtgaagcgtatgatgatcttgtccacactgaaacagcctcctagggaacacggtctcctgtctgcgtcccacctcccccaaccacttctaccagcctccaagccccgcggtccccatgcggacctcagcgccagctgaggttcaaggtccaggttttcaaactgggttccggagcaccctagaggccccaagaaggtagggccacgtgggagatggagcagggagggttctgagggacccctccttcctgcggaccagatcagtgttgtcacttctgttttgtggcttacaattccatgttaagattttggtgtgcattttgaaagaaagtcattgttttaaagaaaggaaaaaaataaggcttgaaaatgatgcttcaaggaaatgactcagcctgctccctctcctcgatggacccttcttggatttgctggatgtcccctctttaatgacacctccacctttggctctttactccaaggtgctgtggcttctggaccaaatgccctctagttcgcttgggcttttgcccctcaggagagggacccacactcccaccccagatgtgtggaacccctcctgccctcagcctcggcacctcctctacctctggggtgcccacaagctagaagctctgaatgcccaagcggggctgagacagcctctccaagggggactcagcccaaatccatctgccagaaaggacacaggaggcttctccctggccctccctgcctccaaagcacccatccctgggagagtgtgccttgacaaccccagccccaaagcccagacctggcccaaaggcagtgtcacagcagccaaaatcttttgggcggtagaggccggctccggccagagcactcatgcaatttgtggtgccggccagggctgctggaaaccagtgcctaatgctgtagattatgaggggcctcccagtgacctgctgtgtgaccttgggcgagcaaccctctctgggctttggttccctcatctgaaaaatgaaggtgtggaaatgtagtgaaaaagctcctatcacctcctgggtaatggcaagagcgtttccaagagacaaccactccttccaggtggggcaatggccctgggggtggggggcggtggataccccctgctccagcccttctccttctgcatattagagcagatgctcagcaggacatcagagaaaaaaggcaaaaaacccactggcctgactcaaccttggttctgggactcccccgggaagcagagagttgtgcccctgccacagaagccctcagggggaattggagactttgaccctttctagaagtctgtgggagggaaccactccctacagggagtctggccatctcccttccacccgaggcctcacctctgttgagatgacccgtggcacagcccctgtcttcccaggcaggggctggtccaacataggcctttctgcaacccaggggctgaggctggtcaggggtacagcctcctctctggtcctggctgcccaacccccacaaccatccaacttcccctgcacaaggcattttgatctctgcgtccaagtagctcaattggtcaggaccgggctgcggtgaggccaaagtcaggggttaccatagcaactcaccacgctttgtggctgcttgttgatatccacaggggcagggggcatgccctctcactcaccaagtatctggcaactggcacagtatctggcccacagtagatacttaataaatggttgttgcctaaatgaatgcatgaccgacccattgtagctagttagagccagtgattactgagcacctactgtgtgccagggactgttctaagccctgacacgtcacaaggtcatttactactcgaagtaaccttccagcgtgggtaccgttatcatcttcttcttaccaacaggactctgagagtcagtaacttagaatcacacagctagtaaatgacccagcaggattggaacccagggtgtctgcttgtaaccaatgagtcttgccttttggttgatagtttcacggaagagatggcattgatggcccctagtggagtccgtagccaggcagtctatatgggtcaaacaacatcacctccagctttcccgatgggggctctggaggtgttcctcagattggtttattgactcatgggaccagaagtccctgggtagggctgactttgggcatgtctccaggggctcagtgctgtcaggactcaggagagtttctctctcccctcactttgaggcagacctctctgccacggggctgctcacacctgccccctgctgctcgtaacgtaacctttccagctcccattcaagtagacagacaggtgttctttgcccagaagtcctggaagggtccaggaattgggtctctctggcagtgactgggtgagcctgaaccaaggaaatggtgctctatttggccagctgtgggtcatggccagactctgagccaggggtataccagccccagccaagccatagggtttgggagtcgggaggtcggcttctgcagggcagatggggggataccatgagcaggagcaaggggtccagtacaccttcttgtggaaggacaacactcatcttccagtcatgccacgtggaaacagccaggagagccaggcctgcctgtatcaggcagccctccagagctaatcctgcagaccttatcaggtcatttactgatgccttaccaccgcgccccccaaccccccacccatctccccaagaaaaaaaagatagaatggacttttcagggttgaactaaaatctctgccttcaaggagattgtagttcaaagaggcaaaatgctcagccaccaaagtccagcaggttgtcaacagactgactttggaaacttttctagacgatagatagagagatagactgtgatatgagaggaaaggaagccctttgctaggtcatggttgctagtgatacttcacaggtgcgagaggccagctctccctcccctccagctgcgggcaggggagcagaacagagatgatattgggtccttccaaggtggttggtgaggggggtcttccttttagtgctcccacagcccagcaagcagtggcccctctcacaggcctggtagcaggtcaccgtggggagctggggccagtgtgactgtaaagggcagcgtgaccttcatgcaggcaggcagtcctgccagacacacccacatggcgtctgtccacccttggctgcacggcccatgttcttacatctcagatgccaaagaattaagagtctgacctggcctctccgggccacttccctatgagcacacagcagaggagacggggtccttaagggatggcaagacacaaggtcagtgtggactgggcacatggtgccctccgagggctcacacctcctcagccagcagatccatgccttggctttggggatatctcctgagccttcaagtcagtggaaatgtttgtgtgagtgtgtgtgtgtgtgtgtacgtgtacacacacacacacacagatgtgcggttctttctttcacaaggagccagtaaagcatagagattcagattttgagttcaggagtcaaccacaccaaagttcatatgctggctcttctattcacttgccgtgtgaccttgagcaagttactggacctctctgagcctacatgccttggtagggtggaccatggctgaaggcagctgcaagcacagacgggggcttccaaccagtctttgttgttaataaagtgctacccacgtgttaaacaatttacatgacaatctgatttactcctcagagcaaccctatgacacagtcactgttcccagtttaaagatggaaatactagggctcagagacgttaaatacttgcccaaggtcacacagcccaggtagccatgggattcgaatccaggcagtctggcttctaggaaaggaaacctggctgtgcctaggactggggtctaagctgaggcgttaaggatgagatggaagcagcagaaggaaaatatcccaggcagagggaaagagcagagctagaaaataggagatgagagagtttgtttcctttgggaaaaagaccctggcctggccagaacaaaagtgtgagcagggagtggagagagatggccagggccatacctcatagagcctggtggttgtggggtgaagtctggacatgattgggagagcactagggagccactgaaggctttctacaggatgcacgaccagcccacattactggaaggtgacggaagcctgattttccacagaattctctgatgttggagggatgtgatgctctctgaggaccacggaaaatcactttctgtggggctggtgcttgggaaaattcccgcctcaactggccctttgggccaagggcctggcttttctcccagcatcctggtctttgcagggtgtgctggcctggccatttcccattgaatgtcccgcttcctctgaatcccctggccctctgggcccagagccacagcctgatagcatgagaccagtcagccggaagggttaactccaaggcagttgaccttcgtcctagcagagattaaaccgattcctaattaatagcctgtaggatagctaccttggcacagcttgcaagtaatttaaggcttgtccttagaggctggtccataaattacgtttaattagctgaaggtctccctgggacacatcagcctggtgtgtgattgagcctaccagctcagtgacctctgaatttcatgttggagtatgagggagatgctgagatactccagtaaaatgtttatttccttttccaaaacaagagctgaattctttcttctgctagcagctctgaggggtaccgccaaccggtttgggggtctctgctcagctagttcctggctttgctcttgactaattacttatatttccagggtctcagtgccttgtctctaaaaagaagccgagttcaagtctacagacccttatctgaaacccttaaggctagctgtgtctcataggtctgatgttttggactttagaaatgcaatccagcagataggccatatacctagtgatgcccacagcaaggtctagggcagccacccgtaatcacagtgatagttaccacagtgggataaagagaccagaactagcctcatgatggttccaattagggcttgctctaaacgcgtgtgtcaaaaataaatgtaggattttagagctttttggattctagaacggaggataaggggccgtaaacctcactgttgaactcagagaagctcctaaataaatgctaattatgatgagtactgttgttattttttttgttttattttacttgccgagacagagtctcactccatcactcaggctggagtgcattggtgcgatctcaggttattgcagcctcaacctcccaggctcacgtgatcctccccagtggccgggactacaggcgcgcaccaccatgcctggctaacttttgtatttttagtggagacaggctttcaccatgttgcccaggttacctgttgttattattcctctttcccctacagctcatacgctgccatgtccactgcccctgcacatgtagagactggatgtgcaggcaacttttagtttggcaggtgtcacctgtctgctggggatgtgtgatacgttctccctggagtggctctgccagagctgtgtttgtgtttcctgctgcctgggggagcgtggaaggcttgtgacttggcacgaggtcccactgggtgttcctgttgggcaccctctgtgcgatggctggggctggcttcctgggtgtgacccagggattctcactggccctgctctcagaagcgccctacacttggtttgaggctcggctgtcaccatcttgcagttctttacaatttttgaaccagggaccctgcgaatgatgtggctggtcctaacgacagccatagcacacaggttgtcaacttcattcctcccaagttcccctcaaagggaagttactaatgtttcacagaagaggcaaaactatttcattcattcattcacacagtcactgggcacccaattaccaagccaggcctggaaattccttggagagcctacattctagagagtgtgtgtgtttgagaatgggagaaatagacaaaaaccaagcaaacaaataaccaccatcacttcagatagtgaccaagtgctgcaaagacaagaaagcagagggatgtgaggcagaaggatgttaaagattaaattcagtgaaggagaagctggaatcagggctggagttcagctgtgccttgttgcactccatgagtactcgctaaagatctggggtcatttcaggccgggcgccatggctcacgcctgtaatcccaacactttggaaggctgaggtgggtggaccagttgaggtcaggagttcgagaccagcctggccaagatggtgaaaccctgtctctactaaaaatacaaaaattagccaggtgcggtggtgggcgcctgtaatcccaggcactcgagaggctgaggcaggagaatcgcttgaacccgggaggcggaggttgcagtgagccgagatcgcgccactgcactccagcctgggtgacagagtgagactccgtctagggcggggggagatctggggtcatttctaggttccccaccccccacaaggcagggtgatcattagttaatgaggtccaagtaggggagtcaatgggggtctccttgagccaggggggactattcatccccaaagacctcgtcaccccggcttctcacaataaacccagaggctcagtttgggggggcagtgggtgaggagaagggcagccttggtttctctgagggtctccaagttctccccgtgccaggccccctgcacctgaggcttctgaccggccctgcggtttggtgagcattttcttgcacttttgaccttccccacaccagcacagggaggccagtttcagttttccccacttccccagatggagatggtgaagctcagagatgccaagtgactcatccaaaagtcacacagcaaatcaactccagagcagattccttgaggccccaaccaggctgcttttcattccaaagggcagtgcaggctctcagctctgagcgctggctgccaagttagtgcggtccagggctgctctgggagctccgcgggataaacaggccccctgcttcggaagggaggggcggtgcgcggccaacgggacacttttatacctctttatacctggaagccatccctgcaaccccccaaccaggctttgcaagggagaagtaatgagcttcccagaaagcccagagcaaaggcaggcacctccccaatctcttcccacgaaaacccgaagctgaccccggaggcccagccctcgggtttagaggcttctcggggaagcggagacagagaccctagaggagaggctgcccccggaggggtgggagctgccagcccccaggggtgctcgaggggagcgaggccgctccagggaggtgggtgcccgccagaggggcggcgagggctgccgggacggttcacgcagcggccagcagactggctgcgtgttgcaatgtctggtggcgtttgcagcatcctgtccgtgtgtgcagctggggtaacctcgggccggcggaggagcgcgtgtggctcgtaggccctgcggccggaggctgctggcaccttgcatctcatttacagctccgggttcagccacaggtcagcggcgcccgtgacatcacggcgtctgtttaccgacgggtctgggcaagagcggacggtcccggggcgggagggggaccccagcagcgccccggcccccagcccggctcccctcctcaccccctccgcccagcccctcctcgtctgcacctgagacctcaacccagcccccttctgcagccacctaccctgtcccctccccagctgcacccgggatcccaacccagctcctctccacagcccccagcctgtcccatcgccccccatctgtaccctgaccgcacctcggccttccttcgccgcccggcccaggaccccaacctgtttccccgctttccccgcaaagccctccctatctgctcccgggacaccacctggccccctcctcacccgctccacccagtcgccctccagtctgcacccaggaccccagcctcgccccgccccctccccatctatctcccgccccttcccatcccctttccacccctttcccatccgccgcttgggatcccagcccgatccccacccggcactgcagccccgcccagcccctcccgggacccccgcggccccgccccgcgcccgcccctgggcccactttcagaaagacttcctggagcctcctgcccgacccgctgaggcttggcggctcctcctgccaccccctcacgccatcatgtgagccaggctggcctcccggccgcgcaccgagccggctgcagctcgttagctgtcagggccagggttgggacggcccgggcactttgttattggaaactgggctcacccccgctgcgctaggtgggtcccaggcgctggggcagcctcttcccccggagctgcctttgccacctggaactgctttctcgctcaccgcctcccctcccctccctctgcgtaaaccaattgttctggaagctgaagggacctgggattctcttcctgcacacctggggcttgccagagccaaccctcctggagagggaggcgctggggctcagggaacggcaacctcattcttccattttctcaggccaaacgctctggtgtcctctgggaagctcactttctccagcacccagctctgcaaccgtccagaatccctcttctcccatcacctaagcatcccagcccagccccttccagcttcatgtcagaggctgtcttttttctccttacaacctcccaatctaccccatctcagaaaagaattcaaagtcctgctgtggctggtgtctcccgcttgctcttccacactggtctccgtgctggggaagctcattcccaccccagggcctttgcaccaactgttccctccaccagggatgctcttcctccacgcgtctgtatcgctccctccttcacttccctcaggtctcttccaaaatgttactttaaccaagaggacttccctgcacctttcccccaccatctgaataccactcccaccccataatcactccctccaaccccctacaaagctatgtgttcctcccatgcacatctagcactttctagtggctagaaaactacttactatacagtcattcgttcacgtgaacaagtgttcatgctcattgtccccggacttacacacaagcaaactccgcaagtgagataaatgtattccccgctggatcccagggcctccaaagtgcctggtgcacacaattccacaaatagtccttgaatgaatgaatgaggcaggacagggttgttaaaagagcttccctttggagtccgagccttgctttgaaacttctagtagtgcagcctgcatgagttacttagactgtccaaatttgaatcccaccccggtggacagtaatctggagatgtgtgctgtgagggaagggtggtctgtagatgctggctcctccctcctctccttggcacccccaccccaaggtcacccagcactttccagcaagaggtccagtgggggaaaagggcaaaggttgtgaggtgtcagccatgaactctagcctgagtttctctgcctccgtgttttgccaagtgcggccctgggcagtcagatggaggtggagcccctggccagtcttgtaggctggggatgtttgtgaaaagaaacatcagcccgtgggtttctggctgggagtgagcagtgttctgcctgcccagagtcagcttttgtgatcgtttccctggagagttttctgagtggtcccagaaccaaaaagtttcgcaagaatcacacccagggatgaggtggagactgcccagttgtcacgtactggctcttggcagggcgtggttttagcatttgaaggagtgtcctcaggaacactaggtgctcatcacagggggagacatgcctgtctcagcaactgggaaggaggaaatcaaagaagggtagatttgtaaatcaaatcagagctggtgtttgtggggttggggcattttacatgaagacctcttgggtaaagagacacttgagcagaacctgtgagaaggtggccaggtgtggtacctcactcctgtaatcccagcactttgggagactgaggcaggaggatcacttgaagccaggagttcaagaccagcctgggcaacaatgtgatacccccgtctctacaaataataataatcataataattttttaaaaagaaaagagggtgccctacaaggagagggatacttgggaaaagagaacagagagcagccagtacaaaggccctaaggtagagggggccagtgcttctgcagggccgagacctaggagggagtagctgagacgagggatggggcagaccaggaagggcctgcgatcctagtaaacactagattccagtctgtgagatgggcagccatcagtagtcataagcagggtgatgtggtctgacacattctagaaggatctctggctgttgtgttgagaacagactgaggcaggggccctggggcaaaggtagcagccaagtgaccttttgggaccaggtgaggggtccacttgtgctccaggtgaagggcgctgaggcagggccccaaggcgccgtggaggtggcgagaagtggtgagaagcctctggatttcagaggtcaggctgacagggtgcgtggtggagtgggcatacagtgagagaaaacacttaatgtgggacagtgaagaggcttcggaggttaaaaagagcttggcatctgaaaacagggagtggtgtggaggggaagcagcctccgtcacctcccagcctcgggagcctggggctgggcctcgcttggcctcctctattgaatgaggataatggagcccatttgtgttagtttcctgtcaatggcacaacaaatgaccaccagctgtgtggcccaaaacaccaaagctgctctcacatttctgggtaccagaagtccaaactccaggtgtcagcagggccccactccctcccgggctctagggaaggatccttccttgtctctttcagctcctggtggctcttggcagctcctggcatcgcgtggcttgtggccgcctcactgccgtctctgcttccatcttcacgcggccttcctctcctctgtgtatgtctttcttctgtctctcatgaggacactagtccttagactcagagcccaccctaacccagggtgatctcactttgagatccccaactcaattacagctactcaattccaaagaccctctttcagcataaggtcacattcacaggtaccaagggttaggacttggactcagcttctcaggggacactaatcagccgactgtaccacatccgggcagccgagaggattcagtctaagagcccagagcaggatccagcctgcagtaaaggtccacagattgttcactgtggtggcggtgagtgcttgtcacagtcccaccccgcccacttggagagcaagggtgctccaggcaaaccccataccccctcacagcaaacaccagccctgggcactgtgctgacccatgctcagaacagcttctgtcctcacctgtcctcccacctgagccccatcagagccccagtgtcctcgcagaggggcaaggaacatctctgccatgcctttcataaccacttggtcatcaagaccgaatgatgaccgcacctttccctcattccctgggaggtggacacctttctgtccagtccttggacatggcatcagctcactgtacctgtgcactgaatgaatatgttgtttcgtggggtcattttgctcccgcaggtaaagtcagtggccaagggcacagattgcataagttgaggtcccagctctaccgcttaccgcttggaattacatagccccttcgtgtatcagttttctcgggtatgagcccttctgagctgacagaggactagacgccccacggcacccatgctgaggcagtgtggccagctagtgagccccacgtgcatgtcagagctactgtcattcctgtgcctcccaagcgggccagttccaggctggacgtccgcctggaggaagtctctgccctgctccaggttgcggtcagggacttgtgggagggcgacaccactggttgatctaatttgaggagcttcatcacaatcctccccaacagctgagccagcggtagccaaaacattctcggcaggccaaaacaggggcctggagccagggaaagcctgttttgcagggctacgtgggagagacctgcctaggcttcagcagcccagcagtgcaggaacaggaaggacacataaggacctagccgaagtccctgacaggcccagtggcttctgtcacctctgacctcctggggtcagccgtggggcacctgtaacgacctagggctacaccaataaatgctagctgttactatttttattagtacagcaacagatatagatcccccttgctgatggaagatccagaaccctgctggggtaatggttgcctggaaaacccgaagctctatgtctgtctcctcccctagaaacagccttgagtgggacaaaaccacagaatcgcacgatctctctgtccccatccttttacctgacagcatgcagactggattgtgtagagtctggaaaacaggcctcccagaaaaaaaggtggaagggattagaaagtctgggaaggagatgctggaagtcggtacctgatcattgtggatcagttttgatcagtgtgatcagtgtggatctgcactggaagcagaagggctggtaggcttgttgggtgtgcccgagtgacaggccagcactctcaatgggtgacagctagagggatcccactggagtccattcggagaaagcaggcttccttccagggctgtgctggggaggaagaggctgcggattcagagtcacattccaactattttttttttttagcgacagagtctttgtagaaatgactattctaggtcgggcacggtggctcacgcctgtaatcccagcactttgggaggccgaggcaggtggatcacctgaggtcaggagttcgagaccagcttggccaacatggagaaaccccgtctctactaaaattacaaaattagccgggcgtggtggcgcatgcctgtaatcccagctactcgggaggctgaggcaggagaattgctggaacccaggaggtgaaggtttcagtgagccaagatcacgccactgcactccagtctgggcaacaagagtgaaacatcatctcaaagcaaaagaaatgactactctagaaacctaaagtgtcaccactctgggtgactggggcaggagtgaggagaagcctggaatgatatctgcttgctccccaccccaccctcagcacctccagaggctcctcaccagaacccccagagttccttggggctctgcttgaaaacctctcctccctaagaaatccccccgcagcttgctctgcaggtggacagttttgacagctggtctctaccttctcaggcttggggacgtagaaaaaggagagccttctaagtaaggtggaaggatggaatcaagaaatagcaagattctgtggttttgccccagtcaaggctgtgcctagggtagtcagatggaggtggagaccagatggggtcttccgggcaactgtttccccaacagggtatgtggatcttctactgcaaagggggatctatttctgttgctgtgctaataataataataataataataataatgacagctagctttttacaaaacagagacagagtcttgctatgttgcccaggctgatcttgaactcctggcctcaagtaattcccccacctcggcctcccaaagtgctgggaatataggcgtgagccaacatatccagcccacagctggcatttattgtgccctttcttaatcctcccaactactcttcaaagtgggtgttttaggctgggcacggtggctcacacctgtaattcaccatgttggtgaattatggtgaaaccccatctcaactaaaaatacaaaaattagctgggtgtggtggtgcacacctgtgatcccagctacttgggaggctgaggcaggagaatcgctcaaacccaggaagcagaggaggcagtgagccgagatcgcgccactgcactccagcctagcccacagagcaagcctccatctcaaaaaaaaaaaaaaaagaaaaagaaaagaaaagaaaaagagtggatgttttaaaccttaattcatagaggttaagatcatattaattcataactgttaaagaattgaacccaggcagtctggctccagagcccatgttctaagctgctctactcgagaaagggtctctccttttggaaatagacagggttgtgaaagggggaaattctagtagtaacctatgccacgctcacactcaccctctgctatctagcaccccattctaaccttaatgtcttaaaagctagatgttgcttgcctgctcattctcatctgaccacagggatggatttttattaacagcctcctactggaggggccaggagcagagagctgtgcaccctccacgctgtgaccttcccaccccaccgcccagcctgctgtggtttggggtctctggcgggtattttctttccctctgagaagccaagtcagcaccgatccagctccaaaacatggggcccatgggacatgagctggcctgccaaagacctgcccagggtctcagatctttccggggctgccaattataaacagatgctcctcctgggacgcacccagagaccacccagctcatgtcgccggtgggagggtgcgctgcagctgaactccaggaatgaaagccaagtccagcattagtgcaagcccctctgggctaggaaggcaaggctgggtagagaaggggcactcggtatcctcctggggctggtgtcttgtgatgatgttagctgagcttttactcttgtgcctggcccatgctggatgctggggttacgagatgaataagattccctggaggaccttgcacgctcatgggagaggcaggggtgttcaccagtcagcatgctcacatctgtgcactagtggaggttgaaaaaagactagtgttagcagtgaggaatgggtatcctgagtcaggcagatctgctcttatgagctgcatgaccttgggtgagtcactgtctgtctgcggcttacctattaaatgcagaaggtaaacatacccacctcgaggggttgtgaggattaaagaagaaaacatatccatgtactcagcacagtgtctggcccatggcaactgctcaacagatttagccattatatagtggtggtgctgttgttgtggggaggctggaaggagcagccagggaggcttcagaactgagggagcattcaagtagggttttgcaggttgaataggagtccataagtagccctggcatttgaaacagagaaaaacagcccgggccgggcaccaggtagggacacaggagaaacctgaatttgagagatttagtccctgtcctctaagagacaggatatagaccccaaatggccgtgacagcacatgcagggccaagagcactgtgtaatgagtgagtggaaactgggagctgtggatccccggcaggctccctccctcactcactcaacaacaggaagagagatgtgaatagacagtcacttgccaatggatgagggcccccgaagagcaccactcgggggctgggggacaaggggttggacccaaagggctgagtgacattacctgtgtgtaaagaatctatttggagagtgatccatggggaagcttttactctaccttctgttgttttttgttttgttttgttttgttttttggtttttgtttttttgagaccggctctctctctgtcatccaggctggagtgcagtggtgagatcttggctcactgcagcctctgtcccctgggctcaagcaatcctcccacctcagcctcctaagccaccacacccagccccaccttctatttttaagatcataaataacaatacttgttctttagagatattttttgcttatacaaatataaagaagcaaacgacagtcagctgtgatcctgcctgagacacccatctctgtgtagcctgttgacttccagtgacctggtggcttatgcctgtaatcccagcactttgggaggctgaggtgggagaatcacttgagccccaggagcttgagaccagcctgggaaacatggcaaaaccccatctctacaaaaaatataaaaattagccaggagtagtggcttgcacctctggtcccagctacttgggaggctgaggtgggaggatcacctgagcccaggaaatggaggctgcagtgagtcatgattgcgccactgcactccggcctgggcaacagagtgagactctgtctcaaaaaaaaaaaaaaaaaaagtttagagttgagattatcttattcaaatagtgctgcaccccttttgtctgaacattagactcctgagcatttttccatgtcgtgtcacttatcattttaaagcctgcagaagagggtgtatcagaggcagtgaagagggtgtatcagaggcagtgaagagggtgtatcagaggcagtgctatgattttctcagcttttcctccccacgggaaataccaacagggagtgggtactgagcagttagttagtgggtgccagcttctgccagcttaatccccacaggaccccttgaagagaggagatgtgctttctttctcttacaggacagtgagtggtggtgcaatccccacagcctgtggagctggacatgaccttggttcaaatcccagctccattattcagttgctgtgtgacctcagacgagttgcttagcctctctgaactgcagtttccttatctttaaaattatgatatggctaccttgtcaattccccgatgcaaatgaggttttcttgtttattctttatcccacttactgtcatttgtgactgactgttttctggttccttctctgtcttcccccactggaatgtgggttccttgaagtaggattacatctgcttcattctctgttggatcaccaccccagcccatagccggctgtccgtgtggtgctggatggacggggctgttgtggacattggaggagacgaagcaggagaaggctggctgggtggggatgaacgcggggcgtggggttgcatgtgaggagagtggaaccctcaaagctcagacgaccccaccgtgcctgggggcttaggggtgcctctgcaaagggccaaggctctgggttcaaatcctgtttcacagtgggtggcgtggggtgagttacttaactcctttgagctacggttttctccactgtgaccacggataatgacagccttcagcgcagagggctgctgaggaatctgtctggctatagccgccttgagagcagctctgggcaagggcaggacagcccggggccccggagaccagaggtctttctccccttcctgcctccccctaccagtcactgggagagagaaggggacagaagctcaccatttgccccagatgggagggaagaggaggagaggccttggaggtgttgagccaccccagcccttattctataaaccctgcttaagagtaaattccaggcctctggccttcccagctgctgcctgtcccgagttcactaagaggcagccgcactggttccaagggctcagaaatcagtcccctctgcaggcccccaacccacataccctcagacgcccgcctccgcccgcccagtcctcatgctcatgatggccttgggtgggacccttgtcctgtcagctgtgcaggtcacctccagggaattctggcaggagccacctgggcgggcctgcagagcggtatctgccagttacctggtcagtgacgcagattccccagaagggtcagggtaggaggctggagggggaagaggagccaggaagggacagtggctggggcagctccacagggcagcacctaccagggaaagggacccattccctccactcagctcactcaggcgccagcccagcacttcagagacgctaccggttcctaagatggaaggtgcccagccgcgcttccctgcgactcccagcatccaccaaggacctgaggaaacacaacagcacacatggctacacactcactcacacacacacagtcacacacagacacacactcacacagagacacagacacacactcacacagagacacagacacacagagacacatagagacacacagacacatacactcacatagagagacacacacagacacagagagacacacactcagagacacagagacacacactcacatagacacacacacacagagatacacagacacacacacacacagaaacatacactcagacacccacagacacacagagacacactgagacacacacacactctctctcacacagagacacccagacacatacattcacacagagagacacccacagacacacacacacatactcacagagacacacactcagacacacagagacacacacacacacagagatgcacacagacacacacccacagacacatacactcatacagacacccacagacacacggagagacagacacactgacacactcacagatacactcatagagacccacacagacacacacacacacacacttacagagacatactacagaaacccagttacaaaaacacacagagcctggcacagggatgctcagcagggcatgcgcacagcagccagagcctcacctccgtctgagaccgaagccttgccctgtgaaagctgctcctcacccaaggcccggccaggaaggtgctgatgctctggggcgcccaggtagacttgagtggaaggttctggggccctaaatggcttagccaaggggatgggtggtctctcctcttacagaagttaaaacacctcccttccccgtccacctgtgtacctgaactgtcattcattcattcattcattcaacaaacagaatgtgctatgctgggcactgggatgtgaacgggatagaattggggcctggggggtgggggggtgaggaggcagaaaggcaaacctatcatggtgccagggagaggtgaggccggttccccagcccgcctggggcaccctcaacagacccttgaaaggaaacagccaagtgttagggccctgcctggggggcttcctggcccacggaagacagtgggagacagccttcattccttctccctcagccctgctccacttcctctccagggtggtcttccagctaggtcaacagtgctggggtgaccacttgtctccacggacatctgaaccctataccttcctgcaagcccccagctttaagctttcctctctgtcaatttgcccagcaattcttagggcccccagaggcacctctccctacctcagccagaccccaggggactgtgcaagccccatggtcctgttacacataggagccagaggtaggatggggttaggcagggaccagaacagaagaatggaaaccaatgattacctaccccttgggctgacatactcagaaaccagatggatggatgggtgcagtggggctgatgggtgggtgggtgggtgggtggatgaatggatagatgaatggaattgggcaggtgagtaaatggatggatggatgcatgaatgcatggatggatgaagtggagtaggtgagtggatggttggatagatggagtagggtagatgagggatgggtggggggatggatggatgcatggatggatggacagatggagtggagtgggtgagtgcatggatggatgcatgaatggatggagtagggtaggtgagtggatgaatgggtggatggatggatggacagatgaatggatggatggatggagtggggtatgtgagggagggatggatggatggatggatggatggatggatggatggataagtaggtgagtggatggatgggtggatggatgggtggatggagtggggtgggtgagggatggatgggtggatggatggatggatggatggataagtaggtgagtggatgggtggatggatggatggataagtaggtgagtggatggatggatggatggatggataagtaggtgagtggatggatggatggatggatggggtggggtgggtgaggaatggatgggtgggtggatggatggatggatggatggatggatgaatggagtagggtaggtgagtggatagactaatggaatggggtaagtgaggggatgggtagatggagttgggtaggtgagtgggtacagtggggtaggtgagggatggatagatggatggatgggtggagaagcaggtgagtggatggatggatggagtggggtgggtgagtggatggatggagtagggtaggtgtgtggatgaatgcatggatggatggatggagtgggataggtgagtggacagattaatggaatggggtaggtgagtggatgagtggatggagttgggtaggtgagtgggtacagtgggtacagtggggtaggtgagggatggatagatggatggatgggtggagaagtaggtgagtggatggatggatggagtggggtgggtaagtggatggatggatgcatggatggatggagtagggtagatgagggagggatggatggatggatggatggatggatggatggatggatggagttgggtagacgagggagggatggatggatgaagtgtggtggatagatggatggactggtgaacgggagagtggacggatggacagatagatggatgggtggctgtatacacaggatgataagggaggaataaaggaacctggatgacaatggctgcaaggcaaggcggggggtggtccagaggagtggaggaggcctacaccaaattgcctgcctggaacaaatgtttgtcttttttcttttccatgaactgaacctcccagcttctcctggaggaacacattctgtttttagttcaacagacaagaaagtgtcccttggagcctgtttaattgcagtccatctgcctttgaaggacttgtaccgtcattgagaggaactgacgggacccacttgttaagcccttcctgtatttcaagaccttaattaaaataaagtggctagactaagtggggttttcaaactgggctttagagaacacttatttttttgtaaaatattttgaaagcttttaaaactctaatttaaaaaatcgattccattggagaataccggaatttctgagagccgccagctaggcctgttttgtgccctctctgcttaagtgacagtcttgagatttcaaggtgagcagcggataaacggttaccattagcaactccttatcaatgtgacttttctctataccgtgtaacaaagcaaaatagagaaatcagttggatctgggtctgatgtcatcggagccgccatctgtaacccccagtttaaaatgtttaccttcccaaagcagccattttgttctcattagcaacctttagagtaagaaaatattatggagtcaggtgttttattccttttctaggtttcacgcgttggggtttccacgttggatattttttaagggggaatttcactgatagtcttaaataaaagagaaaagaaacaaaaatagaagcccaccggacgaattcccaaaaccctttcggctcttcctgtctctgcttctgacctctgggcggtgttcagccccctgcctttctccctctgtgctggtgaagctggttcttagttagggctcttggtccccctgtcatccgactccaggccctcttaccaacagaggcctcactgaccccagtgacacatcgtggggaggtgcgtcgtcctccgttaggtcaaggttaagaattagccaggcttctcttctgagccttttatgggctggccattcataaatttgcccaaaccctcagtggtcctgccaaggtcaccttctggcgtaatgagtccatgtttgttacctgccgggtgaggccatgcttccttctcagtggcagcctcgtcactgcccttccagaatatccttaggggagtgactgcagctagatgggaggctcggcttagctcctgtgaaccttgaggctggaatggtcccatctatgctaccagctggtcttaataatcctggctctagacctaatcggtgaagccagctgattcctaatggagagcattctggagcattgtgcataaagagctctgctgttgcctctacatttacaggaaatgaactgcactggcaggaggcagcctgctaaaagtaatatacaagaaaaacttgtaaatacacatcaattgattgatcataagtgggctcagaaactactggttcacttaaaagtagatcatatccctttaaaaagttatattgttggctgggggcagtggctcatacctgtaatcccagcacttgagaggccgaggtgggaggattgcttgaacccaggagttcaagaccagcctgggcaacataagaatacccctactctacaaaattttttttaaaaaaattagctaggtatggtagcatgcacctgtggtcccagccactccggaggctgggatgggaggatctcttgagcccaggagtttgaggctgcagtgagctatgatcgcactgctgcgttctagcctgggcaacagaagaagatcctgcctcaaaaaaaacaaaagttatattattaatctatgttgtattctttatctttgggtggaaccagggaggccagtcatttcaagacaaatgactttaaatcctgaatttctggtggcaattgttgcatcactgtggcttaatgaccatttgttctgcgttgttattatcttcttccagattgttctctggggccggactgagaaatgcctgaaggagacgacggaggagatccggcagatgggcactgagtgccattacttcatctgtgatgtgggcaaccgggaggaggtgtaccagacggccaaggccgtccgggagaaggtctgtagcctgggagggtctattcctagcacagctgaccacaggctaattccgggcaaagagaacattctcatgtggcctggaagagagctctgcttatggcagaatggctttgcccggggcacctttggggactctcccatgaagctggccccagttacataggcagggattagggttgattacgtaacaggcgtaatcatctgttgttcccttggaaatgtagaccgtgtgggtttctctccaggactgtggcggggcaaatgtcccattggcctctgggaaaatccttctgactccagtcatctgtttgggctaaatatatcagtgacctccaagagagggaaacccaccctgactgtctggcacgtggtaatgttaactgtttttatgtcgcagtaaactcatttattataaatatgccgtgtgccaggtacggtgtgtgccataaattatttctcctcctcagaacagtcctggtgcggcattagccccatctcacaaatcaagactggcgctcagagacgcagttctcttccccaggccctgtggctgctggtggtacggccaggtggctgctgggcctctatgtatgcaggataactggaactaggctggcagaaagtggcctgcgggaaggaatatctaagaaaaacttgtaaataacacatcaattgattgatcataaatggactcagaaattactcgttcacttaggagtaagccatatcccttttaaaaagtatattggaccgggtgcggtggctcacacctgtaatcccagcattttgggagaccgaggcaggcgggtcacttgaggtcagaacaagattagcctggccaacatggtgaaaccccatctctactaaaaatataaaaattagccaggcatggtggcaggagcctgtaatcccagctacttgggaggctgaggcatgagaatcgcttgaacccgggaggcggaggtggcagtgagccgagatggtgccactgcactccagcctggacaacagagtgagactccatctcaaaaacaaacaaacaaaaaacatatatcgttggccctgggctggctgccctcatggccccgtggctccctctcgcctgcaggtgggtgacatcaccatcctggtgaacaatgccgccgtggtccatgggaagagcctaatggacagtgatgatgatgccctcctcaagtcccaacacatcaacaccctgggccagttctgggtaagggctatccggggccagagccagccccgggcgtgcagggagcccaggcaggatggaggggaggggatgatttgccagggcttgggctcaggccagcagggatgtccacgaacaaggtggccagacaagacgaatgaccagctctaggatacatcagactttgtgaaatatgctcggtgtcctggggcagggagccctcggccctctccctcgcaggaaggctcgggccctagagcatcatgtgtgtccggggtgggctgttctccccgaaagaaaggtggaggggttgtcagagctgcggctgctccaccctgacaccccatctgccctcagaccaccaaggccttcctgccacgtatgctggagctgcagaatggccacatcgtgtgcctcaactccgtgctggcactgtctgccatccccggtgccatcgactactgcacatccaaagcgtcagccttcgccttcatggagagcctgaccctggggctgctggactgtccgggagtcagcgccaccacagtgctgcccttccacaccagcaccgagatgttccagggcatgagagtcaggtcagtgagcaggggacccaccttgagaccagccttctcacctgcctccccaagccattcagtcagccaactgcagaaagagctctgatataaaaatcgggctaggcacggtgcctcatacctataatcctagcattttgggaagccaaggcaggtggatcgcttgagcccagcaatccagtttgagaccagcctgggcagcatggagaaaccctgtgtctaaaaaaaataaaaaattagctgggcatggtgatgcacacctgtattcccagctatctgggaggctgaggtgggaggatcaattgcttgagcccaggaagttgaggctgcaagtgagctgtgattgtgcgactgcactccagcctgggagagagagtgagaccctgtctcaaaacaaaaagtcaccaaggagcctctaccctctgtttgacgctgtcttacctggttctcggtctgcaaggcagtgatgccacgatggggagggtcctgctgcttggttcagggagcttataggaaactaccagagctacaggcatgcagcgggatgtgtctaaaggtcaaatgagggagatgcacctccacagcgtcgtgcagggcgaagggagcttgagacatagggtgcattctgcctggttccacctgtatgaagttccaaaacaggcaaaactgggttagggtgatggaaatcagacccgtggcttcccctggagggctgggggtgtaacctgggagggaggcgagggaactagcaagaccttcagaaatgttctctcttcttgaacttagcagtcattaaatacgtgaaagttaatcaaactgtctgcttaagatgtataccttttgttatatgcaaattatagctcaatttatttgtttgtttatttagttatttattgagatggagtttcgctccgttgcccaggctggagtgcagtggcgcgatctcggctcactgcaacctccacctcctgggttcaagtgattctcctgcctcagcctcccgagtagctgggattacaggcgtgcgcttgcacccagctaatttttgtatttttaatacagacggggtttcactatgtcggccaggctgatctcaaactcccaacctcaggtgatccacccacctcagcctcccaaagtgcagggatgacaggtgtgagccaccacgcctggccgtagctcaatttaaaatgagtaatagggaggtcccaccactcctcctccaaaccagttaagtcaaggggaacggggaccactggtctagagctcatgccacctggggtggtgactccctcatagctgtgatgtactctgtgacattgggtcccgttaattactgctgtggctgatctgcaagatggggtgcgcgaatgtctccatcataggttctgcagtgaggacaaagtggaatctggcagggaacaccgtgtgtggtacatattaagtgcccaataaatggcgctttaatgatgtgcagttatgtaggggcatgacgtcatcgatgaatgaaaaccgggaattactcaaatactattctccctggttttttgcaatccagcgtacagtgcttcaccttctgattatacattgcagctgcttccaaaaatgaggatgacacggaagggtcatgaggagaattcagtgagacaatttagtgtagtgcatgccacgtgggagtcactcattacgccttagttactattaatcgggacagtgcggtgttgattgttgagaatcaaaaataccgggcttggtggctcatgactgcaatcccagcactttgggaggctgaggcaggaggatggcttgagcccaggaaattagaaataatacatgtaacacatctagtgcaaagcccggatactagatgctcaataaggagctgctgcttttattatttttcctaacaataaacatcttcataaatgcatgttattaattttcctagcagaccacctggtttgcatgcaaattgtcatcaattctgaatttcgaggagtctagactaatggctactaatgtttcctgttggctttttcccccatgggttttggtttggtttcttttcatctgagtatacagaaggtgctcaataaatgcatactggacagaagtgcatcagtggcagtctgcagttttgttttgtttttttttttaagacggaatcttgctctgtcgcccaggctggagtgcagtggtgccatctcggctcactgcaagctccgtctcccgggttcatgccattctcctgcctcagcctcccaagtagctgggactacaggtgcccaccaccacgcccagctaattttttgtatttttggtagagacagggtttcaccgtgttagccaggatggtctcaatctcctgacctcgtgatccgtccgcctcggcctcccaaagtgctgggattacaggcgtgagccaccacgcccggccggcagtctgcagttctaattgggtgtcctgagcacagaagcaagcaggacattgcagacatcgagtttgtgtgtctatttcaccttctagcatagcttctttcctaccactttaagaaggaaattcaaggttttcctgccacattttttcagagcgtgaacccaaactgcctggggtcaaatcccagctctgtgtgaccttggccaagttacttgacttttctctgcttcagtttcctcacctctaaaaagagattcataataatagtatccccagctgggcacggtggctcacgcctgtaatcccagcactttgggaggccaaggcgggcaggtcacctgaggtcaggagttcaagaccagcctggccaacacggtgaaaccctgtctctactaaaaatacaaaaattagccaggcatggtggtgggtgcctgtaatcccagctactcaggaggctgaggcaggaggatcgcttgaacctgggaggtggaggttgcagtgagctgagattgcacagttgcactccagcctgggcaacacagcaagaccccacctcaaaaatgaataataataataataataatagtatccccttttcatgggttagatgagctcctgtgtgtgagtcatctggccacgcctggcaagtagcaagcactaggtgaacattagctacctatggttgtgcaggggagccccaaggtctcggccagaagagtagtacaaggaagatgggtacctaaccaactcccatttcctaaaagaataaaaaatggataaaagcatgggtttcctcctacaaccatgcttagcagcctcccagggttaaatgggttaaatgtgaagacatgtttaggacaaaatgagtgagtttcccagcaagactggccatgtcaatggatgttattgtttataaattgctatttattgagcctctttttttttttttcttttgatacaaagtcttgctctgtcgcccaggctagagtgcagtcatgtgatcttggctcactgcaacctccgcctcccaggttcaagcaattctcctgtctcagcctcccgagtagctgggattacaggcacctgactccatgcccggctaatttttgtatttttggtagagacagtgtttcgccgtgttgcccaggctggtcttgaactcctggcctcaagtgatccacctgcctcagcctcccaaagtgctggggttacaggcatgagccaccacgcccagccaattgagcctcttcgatgttccagccatagaaccacctagaaccactagacactttacaagtgctgctgcatttggccctcacagcaaccctggaagagagcttttattcccattttacagatgagggaactgaggctcagagaagcaaagttacctgcccaagtccacatagcttgaaactggctagctaagcatgcttcttccacgaatttgcactgcttccatgggagttaatagctgtgccagttccccgtgtccccatcccacacaccgtggagaggaaggagaaaatcctgcgcacagacgtgcttgaggcctcctctgtcggcttccctggcaggggtcttaccaagaaggattcccgtcaagcccatggactttggtctgtccatcctgccttccctttcccaagagacaggccaggccacaggtggaagccagagaatccagaccgcccacgacacctgtaggactccagtatcagtgagctgcctcaacacgttcatctctgtagaatggcagaggctggcccctcttgaccacagggctgtgggcctcagaatcaccatcatggccaggcgtggtagctgggttcacaccagtaatcccagtgctttgggaggctgaggcaggggaatcacttcagcccaggagttgccagcctgggcaacatggcaaaaccccatctctacaaaaaatataaaaattatctgggcatggtgtgtgcacctgtagtcccagctactcgggtggctgaggcaggaggattacttgagcccagggaggtcgaggctgcagtgagctgtgatcacgtcactgcactccagcctgggtaacaaagtgagaccctggactcaaaaataaaaaataaaaaaagaatcatcatcgtgatgacaaaggaattacagggcagggggtaagattcatgtaccctctgaggccaaacccctgctgggagtccaagggctgcctgttgctgaggaatgacatcaaacctgggtgattcatcacccttaatcttcctggtgccagagcggatcacaagctctttgtgggattggggtcagagccagcaacatgagccctgcacctatagatccaggaagggcaggaagagcagtgagcaaaggtgatagagcattggccaggtttgaatccttagcgccctactgactcaatacagcctcggtttccttatctgtaaatcaggagaataatttgtacatgagtctggcacgtagggaacatcatcattgtttggatctagggtcagatgcttttaaatagtcatgagaagcccctgatgtttgcttatgcaatcattcattcattcattttgagatcccatggaaagcactgtgcaaatctttgaatcaatgaatcagtgagtgagttagtgaaccagcaagctgagccccagccatcgctagccaagcccctgcctccagacagaatgagcaggacacatttgggaagcagcaagtcatcagtgtgttcagtccttcaagtatttattgagcacatactatgtatcagatgctgtgctagatgcaggggagcaggaccgaccaggcctccaccctcatggaactcattgcctgatggcggagacaggccactgacaaggaaacaacccaaaaagcaaggtcttcctaggtggggtgaatgcggtcaaggaaattagcaggggacaggatcagaggtcgctttggatggactggcctgaaatgtctcccaaaggaggagctgggaggagagagccaggctgttgagagagctggcaaaaagccctgacccgagcatgtgatgtgacaagaacagaaatgggcctgtcctgaaggagcagagtgtagggaaaaggactcagaaggacaaccagggcccagattacgcagggccatggaaaggccaagccctagggcactgggagcccttggagggcttgggagagtgggtccccagtgggtgggctagaagtccttgactcaagaagagacccctgtgtgcctggaggagtgagggaatgtggcacctggatgggtgtggggtagagggagtattccaagcaggcctcgaatctctcagacaggaaaagccaaagggtgacccagacatgtcagcctcataaagacttccagataagcacatgcctctccaggagaaacccactgtgtctcttcctgtgttcaggtttcccaacctctttcccccactgaagccggagacggtggcccggaggacagtggaagctgtgcagctcaaccaggccctcctcctcctcccatggacaatgcatgccctcgttatcttgaaaaggtatggggctgggaaagaacactctgggtcaggggaaagtacgcatgtgatctattagtcatgtctgctgcgggcatgagcatgaggagtgctggcacatttgctgctgatgtactgtacttactgtggggcagcagttctcaaacttgttagtcacggggccccttagagttttaaaaagtatggaggaacccaaagagcttttgttaatgtgagttgtagctatcgctatttactatattagaaattaaaagccagggccaggcgcagtggctcacgcctgtaatcctagcactttgggaggccgaggcaggtggatcacgaggtcaagagattgagaccatcctggctaaaatggcgaaaccttgtctctactaaaaatacaaaaagaaagtagctgggcatggtggtgggcgcctgtagtcttagctactcgggaggctgaggcaggagaatggtgtgaacccaggaggtggagcttgcagtgagccgagatcgtgccactgcactccagcctgggtgactcagcaagactccatctcaaaaaagaaattaaaagccagaaaaatgttgtaagttgtatacatttgtttataatatttattcatttataaatagctataacaaacccattacattaatataaatatatttttatgacaactagttatgtattctaaaacaaaataaatgtagtcaggagtggcattgttctacctttttgcaaatctctttgtttggcttaattgaagacaattggattcttatatgtgcatctgatttcaatttgttgtgatatctcgtgtcacgtagcctctggaaaattctaccattcactgagagaatgaaagtgaaaagacaaataacatcttagtattattacagaaacaatgtggccgggcacggtggctcacgcctgtaatcccagcactttgggaggccgaggtgggtggatcacctgaggttgggagttcgagaccagcctgaccaacatggagaaaccctgtctgtactaaaaatacaaaaaaaattagctgggtgtggtggcgtgtgcctgtaatcccagctacctgggaggctgaggcaggaaaattgccggaacccaggaggcagaggttgaggtgagccgagatcgcaccaccgcactccagcctgggcaacaagaacaagactccgtctcaaaaaaaaaaaaaaaaaaaaattgacctcacagacccctgaagagatcccgggtaccccaaaggttcctggacctcactttgagaaccactgttctacagcctattggacatagcccctgccctcaggaagtttactattagagggaacatggggatcttgatgccaagggctcagaattcacagaagcgtcttagtaccagtcgggtgggatgtagcagggcagaccactttggggaggcaggctttataaatgagagactcctcctccagaatttgcctggcatcctattcccctagaactttccaggctttgtgcagcaaatccttcccatcccagtcccacactcagttttcttgggcctcttagtacagcaggagatccttgtccctggtgccacaagtgaccatgggctcttggctcccctggggctctggccccctcctgactgagcccctctgacctggaagtccttttcaggaaggtaagcccccaagtgccaggctggcccctgctctcatgcaacatgcactcccaggaaagccaacttctgccctggctgctgggacatggtgagccccagctgaggggctgccccaacacatgcagggcacagaaacctcgaaactgaggcgcaagcccgatcagccctctcttccccaaactcaaagccctttcagaggcacagggaagggggcacccaggggcatccaggccacacctcggcctccctcagtccatcctgacctcgggtctgagatgctcctcagccgtctctaggagcccctaattgatcaggggctcaggtcctcactgaggtcaggctgccaccctccacctcaggggagcttcttagaagacttccagagctttctggagaaaagttggtctagaacacctcagcgctctccacagtaagccctcagccttcattttccaacattccccacaactacttttgaacaggaagcaggagccaccccgctccccattctctgaactgcatccctcctcaccttccccaggagaaagcaaggctcaactctaataccaccacccccaggaagccttccagattgctccagctggaagtgaacccttttcatcttgtacttagagtgggccaggacccttcagtttgagtcaccaaacagcctgagggccctctctgtgccgggcccatgtgagggcctggggatcagagatgaaatacccgccatgaaggcccccacaggcttgacaagtaaacgggtggggactacaccagggcttgctggggaagcgtcggaactccggttgtacgaggagaagcctgaaggtgagcccaggacgcttccccagaggatgtgacacccaaatcgaacctgattcctcagatccacaccgtcatctttgtggaatcaggggcagttgggatcgatggatctctgagctgcctgtgggcaccaagatgctaagagcctggttttgaaagtgtgttgtatgaagggagagaaggtcagcactcccctcgacaaggagcacagacagattaagccattgtcacctacttagtggcacctaaccatcatttgtttttaatgggtacaaaaaatagaccgaataagaacaagtctttgatagcacagcagggtgactatagttaataataatttaattgtacgattaaaaataactaaaagggccgggcgcagtggctcacgcctataatcccagcactttggaaggccgaggcaggcagatcacctgaggtcaggagttcaagaccagcctggccaacatggcgaaaccctgtctctactaaaattacagaaattaggcgggcatggtggcgcatgcctgtaattccagcttctcaggaggctcaggcaggaaaatcacttgaacccaggaagcagaggttgcagtgaccccagatcgcaccactgcactccagcctgggcaacagagtgagactctgtctcaaaaaaatataataaacataaaaataaataaaaaaactaaaagagtatagttggattgtttgtaacacaacagataaatgcttgaggtgatggataccccatttatgctgatgtgattattatacatttgcatgcctgtatcaaagtatttcatgtaccccataaatatatatacctactatgtacccacaaaaattaaaaataaaaaaatgagctctgtttcaggatctaggaaaaagataaaaattttaaattaaaaaaaaagtttgctctgaccactcactctctgcctttttaaaatatatattttaaaaagagtgtgtgtgtgtgtgtgtgtgtgtgtgtgagagagagagagagagagagagacagagttttactcttgtcgcccaggctggagtgcaacggcgcgatctcggcccaccgaaacctctgcctcccaggtcaagcaattctcctgcctcagtctcctgagtagctgggattacaggtgcccaccaccatgcccagctaatttttgtatttttagtaaagacagggttttgccatgttggctaggctgttctcgaactcctgaggtgatccacccaccttggcctcccaaagtgctgggattacaggcatgagccaccacgcccagtctgaaaagaatttttgagacagggtctggctctgccacccaggctggaatgcagcggtacaatctcagctcacttcaacctccacctcttgggttcaagccatcctcccacctcagcctccccagtagctaggactataggcacatgccaccatgcccagctaatttttgtatatttttgtagagacagggtttcaccatgttgcccaggctggtcttgaattcctgggctcaagcgatccgcccatctcggcctcccaaagtacttggattatagacatgagccaccgcgcccagcctccccctgcccttttaacagctgcttatccacttacttgaaagctcttcccctggggagggtgggggtttggggagaaactggtgtgtggcttggaggtgtggggagcactttcaggaaccagccctctgctgccccgtctcacatggccaccagcgacccagcccctggatcctgccccactaaccatcgctatcttcttttcttcctcctactccagcatacttccacaggctgcactcgaggagatccacaaattctcaggaacctacacctgcatgaacactttcaaagggcggacatagagacaggatgaagacatgcttgaggagccacggagtttgggggccacagcacctgggcacacacccgagcacctgtccattggcatgcttctgctgggtgagcaggacagctcctgtccccagcgaagaatccggctgcccctgggccagtcccaggacctttgcacaggactgatgggtataactgacccccacagggaggcaggaaaacagccagaagccaccttgacacttttgaacatttccagttctgtagagtttattgtcaattgcttctcaagtctaaccagcctcagcagtgtgcatagaccatttccaggagggtctgtccccagatgctctgcctcccgttccaaaacccactcatcctcagcttgcacaaactggttgaacggcaggaatgaaaaataaagagagatggcttttgtg

SEQ ID NO: 36177 - DNA, 18308 bp, Homo sapiens
ggccacagcagcgcgaggcgggcacggggtattgtccggctccggcggcggcggtcggtgctgcgagagcggcggcggcggcgcgggtcggcagcgggagggcgcgcggccgagcggaggcggagtcggcgccgagaacatggtaagggcggccgggtgggccgggggcacggggcctgggagagcagagcgcggaggccctggcgtcggcgccgctacctgtggagtcgggagtttgcgggtgtctgggcttcgtccggccgagcccctcgccgcccgccggggggcgccatgtcccagctgcggagcccgacacgggtccccgggtgagagctgggcctggccgggtagagcgcgaagtctgttccgagccggatagatctgtcccgacgcttgtgacgctgcaccgcccgtcttagaaggaggaggacggcagaatccggcttggaaatgtagaaacaagtgctggatcttaatgtgatcgcttctctgtatgaatgaggtcaaacaggctgccgctgtacaagttagataagtctttggcgatgtttggttacgtaatctccctggcagtcagtttgagggtttctgcgaaagggtgcttgtatttgtggtcttttgagcgacaaagaatggttttatagaccagaaccacacgatttgttctaggtgattgcacaggttagaaatgaacgcccgttatcttctgagccccttgcagtttgcggttttcattatacaacagtactttcctttgcccttgctatggattttcagtcttaaagtattcatcttttcattctgaaattcagatctagataagaagagtgtggctttaaaaaaatgaaagtgaatagaacttcagccccattttaaagttgaggggaaaagagaaggtgctaaaggatacgctctgagttgcatcaaagattgtgtaaaaataataagactgttatggaatcttatttttgccggtattcgtgctttaagcattctgttgaaaggttacttcaacgggagctacctgcttaaaagttagcaccaagctgtcatttatcatactgcagatagtattagatgatttgtcttgtgcttgatgtgacagatatggtattgaatagacataacacctaactgtaaacagattggccagtcgagaggacaatgtttggttattgtaaaatacccaaatcttagagctggaatagactttagggataattgcttccaacgtctaacgtatagtttattgttattgtaaaaaacccaaatcttagagctggaatagactttagggataattgcttccaacgtctcacgtatagtttattgttattgtaaagtactttatagtactttatcaaactgaggtacagcttacatctaatctgtaaaaggatttgctcaaacagatgattttcatgattctagttttttgtggttttttttttttttggttttttgttgtttgttttttgtggttttttgtggtttttttttttgagacggagtctcactctgttgccaggctggagtgcaatgggcgatcttcactcactgcaacctccgcctcccgggttcaagcgatgctcctgcctcagcctcccgaatagctacaggcgtgcgccaccacgccctgctaattttttgtatttttagtagagattgggtttcaccatgttggccaggatggtctcgatctcttgaccttgtgatccgcccccctcggcctgacaaagtgctgggattacaggcgtgagccaccgcgcacggccaattctagtttttcagatatttttcaatctctagtgatacgctatatgttttatatccacttaccagtagctaaaaatacataagtattaacataagctaaaaatgcaggagacattgagttgtcgttcttgatagattttaaacctgagaggaagtaagcagatgtctgttaaaactgacatgaaagtgtcttagtatccagtttgcaagtttatccaagtaaaatgaacgaactcctacttcctcctctctctctctctctgtctctctctgtgtgtgtgtgtgtgtgtgtgtgtgtgtgtgtgtgtgtaattttttaaaaccaacaaccttaactcaggttaatacgaagtcagttcttggaattaaaaaatttagatttgggttctcaagcaccaattatattaaaatgaatgttcaaagtagggaggctatatatacagtttgaggggatatcggaaagaaagtaattatccatttattgtatagttttatattcagataagtttgataccataaaagttttcttttgttaagtatgagaaatgtatcaggaatctctaaatgttggaaatagtcatttaatggattgaggcttttaaaacctgactgtatgtctacttccttaaaaagcaaatagaacaccaaatatgacatatctgaaacagtgaggataaaattgcttaagcagagtagttattatatgacctggggagcctggggaattttgtagttgttggctttttattagtgactacttcttattttttccaatccagtcataggaagacagtgattataattttagatgccagttgagaggtttttaagtgttatatattagggcaaatggaggtaacaagggttttttatttgagaagtaagtaagactgtcttgttagtggagctgacctcaaaaatccaaaaattgtatttttcttatataacaacatagtcaaaaattattaaaatatgaggcattctggtagaaatagagagcgtctcagttcttactggtaaacttaaatcagtctcttgttgaattacctaatataagagagtgaatatgaattagttcttagatttttatttttcctgtttctgatacctgccagggttttactgtttttcttccatattatcttgggtgacacgcacttaatccacttagacgtgcaattagaggaagtatacaggggtaatttttagctttaaaaaatttttaaggaaagggttagctacaaaggggatatgccatttcaaagcttaccatctattttgaaagaatagcccctcaaacagccaatcttgtaaactgatttctttttttaacagtaaagaaataatctgtttaaatggtaaaagcaaaatatatgagagaaaattagttttcttaagtcagacctttagtatttcctcccgagaggcaaataacatttctaatttattgtgtcacctactagaaatacatgtgtacacatatactctataataccccatatttacttaaaagctcattacattggcacatactttgcctttttcatgcagaaataggtttttttaaagcgtacagttcagtggcattaagtacatttatagtgtgcaaccatcactgccttctgcctctagaactttttcatcttcccaagtggaaactctacccattcaacaataactcggccaggcgcagtggctcacgcctgtaatcccagtactttgggaggatgagacaggcagatcacttgaggtcaggagttcaagaccagcctggccaacatgcagaaaccttgttggtactaaaaatacaaaaattagcagggcatggtggcgcgcacctatactaccagctacttaggaggctgaggcaggagaatcacttgaacccaggaggcagctacccctggcaaccacaaatctgctttctgaccatgaactttactattttagggacctcataagtagaatcatacagtatttgtcttttttgtaactggcttattttccttagcataatgtcctcaaggcccattcatgttgtagcttgtgtcagaatttcctttttaaagctgaatactattccattatatgtatatcattttgttcatccatcattggacactcaagattgtttctaccttttggctattctgaataatgcttctgtgaacgtgggtatacatgtatttgtttgaatccttgctttcaatttttaggtgtatacctagaagtggaattgctagactatatgacaattctgtgtttaattttttgaggttttttttttttttcttggaacatgctttatttttctgagagctaagttctaaatatttctgtggaagtaatatatgttacattgacattgataaaaattgtgaaatacttcatgtatgcataaaagttatattgacttgcaagattctttaatctggaaattgataaatatgtttgtttttaaaaatctcatatttttcagcctggcactgtggcttatgcctgtaatcccagcactttgggaggcctaggcgggcggatcacttgaggtcaggagttcaagaccagcttggccaacatagtgaaacccacctctactaaaaatacaaaaattagccatgtgtggtggtgtgcgcctgtaatctcagctactcaggaggctgaggcaggagaatcgcttgagcccaggaggtggagtttgcagtgagtcaaggtcgcaccactgcactccagcctgggcaacagagctagactccatctcaagaaaaaagaaaaatattttaaataagtgtttaaggtttgatttctttgatagaaattataaaaggtgatagaatcccatgtatatttacaaatgaggaaggggatcacctacatattgttaactacctaaagtaaaactagaaaaaattctgtttccagaatatttttgaagtagtattttcaactcttttcattcaaaaaaatttttttttgcatttaggctggaggcaaagctggaaaggacagtgggaaggccaaggctaaggcagtatctcgctcacagagagctgggctacaggtaatgaatccatgctgtcattacattattattttctttactgttgtaatttatgacctatgtttcatcaattacaaaaatctacttgtattactacagacttttttttttttttttttttttttttttttttttttttgagacagagtctcactctgtcgtcaggctggagtgcagtggtgcaatctcggctcactgcaacctctgcctcctggattcaagcgattctcctgcctcaggctcccacatagctgggactgcaggcgtgcgccaccatacccagctagtttttgtatttttagtagagacgggatttcaccatgttggccaagatggtctcaatctcttgacctcgtgatctgcctgcctcagcctcccagagggctggaattacaggcatgagccaccgcgcctggctgagaaacccttttaatcaggaaggctaagctgtaaactgttatcctcttggcagtggtaagccattgagagtttgagccagaggacaacattatccagatgataccgaaagaagggggatgggaacttaaactgatatgcacattctgtattttaggtctccatgtatattcccaattagaatttattttaaggcatacttaatttgaagtagaaaatggaaggccaatggaggtttttgcagtggtttaggaataaagtaacatacttgaatgggaaggagtagaaagcatgtgtgtgcagaaaataggtgaagcagtataaggttgagagaaagtcacaggtttctctaaggcttagaacctaaggaacagaggagtttgtagtaggggcaagttatgagtaaatttaaatggaatcattttgaagttcactaaaacatccatgtgaaaatgtccagaagttggaaacatgagttcagctttctaatagaggtgatagaattaggaatttgagatcatttatgtaaaatggatagtttatgttatggatgagtttcctaacctaagagaatgagaaaggagcacagggacgttggtggacccctgaaaaactttaagaaaaggctgaggagtagtcagacttggtatgagaactctgaagtctaagatgaaatgtttttgagggcctactgtatgccagacaacatactggttactaaggatacaaaggaaaagaagacataaatcttgcccttaagaagcttttggtcacttagagatgaagtataaatgcaaaaaaaagattgcttgtttttattaaggaagtaaaatgtcactgctggccttcaaaggtcaagttagggttaggaaaaatgggtgacaaggaagtaagggtttcaggatttgttttttcaattcagtctttggaaagagactgtctagactgtaactggaagcagttttcatagattgtgaagttttcagtaaagtctgtagaaggaaaggaaccagcggaaaggaagtaattgtagctgttgaaataatggagcagtgaagggttgagggaggcctgtaagaaaggcacagactggcggggcacagtggctcatgcctgtaatcccagcactttgggaggctaaggtggacagatcactcaaaaccctgtctctactaaaaatacaaaacagccaggcgtcctggcgcgcctataatcccacctactcaggaggctgaggcaggagaatcgcctgaacccgggaggcggaggttgcagtgagccaagatggcgccactgcactccagcctgggtgacagagtgagactctgtctcaataaaaaaaataataaagggcacagacaagtgggatcaggatactttgaaatgagaaaaataccctctttttcagaaagtagaaagaaccacaatgagataatagtattgatttttcttaactatcagatcacctcttgaaactgaagaaagaacatttaagatctgaggaaggtattggaggttcaaagttgcatgtggctattatgtgaagaaattaactagataggaatttgatccatgggtcatgttgaacgtacagttgatgacagcccagcgtggtatttcttcattttagagtgatatttcccatattatgcagaggttaaagattttggacagattaccagaacagagacacaggccctgggaactattgatgcgtaataggtttggcttctgatatgtgtgatcaagttttttattatttcatgcttacattgttcagcctttgattacagtcagtgcaatgttaagactctgcagtgcttcccactaagacatctctcttttagtttcctgtgggccgcatccacagacacttgaagactcgcaccacaagccatggaagggtgggtgccactgctgccgtgtacagtgctgcgattctggagtacctcactgcagaggtttgtacaggaatgtctgttgtatatggccatccagaaggtgcactagtctcagtgacagaaacccatggaatatatttgaaaaaagacatattatgctcactggggcttttttgtttgtttgtttggagacagagtttcactcttgtttcccaggctggagtgcaatggccagtctcggctcactgcaacctctgcctcccggattcaagcgattctcccacctcagcctcccaagtagctgggactacaggtgtgcaccactgtgcccagctaatttttgtatttttagtagagacagagtttcaccatgttggccacactggtctcaaactcctgacctcaggtgatctacctgcctcagcctcccaaagtgctgagattacaggcttgagccaccacgtccggcctcattggtttctttaatagcagtttgagatgcatcttgtcagctattacccaatgccaatgtaaaagaaccttggtgtacttgtttttaaagctaagcaaggggctgggcacagtgattcacgcctgtaatgccaacactttgggcggctgaggtgggtagattgtacacttgagtcctggagttccagactaggctgggtgacagagcaagaccctatctcaaagtaaaaaaatttttaaaagttaagcaagggccagcaatctcttatcttttatttttatttttttattttgagactgggtctcactctgtcacctaggctggagtatagtggcatgatcatagctcactccaacctcaaacctcctgggttcaaaggatcctcctgcctcagcctccctagtagctgtgacttcaggtgtgtgccaccacacctggctaattatttatttatttatttatttatttatttatttatttattttgagacagggtcttgctctgtatcccaggtggagtgcaatggcacaatcttggctcactgcaacctccacttcttgggttcaagcaattctcctgcctcagcctccccagtaactgggattacaggcacccgccactacacccggctaatttttgtatttttagaggagactgggtttcaccatgttggccaggtcagtctcaaattcctgacctcaggtgatccacttgcctcagcctcccaaagtgctgggactacaggtgtgagccactgcgctgggtgctaattttttatttttattttatttatttatttttttttgagacagaggctcgctctgtcacccaggctggagtgcagtggtgcagtctcggctcactgcaacctccgcctcccggattcacgccattctcccacctcagcctcccgagtagctgggactacaggcacccgccaccacgcccggctaattttttttttttgtatttttagtagagacggggtttcaccgtggtagccaggatggtctcgatctcctgacctcgtgagccacccacctccacctcccaaagtgctgggattacaggcgtgagccaccgcgcccagcctattttttatttttttgtggagacagggctccctatgttacccaggctggtttctaactcctagcctcaagtggtcctcccaagttgctgggattacagacataaaccaccataccccagtgaactttgaagtatgtatgtaatcagtagacagtatttgtgaagttagagcataatgttgtagtttatgaagatttgggatgatgtaaagtttggccagtgtgatgatatataaaaatcacaaatatgataatagaagtaaaagactcagtctgtcctggttctctgcagggttatacatacaaaattgctgtatattactcagtttgaaatttcaggaagacaagttaattgggcaagagttcttgggtcacagaccaccactttccccatccctattcctcctttaaaaaaatccgttgggaagtcataaaacttcagctacattccagattggggaagtaatttgagtaacaagtaggtcaagtgtagacgcattcattctggtggaaacagaagggtcttacttggggagatgtgattgggagctaggctgaggaatttagcttttaatctgtatgtcagttatcattgctgtcatttatttcattagtctcaccaagtcatctgtgtcccactggggatttaacatcgaattatggatgttatggatagtttcagcttctctgtgtcatgatcaaggggtgttttgtttttggggtttttcttgtgtgtttgttttgagacaggatctctctctgtctcccaggctggaaggcagggacatgatctctgctcattgcaacctctgccttctgggttccagtaattctcccacctcagcctccggagtagctggggctaccggtgtgcatcaccacacctggctaatttttgttattttcttgtagagacaaggttttgccatgttggccaggctgatctcgaactcctgacctcaaatgatctgtccgccccagcctcccaaagtgctgggattacagacatgagccaccttttattaaaagaggccacctggcctcttttatttttaaaaatttttaaattttaattaaaatacattttaaaacttttctataagcattaagaaataaatttcacggctgggcacggtggcttacgcctgtaatcccagcactttgggaggctgaggtgggcagatcacgaggtcaagagatcgagaccattctggccaacatagtgaaaccctatctctactaaagatacaaaaattagctgggcatggtggcgtgtgtctgtgtatagtcccagctactcaggaggctgaggcaggagaattgcttgaacccagaaggcagaggttgcagcgagccgagatcgcgccactgcactccagcctggcgacagaacgagactccgtcttaaaaaaaagaaaaaaaaagaaatttcagctattaaaggttctgcagaaatagaccacatagatatattaaaatatatgactttggctgggtgtggtgtcttacattgaacattgtggttcacaaggttcaagccccatctatctaagcccccccccccttttttttaaatctttgggaactttggttaaaatttttaaagtttacacagtggctcatgcctgtaatctcagcactttgggaggtcaatgtgggcagatcatttgagtccaggacttccagaccagcctggacaacatggcaaaaccctgtctctacaaaaaaatacaaaaaattgaccagatgtgatagtgtgcacctgtagtcccagctagtggagagggtgaggtgggatgattacctgacccaggaggttgaggctgcagtgagccatgattgcaccactgcactccagcctgcatgacagtgagaccatgtctcaaaaaaaaaaaacaatttaggttaagattggacaatgaatgtgtgggtgcagtcaactttttttttttttttttttttcttttttttttttttgagagtcttgctctgtcgcccaggctggagttcagtggctcaatctcggctcactgcaacctccacctcctgggttcaaccgattctcctgcctcagcctcccaagtagctgggattacaggcgtgtgccaccacaccttgctgatttttgtatttttaaagttcagcagttgattctcctgtatacccaacactgctctatttaaaacgaggaggtggcctggcgtagtggttcacgtctgtaatcccaacactttgggaggccaaggcgggcagatcacaaggtcaggagtttgatttttttattttttttgagacggagtcaaggtcaggaatttgagaccagcctggccaatatggtgaaaccctgtgtctgttttttttgttgttttgttttttgtttttgtttttgtttttcttttcgagacagagtctcgctctgtcgtccaggctggagtgcagtggcgccatctcggctcactgcaagctccgcttcctgggttcacgccattctcctgcctcaccctcccgagtagctgggactacaggtgcctgccaccacacccagctaattttttgtatttttagtagagacagggtttcaccgtgttagccaggatggtctcgatctcctgacctcatgatccacccctctcggcctcccaaattgctgggattacaggtgtgagccaccgcgcctagccgaaaccccatctctactaaaaatacaaaacttactcaggcatggtggcaggcgcctgtagtcccagctactcgggaggctgaggcaggagaatagtttgaacccgggaggtggtggttgcagtgatctgagatcacaccgttgcactgcagcctgggcaacacagcaagactccatctcaaaaaaaagaaattattttaaattatattttaggctgagtgcgatggcccagtacacctgtaatcccagcactttgagaggctgaagtaggaagatcacttgaggccaagggtttgacaccagccctggcaacataatgatgtcccatctcttttatttttaaaaaattttaaaaatacatttgaaaacttctaaaagcattaagaaatacatttcagctattaagggttgtacaaaaatggtctacaagtatatattaaaatatatgactttgactgggcgtggtggctcacacttgtaatctcagcactttgggaggcccaggtgggcagatcatttcagcacaggagtctgagaccagcctgggcaacgtggggaaaccttgtgtctacaaaaaacaaaaatacaaaaaagccgggtttggtggcgctcacctggtcacagcagctcaggacgctagggcaggagaataaccctgcacttgggaggtcaaggctgcagtgagccaagatcacaccactgcactccagcctaggcaatggagtgagaccttgtctcaaaaaaaaaaaaaaaaaaaaaagacttttctaaatgttcacatctggcatcttggctaaggggtaatatctcctgtccttacctttatttctatatagaagtgggtttttgctcaagtttgtgtctctgttgcagagaatgaatataaatgaagttaaatgaattagagctttataaaagcattatagaaatacaagaaagaaaaatatattatcagtttatgtattgtgtgtgcattttgtatgtacaaatgctaagtgatccttcatttgggatcctaggtccttcatttgatatgctaatcatggatgctttgtaggtgctggagctggcaggtaatgcttctaaggatctcaaagtaaagcgtatcactccgcgtcacttgcagcttgcaatccgtggtgatgaagagttggattctcttatcaaggctaccatagctgggggtggtatgtattactacttaagccttgattcttattggtctttctgactaatatatcgttcagatcaatgatatagtatatttgatcggttaactagaaagcatataaactttaatttcataaatactaaatctataacaattctaagcttttcataatgatctgaataaatatttcaccttctagccatatgtaatgctatttttattttagccagttctttgtctaaatttcatatgatacttaaagcctgatgtttaacatatttcccatacttttttaactgtgtttgaaaaatgagttggagaagttgcataacatacactggaaagggttgaaataaatacacttgaaaagtgggtcaggatcaatgaaagtgagaggtaagttggtggttcttaatcttctttggataaccctcaaagaacctcgtgaaagctgtggttacagctgggcacggtggctcacacctgtaatctcagcactttgggaggctgagaggccccggatcacccgaggtcaggagttcaagaccagcctggccaacgtggtgaaaccccatctctactaaaaatacaaaaattagctgggcgtggtggtgcacacctgtagtcccagctactcaggaggctgaggtaggagaatcacttgaacccaggacagaggtcgcagtgagccaagattacaccactgcaccccagcattggcgacaaagtgaggccatctcaaaaaaaaaaaaaaaaaaaagctatggttactcttctcaaaaaatgcacggaaagtcacacaattttacatacagttttaaagggttcacagacccctggggtgtagccattggtatagatagtttaacagtatcagaatatgaaaagggacttaagtaaatttcattttttctataattaactttttacttgaggcaaaaactttaaaagtttttaataacttttttaaatttcattctaggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtgacagttgtgtgttgattggctaggtttctcccgtgtgttttatacaaaaatggaattgataaaccattttttacaaaattaatttgtctcaaaactgttctgttcatgatgtattagaaatattttactcagactttaaatattttaaatctcagattggttattcagagtaaccttagaacagaaattgggaatatatctttacaatgattgataccatggtatattgactcttagatgctattgatctgtagcaccattttttacaaacgactaaggaaaaaacctgccaattaaatcatgatatgccatcaattatgagacatcccaatttgagagatgttagattatagaaaagtatgcatttatgactgaaatggtagtggaattatttgaattctacaccaagcacttaccatgtgccaggccctttgcagagtgctctactgaccaagaaagttgttgctgccacattatagatgtggagcctaagggtcacagaaattgtgtgctatgccaaaaaacattgaactggtagatagaaaatgacagagctaggattcaaacctagatctggctgactccagagcctagttttacctggaattgatgttcagtttatcaaaggtttctccttttggtttaaaatcccaatttttggcctggcattgtggtttacgcctgtaatcccaacacttcgggagaccgaggctggtggaacacttgaggtcaggagtttgagaccagcctggccaacatggtaaaacgccgtctcggccaggcgcggtggctcacgcctgtaatcccagcactttgggaggccaaggtgggtgaatcacgaggtcaggaaatcgagaccatcctggctaacatggtgaaaccccgtctctatttaaaaaaatacaaaaaattagccgggtgtggtggcacgcgcctgtagtcccagctactcaggaggctgaggcatgagaatgacgtgaacccgggaggcggagcttgcagtgagccaagatggcgccactgcactccagcttggcgactgagcaagactccctctcaaaacaaacaaaaaaaagtctctactaaaaatacagaaattagccaggcatggtacacacatgttgtcccaactacttggggcactggggcacaaaaaatcacttgaacccaggaggcagaggttgcagtgagccaagatcacgccactacactccagcctaggtgacagagtgtgactctgtctcaaaaaaaaaaatcccaacttttagtagtctcttagtcatgcaataacagtaatttgtacaatcttttaaaaattatatttatttatcagtttctaagaaacttttttgtttgttttgagacaggctcttgctcttttgcccaggttgaagtgcagtggcatgatcctggctcactgcagcctccacctctcaggcccaagcaatcctcttacctcagccctgcaaatagctgggaccacaggcacatgccaccatacctggctaattttttttatttatgtaagagacagaggtctccctatgttgcccaggttggtattgaactcctggctcaagccatcctcccaccttggcctcccaaagtactgggattataggcataagccaccatgccctgcgctaagtaactgttacttgagttaatgtactagttaattgacccttagaaaattatatttttctgcttgcaagtcttcattaaagaaggaaattttaaaatattttatagtataatgctatccaaactcatttttaaaaacattttattatggaaattttcacaaatgcacaaaaagaatagcagaatgaagctctgtgtacccatcctccaacagctgtcctgtggtcagtcttgtttacctgcatccccacctatcccctgccccaacccacagggatcagtttgagtcccattaacaggcatagtattttcatgtctgtgtgatcagagacattcaaatataactccaaagatagggtacttttttgaacataaccacaataccattgtgtaagactgctaaaacattttttgatgccaagtaccagtcaatattcaaacttcctgattgtctcgtaagttttttttaacagttggtttattcgagtcaagatccaggcaagatctagatcttgcattttgttaatataatctatagatttaactttcctgtttttaatttttgaagaaactaagttgtttgtcctatagaattgtccttcagtggattttactgaatgtatcctaatgggatcatgtacaccttttctgtcccctatatgttctataaactgacagatctagagggcttctgttgttctgttttgctttttcacaaaaataattcataggtgatatatgctccatgttgtatcacatcatggcacataatggctctcatcttgtaacattaagattgatagtgggtttggatgctgccagcccactccattcattacaaaagttctctatcagcttttcccctgatggatttagccatcattaatgatatttgcccacatctgggattccattagaggttgccaaccagtgatatcttgtcattccttctgcatctattagctggaatcctataaagaacttgtgctcattaattcacgaggcaggataaaatagaaatttcaaattctgattgaataggcgcccattttgaagtttctgtattgagagtcaggcctacagtaaaagtagcaatagaaagctgattgtttgaaaaaaaagaagcgggggggggagtgcaatataatcaacagactttcctttggctgaatcacttgattcagggcaatttttactacagttttatagataattgcttcaaatgtctaattcattttgatagtatagttacttgactacataatttcttcccagggttgtattttcaatttgttttctaacaaaaaacatagaaatagaacaactaggtcatgtactctgggcttagctctcacagttatgatcagtctcgtttcatttgtacccaaccccttgagttattttaaagcacgttccagctatcatatcacttcatgtataatatcttaatacgtatctaaaagatagcttttttatgttttattttatttttattttttcagacaaagtattactctgtcgcccaggctggcatgcagtggcacaatctcagctcactgcaacctccacctcccaggttcaagtgattcttctgcctcagcctcctgagtagctggcattacaggtgcctgccaccatgcctggctaatgtttgtttgttcttttgtttttgtttctgagacaggatctcactctgttgcctaggctggagtccaatagcctaatcttggctcactgcaacctcagcctcccaggcaactgggactacaggcatgcgccaccatgcccagctaatctgtgtgtgttttttgtttgtttgtttatttgtgtagtagagatggggtttcaccatgttggccaggctggtctcaaactcctgacctcaagtgatccacccgcctcagcctcccaaagtgctgggattacaggcatgagccactgtgcctggcgtagaaagtatttcttataattaaaaacaacacccagtctaactagtataacacctaaaaaattgtcagatctgtattttagatagtacgacacagtgaaatgcaatggcacttaagcagagagaagaaggatttttctttttctttttttaaatagaaggtgttagaacctgaactgggcctggtttgcatttgggaagagtccagtggggaaacaacacaaataaggtcttgagaatgaagaattgcatttatatagggagttgtaacaaatggcctggagagtatctgactctttatgaaacatttaatgagaaatgtgacttgctttggtgcctatggttgaatttgttgcgatgcttctgacattatgaaaattttcaaacatgcaaaaaagttccagtagttatccagtgaattcttatactcaccacctatatctatagttaacattttacttgtattttatccagttatcagctcatctatgagatggcccttatttatttgcctgctgtttttattctctatttgtcctgttatttcttgttagagaagagaaggtgttcttagatcagaagatgccattgtattaggtgacggcaaggttttgctgatttagtggaacaagattctactgggatgtgtgctgagctgaaccaaggaactgcccgaatgtgctgaacaaggacatttgcttctcagatacgtgaattcaattttaagcaagattcttgatctgcttcagagcagctttgatttaaagtaatttcagagcgcttttccttgcatgagtaattttctgaatgtataaaatattctatttatgtttgaccttttggataaactgtgttgctgcagtgttggtccacactaccatcctaagtgaagacttagtaagtctgaggatctcc

SEQ ID NO: 36178 - DNA, 17045 bp, Homo sapiens
gtggggtggggtggggctgggggcttgtcgccctttcaggctccaccctttgcggagattataaatagtcatgatcccagcgagacccagagatgctgtaatggtaagactttggatccttcctgaggacgtggagaaaacttgctgctgagaaggacattttgaaggttttgttggctgaaaaagctgtttctggaatcacccctagatctttcttgaagacttgaattagattacagcgatggggacacagaaggtaagaatgatataattactggttatttttgcttgtttgggatacactcagaaaggcaaatattaatggtaatctccttgttctattttctcctaagtcaccaagctatcttaaggccttttcatttcgtctctagcctgcactgctgccgcttcatcagttctctttgaatgtcatacagttctgttcaccttatcataggaaagtcacccggagaagttgtgtttgcttctcaggtttattttaggtaaccatatgccactgaggacgagatggttgagtgtttagaggatcgggctgcttggttgtatggattacaagtgtgggtctcagagccagtgtgaagacttctctggaagcattagaccttgaaaaggtctgtgtttggaggcacaggccagggtctggccatctgtttgtcctataacatatggggttcgtggatgctaaggagaaagaattccagttgtccttcctattagggttaaaatcgtgagtgcaggacatactaaaatattgagtgttgtatatgcattatttgcagggagaaaggcttttcttttttttctgattgagttttactcttgttgcccaggctggagtgcaatggagcgaccgcagctcaccacagcctccgcctcccgggttcaagcgattctcctgcctcagcctcctgagtagctgagattacaggcatgaaccaccgggcccggctaattttgtatttttagtagagacggggtttctctatgttggtcaggctggtctcgactcccgacctcaggcgatccgccggcctcggcctcccaaggtgctgagattacaggcatgagccactgcgcgcagcaagaaaggcattttttaccaagataaatttaactaaaaataaggggccaggtgtggtgggtcacacctataaccccagcatttgggaaaccaaggcaggaggatcacatgaggcctggagtttgagactagccttgggcaatatagtgagatcccatctctacaaagcagaaagaaagaaaatgtaggaaaataagaaagggatggaaaattatgagactaaagaagaaaaggctctcaaagatagtgaatgatgagaggagacagaagagatttttactaaacggaaaaagatttaacagagcattgcactggcagggccctccggggtaccgatgcttagctgggactgagacatctgggaggctgcaggcaaggtcacttctcctgctgaagctcccagcctgctgcctaatctgcccgacctgaaaggaaaggagtttaagatatgaaaggttgaagggattttgggtggtggggtgggggggaatggcgtagaagttggcctcaggtataaaaattgagctgccccaaggtagaaatggaaaatgtctcgcccggctgaattattccaggcaaggtgaagatgaccggttctccccactaagaaatgtctcttatatgttgggttcgcccttatatgttgggttcagagtaagtactttcttcccctgcgcgggagttagggatagcagaactgtatttaataaacgaagactgaaatggggccaggatgcagtgagtagatccagtaggttacatggtcctgagagataagagactcaaagagccacccagcagtgaagacacaaactaccaccccctccaccaccaccagtgggcttccgtggagtctggggtacagatcagactgcactgtatttgtttccagaatggtcaattcttagtaatcctacccgagactgtctttttctctgccctcccagttcgtgagtggaattctatgcctacatttgcctgatgcaagtttttaaatatttccaaactgaccaacccagtttctcttaacttcttccttccccaattttctttcatttttaccaagttaacttcacattcttatctccagataagttctttagtataatctattcctttgtcttccccattaattacctaaatctcattggatgttcttttcataccactcataactcaaattctcctaatacagctccataattaataagaaacagtcatcaatcacaagttttaaggactattctctcctctgtcttccctccctccaggtcaccccagctctgatatttgccatcacagttgctacaatcggctctttccaatttggctacaacactggggtcatcaatgctcctgagaaggtgagtgccaggccacaataattagaatttagaatagggaagttattcctttaagtagggtttcaggaattcagaatttaaggccaggcatggtggcatctgcctggagtcccagctactcctgaggctgaggcttaaagatcacttgagtccaggagttaaacaccatcctgagcaacacagttagtgagggtccctccccaaactaggggattttaagacaaactttgtatctatcctgtccaagactgaagatggagacaatattggtggggaaaattagtggggtcatctaatcgaagcacaaagctcacttactcccggaacgctgggcggtgctgttcttcctcccactctttcacctcatagtgatgcacatcctgtattatcccttaggggttagttacaaagaagctgggttcccttagcagagggctggggtagactgtgaacatcggtgctgccacctactgggattttcaggacaaatagaattactattccagcgagagttaacataaattccaatacgttatctgccccttccattcctgtctatttattcccttgattctctaggaaggaaatgatccctaatgtttgtcttttgttctcatccaactgtaacagtctgttcttccaccaacccttttattttgcagatcataaaggaatttatcaataaaactttgacggacaagggaaatgccccaccctctgaggtgctgctcacgtctctctggtccttgtctgtggccatattttccgtcgggggtatgatcggctccttttccgtcggactcttcgtcaaccgctttggcaggtattgactagaaactgggcaaggaagtgggctctaccagccacattgaggacaagtgtggagagttagggcagggaggtgatgatgcctttgaataagaacaccttgaattctaatcaagggaaacctagtccaactggccccgaatatgactgcccttgcttggagctctactaccctggagagctcccacccagctgtgcaagagatgaactgtgagtgattggcctttgcagtccagctagggatagttcagaattattccctagtaaactcaactatggggtttctagaaacatacttaatttacaaggtccgaagttgtttacttgtattataaatgtttttattattttacccaggattggtaggaattatttttgtctatggcaaatgtggataatgacaaaaaaaaagtcttattctatagaagcttaacaatatgttttagaaggtagaatatattttcatttatgactaatgaaggaactgttttaatttgccaattaggcacggtgtggtggctcacccctgtaatcctagcactttgggaaaccgaggcaagtggatcagctgaggtcaggagttcgagaccagcctggccaacatggcaaaaccctgtctctaccaaaaatacaaaaattagccgggcgtagtgacaggcacctataattccagctactccggaggctgaggcaggaaaatcacttgaacctgcagtgggggtgcagagggtgcagtaagctgagatctggccacttcacaccagcctgggcgaaagagcaaaaccccgtctcaaaaaaaaaaaagccggtgccgtggctcacgcctgtaatcccagcactttgggaggctgaggcgggcagataacaaggtcaggagatcgagaccatcctggctaacacggtgaaaccctgtccctactaaaaatacaaaaaattagccgggcgtggtggcatgcgcctgcaatcccagctgcttggaagctgaggcaggagaatctcttgagcctgggaggcgcaggttgcagtgagccgagatcctgccactgcactccagcctgggtgacagaccaagactccgtctccaaaaaaaaaaaaaaaaaatgccaattagatattctagaaatgcaattggaattcacatttaaaaatcggtaaagcaacctgttttacttgattatgttgttcttttgtttttttaccccccaagaaagagggtcttgctctgtcacccgggctggagtgtaatggcccaatcatagctcactacagcttcgacctccgacctcagctccctgagtgcctgggactacaggcgggcaccatcacacctggttcccaactagaaatgttctgataatagaaagtgaaaaacaaaagttagattaaaaaaaaaagggatgatatgagcctggagaagaacagaataatgaggacagaggagaagttaggagcctctcactttgctaattctactttgtctttgattaaccttacaggcgcaattcaatgctgattgtcaacctgttggctgtcactggtggctgctttatgggactgtgtaaagtagctaagtcggttgaaatgctgatcctgggtcgcttggttattggcctcttctgcggactctgcacaggttttgtgcccatgtacattggagagatctcgcctactgccctgcggggtgcctttggcactctcaaccagctgggcatcgttgttggaattctggtggcccaggtactctagaacttctcatacttaatgagtgttagtttcatgggtcattaaaaaagttaacataggtaaagcactgaagaatatctggcacatgttcaattacatatggaagttttagataatagatagtagctgaagaagcaggctgaggccgggcgctgtggctcacgcctgtaatcccagcactttgggaggccgaggtgggcagatcacgaggtcagcagatgaagaccagcctggctaacatggtgaaaccccatctctactaaaaacacaaaaaattggtcgggcgtggtagcgggcacctgtagtcccagctactccggaggctgaggcgggagaatggcgtgaacccggtaggcagagtttgcagtgagccgagattgtgccactgatctccagcctgggtgacagagcaagactccgtctcaaaaaaaaaaaaaaaaaaaaaaccatgctgagtagagaaaggaaaagaaacacaatttgtttattttttcacatggtaaaagaatgtatgattttctgaactttttgtgttttaatgaacttgtggcctgtgaagtatggggtttatagcattatctttgtgtggtttctagatctttggtctggaattcatccttgggtctgaagagctatggccgctgctactgggttttaccatccttcctgctatcctacaaagtgcagcccttccattttgccctgaaagtcccagatttttgctcattaacagaaaagaagaggagaatgctaagcagagtgagtatccttcacaccttactacatgaattatatggttgtggtttgttttagggatgattgtactggacctactttctgttacactctttccctgcctctcagaatccaagtgaggagggttctgattactcctgagtaaaattttcagcccctaaagaatgaggtgaaaaggcgggtttaggaatggatgctatcaggcagggtgtgatggctcatgcctgtaatccagcattataagaggccgaggcgggtcacctgaggtcaggagttcaagacctgcctgaaacaacatggagaaaccctgtctctactaaaaatacaaaattagccgggcatgggggcgcatgcctgtaatcccagctacttgggaggctgaggcaggagaatcgtgtgaacccgggaagtggaggttgcagggagctgagatcatgccattgcactccagcctgggcaacaaaagtgaaactctgtctcaaaaaaaaaaaaaggaatggatgctacccatcacctcacctcgtgcggccctttcctggctgccttacaggaagaatgaatttggggcagcacattctcttttatcctttcctctttcttcttttcaccagtcctccagcggttgtggggcacccaggatgtatcccaagacatccaggagatgaaagatgagagtgcaaggatgtcacaagaaaagcaagtcaccgtgctagagctctttagagtgtccagctaccgacagcccatcatcatttccattgtgctccagctctctcagcagctctctgggatcaatgctgtgagtgtgatactttagggtcaaacgtgtcttaaagtatttcacttaaaatgccgggcatggtggcggtgtgcctctgtagtcccagctactcaggaggctgaggtaagaggatcacttgagctcaggagtttcaggttgcagtgagctataattatgccactgcattccagcctgggagacagagtgagactgtgtctctgaaatttaaaaaaaggaaaaaaaaaaaagaccctggaaggacactggcaacttcagagtgaactgactttaccagtctgtttttacaactagtatagcgagcatggtagtttaaagagggcatgatagatgatagtttaaagagggcggcacaacggaagctagcatttggcaggtagcccttgtattccatgcaaatatcagcttcctgcatttgactgtggattgtaggaagagagtattcctgtgccttctagtcaatatggatattaagagcacccttgtcccacctttttaaatactgattcatcccctaagggttttcagatagtctttgatcaatgggattaaattattttgtaacaaagcattttgcaaaacttactattttgagcattttgatgctcaaaatagtaagttggttcttggaacttttctcctacctagcacaccaggatatttgtatttgaagtggcagtgcttcttatgaggggttagaggctgttatgtcagaatctatgaggagccaagtgtggtggctgctcatgcctgtagtcccagctactactcgggaggctgaggtgggaatatcacttaggcccaggagtcaagcctgggaaatatagtatgaccctgtctttaaaaaaaaaacttgggaggaaatacacagtagttagaaaaagcctcctaggtgattttgatgaatcccagtctcaaatttcttcatttggaaatgataatgtaggccacacgtattactggagaaaaatgtgctcccgagactttccagagcagcagagctgggactaggcaggtgaggcagctacgtgcaagtgtagccctgagaatgagcacctctttaaagaatgtaccttgcgttagttctgtgcctgtttaaaaaaagaaaaaagaaagaatgaaagaatgcacctgaggcaactccctagctgcctcaccacagtccaggccctgcaaaacaggatcagtaaaagatcacctgtgagaaatgacaagtgatccgtgagcagtctgagggacagactcctgccatttcagagtatggtgtgtacattctttttttttttgaaacagagtctcactcgatcgcccaggctggagtacagtggcacgatctcggctcactgcaacctccacctcctgggttcaagcgattctcctgcctcagcctcccgagtagctgggactacaggcgtgtgccaccatgcctggctaatttttgtatttttagtagagaacaggtttcaccatgttggccaggatggtctcgatctcttgacctcatgatccgcctgccacggccttcctaaatgctgggattataggcgtgagccactgcgcctggcccatcctttttttgaggtgaagtcttgttctgtcacccaggctggagtgctgtggcgcaatctcagctcaccacaacctccatctcctgggttcaaatgattctcctgcctcagactcccgagattacaggtgggattacagcccagattacaggtgcccaccaccataccttgcttattttttcgtatttttagtagagaatagagggatatcaccatgttggccaggctggtctcaaactcctgacctcaggtgatccacccacctcagctctctctcctaaagtgccggccttacaggtgtgacccacctcgcccggcatgtacattaattattgttggactaagctggctcccaatttagtcaatgagtagattttgcgctaggtataatctcacccaaagctggctgcatcagaattatgggggttgggattcctgagtcagctgaatttgagaatctctgtgtaagagacctgaaagttgtctgtaaaaaaataaatctgatgcacagcaggcttggaaatcacttttccaacctactttgcacaaatgatgatttctaatttcccttatgggcagatgggtaagaggttgcattgtatcatgtttacctagcagagtaaactatttaggtgagatgatgtaggggttaccttgcttggtgacactagatagcaaagtcattttactatgagaaattttattgagatgagtacatgtacattaggtttttgacgtgtagacattatgttaaggaaaagaattggcatacctatttattgcttgtttaaactgctcaagtaattacttttgcactagcctaatatatttccccacaagcttgacgccatcatataatatgttgagatttcttaacagtgttaattagccctagagcagcaggtttttcaataatgactctacaaatctcagtttcaaaacacaattatcttattttagaaaatatgaatatacatagtttacatcttacgtactagggatttaaagagttgtttcgtgagaaggtaaatcccaatgtagaggtccatattcataaaaaagactaataaatattgctatggaggcaaatactctgggtgaaataaactgaagtgaacctcggtaacctagataatgttcccttgttaacttgaggtctgagtccagtattttaatatctcttaactatggtagttatagcaactttagattttagcacagtgcctagcaaacaacataataatttatttaatatatattaaattgcattagtagctggtattatttcataaaacacttcaaaagggcctaggcctaggaaatacagcccaacctctgcttattcaatgagcaggataaggttattcaattagttcactatcaaattgagacatcgatgtccctatcaatgttttgagagtttggggaagagccaattaaaaaagcatttagctgggcctgatggcacatgcctataatcccagcaacttgggaggctgagaggcaggaggatcacttgagaccaagagtttaggaccagcctgggcaacagtgagttgctgtctcaacttataaaaaagaaaccagttagtaggaattacacctttatgtaagttagtgaagtggacataagcaagaggaaatggaacagtgggaataagcatttttagaagaaacaatgtaaatgagtagctagaattaagaacatttagagagagaaaggagggccaggtgcggtggctcatgcctgtaatcctagcactttgggaggccaaggcgagcaggtcacttgaggtcaggagtacgagaccagcctggccaacaaggtgaaaacccatctctacttaaactacaaaaattagctgcgtgtggttgcaggcacctgtagtccagctactcaggaggctgaggcaggagaatcgcttgaatctgggaggtggaggtagcagtgagctgagattgtgccactgcactcctgcctgggtgacagatccagactaggagataagatacagaagataattcatttgcagaagggatattagtattgaacgaaaacctagaaaaaggacttcttacccactgggacttttaagtttatttttgagggttctgtgtaactggtgtgcagaattgcatcaaagctgcatgttttcttttctcctaggtgttctattactcaacaggaatcttcaaggatgcaggtgttcaagagcccatctatgccaccatcggcgcgggtgtggttaatactatcttcactgtagtttctgtaagttggatggtttggtaattttgaggggagaaaagaatccttgctacagatgttcaaagatggattgcatgaccctaccatcatttagttacctttttgttgcttaattttcctttgggaaaaagagataaatttaatgttggatgtagtcttcactcttcaagcaaatatgggatggatgggaaaggagggagtatagaagggactatatagtatgctttgaacttggaattggaggaaaggtgcttggaaaaactctcaagctctgttactccactgtttttacactaaaacaacaataatcaacagaagttatctgtgatccccagaatatgtgagaatttttccccgtgaggtgtgcaatcagttccgtagtggacaccatctaggtgtcctgcgattttttaattatgacactgtctacctggagatagcatcagatctcacaggttggtggcccagttcccaagactgccccccactcctgatgccagtcacaagctccaggttgttttacctgtgcttctgactcaccagctgtagatcaggattcccacgacatcctctttgggtttgattaatttgctacagtggctcacaaaactcaggaaaattgtttcctagtttgatttaaaggatattttaaagcacagaaatacacaaccagatgaagagattcacggggcgaggtctggagggatcctgagcatgggagcttctgtctctgtggggttggggtgcactcctagcacatagatgagttgttgctgaccttcctgtcagcttccacgggttcagatatctggaagctccccataccctgccttttgggccttttatgcagacttaattggttctccatgattgaagcatggacaactgttctgacctgtgattggacaaaaagggaatgatctgaacccagctgggcctgtctgcttagatgatttgttggcctctctgtagcgtttcttcctctagggtgtggggcaggaccctctctgaaatgagggttttatgacccacagtcagattagcgtcctgccaagtgggagggcaggagaaagtcagagaagaattctgttatctgaggcctgctcctgaggcctgaagcatcccaacattatgacaaaagactctaccaagggctatggggattttgagccaggacctgtgaatggcacacaatatgtatgtatataaaatcataaatcacaggaggggtatccataacaagtgtcctgctgttggtaaggcagatttcaagtagctcagatgctgttttcatggaaaggaaaactgaagtttcatgtcatattcttcttccagctatttctggtggaaagggcaggaagaaggactctgcatatgataggccttggagggatggctttttgttccacgctcatgactgtttctttgttattaaaggtaggtgctctttgggtgaaaaaaaagggagggggaaagaagagaggttacagttgacttctgtgacacaaggggtgggttgttaaggttgcagtttgtcaataaagtcagaggagagaagcaggatgcccagagtttaagaaacatgggtcgtcagagaactggaggtaaactgttagaatccttacatttatagaacattattatagcttataaaataaattatctaatttaattcttagaataatatcaaggtaatcacacttaatagatgatgacatggtctcagtacaaagtgacatatatgagatcatatagatgggattgaaaaattcaatcctcagctgggcgcggtggctcacgcctgtaatcccagcacactgggagggtgaggcaggcggatcacctgatgtcgagagttcaagaccagcctgaccaacatggagaaaccccgtctctattaaaaatagaaaattagccaggagtggtggtgcatgcctctaatgtcagctacttgggaggctgaggcaggagaattgcttgaacccaggaggcagaggttgtggtaagttgagatggtgccattgcactccagcctgagcgacaagagcgaaactctctctcaaaaaaaaaaaaaaaaatccaatcctggctgggcgcagtggttcatgcctgtcatcacaacactttggaaggccaaggttagaggattgcttgagcccagaagttcaagaccagcctacgcaacatggcaagaaactttctctacaaaaaaacaaaaaaaaattttttttttgagacagggtttcactctgtcaccaggctggagagcagtggcaggatctcagctcactgcaacctctgcctcctgggcttaagtgtttctgctgcctcagcctcccaggtagctgggattataggcacgtgccaccacgctcagctaatttttgtacttcttagtagagactgtgtttcaccatgttagccaggctggtctccaactcttgacctcagataatccacctgccttggcgtgagccacagctcctggccaaaaaaaaaatttttttttaattaggcaggtgtggtggcacatgcttcaagtccaagcgatttgagaggctgaggtgggaggattgcttatgcccaggagatcgatgatgcagtgagctattgtagtgccactgccctccagcatgggcaacagagtaagaccctgtctcaaaaaataaaaataaaaataaatccaagccttttgactccacagccactctttgtattgtacgtcagggacaggaggagcttgccgttaattgcttctgggaacctagatactaggttacactgtctttaaatttaattttctctgttccttgctcttacaggataactataatgggatgagctttgtctgtattggggctatcttggtctttgtagccttctttgaaattggaccaggccccattccctggtttattgtggccgaactcttcagccagggcccccgcccagctgcgatggcagtggccggctgctccaactggacctccaacttcctagtcggattgctcttcccctccgctgctgtaagtaaactcaccttatcttaaaaccagcctatgtaagctgacatgaagatactccttaataatacagtagtctgggcctggcatggtggctcatgcctgtaatcctagcactgtgggaggctgaggcgggtggatcacctgaggtcaggagttcaagaccagcctggccaacatggtgaaattcaaaaattagctgggcatggtggtgcatgcctgtaattccagctacttgggagatcgaggaaggagaatcgcttaaacctgggaggtggaggttgcagcgagctgagatcgcgttactgcactctagcctgctcgatggaagcaagactccatccctaaataaataaaaaaatacagcagtccctcctcttcttcagtttcagttacctgtagtctaaaaatattaaatggaaaattgcagaaataaataattcataaagtttaatttgcggccagacacagtggctcaagcctgtaattccagcactttgagaggcctaggcgggtggataacttgaggtcaggagttggggaccaacctgactatcatggtgaaaccctgtttctacaataaatacaaaaattaggccgggtgtcgtggctcatgactgtaatcccagtgagcgagatcacaccattgcggtagcacacacctgtagtcctagctactcagaagactgaggcaagagaatcacttaaacccaggaggtgttcatggtgagctgtgatcaaccttctgctctccagcctgggtgacagagcgagattccgtctcaaaaaaaaaaaaattcataaatagagatggagttgcccaggttagtctcaaactgctgggttccagtgatcctcccaccttgacctcccaaagtgctgggattatgggcgtgagccaccgcactcggcccagaaacacagattttaaaaataatactcaaaagtccaaaaatactcagtagacatttggaagcatctaactgtaatgaaatggaatgacagaaagaaaactagagagaactacagtaagttagcaatggaatcataagcgaatctgaagaaacctgttttcattaaatatggaagggttatagcttgaagcctattggaaatatgaatgtgaaggaaattgactttgtcaatgaccagatttttatatcaaccttccttttttctgtcctttctctagcactatttaggagcctacgtttttattatcttcaccggcttcctcattaccttcttggcttttaccttcttcaaagtccctgagacccgtggcaggacttttgaggatatcacacgggcctttgaagggcaggcacacggtgcagatagatctggaaaggacggcgtcatggagatgaacagcatcgagcctgctaaggagaccaccaccaatgtctaagtcgtgcctccttccacctccctcccggcatgggaaagccacctctccctcaacaagggagagacctcatcaggatgaacccaggacgcttctgaatgctgctacttaattcctttctcatcccacgcactccatgagcaccccaaggctgcggtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactaggggatataggagaggaaaagtaaggtgcagttcccccaacctcagacttaccaggaagcagatacatatgagtgtggaagccggagggtgtttatgtaagagcaccttcctcacttccatacagctctacgtggcaaattaacttgagttttatttattttatcctctggtttaattacataattttttttttttaactttaagtttcaggatacatgtgccgaatgtgcaggtttgttacataggtatatatatgccatgatggaaatatttatttttttaagcgtaattttgccaaataataaaaacagaaggaaattgagattagagggaggtgtttaaagagaggttatagagtagaagatttgatgctggagaggttaaggtgcaataagaatttagggagaaatgttgttcattattggagggtaaatgatgtggtgcctgaggtctgtacgttacctcttaacaatttctgtccttcagatggaaactctttaacttctcgtaaaagtcatatacctatataataaagctactgatttcctttggagcttttttctttaagataatagtttacatgtagtagtacttgaaatctaggattattaactaatatgggcattgtagttaatgatggttgatgggttctaattttggatggagtccagggaagagaaagtgatttctagaaagcctgttcccctcactggatgaaataactccttcttgtagtagtctcattacttttgaagtaatcccgccacctatctcgtgggagagccatccaaataagaaacctaaaataattggttcttggtagagattcattatttttccactttgttctttaggagattttaggtgttgattttctgttgtattttaactcatacctttaaaggaattccccaaagaatgtttatagcaaacttggaatttgtaacctcagctctgggagaggatttttttctgagcgattattatctaaagtgtgttgttgctttaggctcacggcacgcttgcgtatgtctgttaccatgtcactgtggtcctatgccgaatgccctcaggggacttgaatctttccaataaaccaggtttagacagtatgagtcaatgtgcagtgtagcccacacttgagaggatgaatgtatgtgcactgtcactttgctctgggtggaagtacgttattgttgacttattttctctgtgtttgttcctacagcccctttttcatatgttgctcagtctccctttcccttcttggtgcttacacatctcagaccctttagccaaacccttgtcagtgacagtattttggttcttagttctcactgttccctctgctcctggagcctttgaataaaaatgcacgtagctgaggccggatgcggtggctcacgcctgtaatcccagcactttgggaggcctaggcgggcggtcaggggttcgagaccagtctggccaacatcgtgaaaccctgtctctactaaaaatgcaaaaattagccgggcgtggtggcgggcgcctgtaatcccagctacttgggaagctgaggcgggagaatcatgtgaacccgggacgcaggggttgcagtgagcggagatcgcatcattgcactctagcctgggccacagggcgagactccgtctcaaaaaaaaaaaaatgcacatagctatcaagtgtgctttagcttgaaaaggtgaccttgcaacttcatgtcaacttctggctcctcaaacagtaggttggcagtaaggcagggtcccatttctcactgagaagattgtgaatatttccatatggattttctattgttactctggttctttgttttaaaataaaaattctgaatgtacacg

SEQ ID NO: 36179 - DNA, 17045 bp, Homo sapiens; identical to SEQ ID NO: 36178

SEQ ID NO: 36180 - DNA, 100442 bp, Homo sapiens
aggcagtgagcgagcaggcggcaggcacggtccgtgcggagcaggcgagcgagcgggaagacgcagccaccttcctcaccagccagcccacagcggtttgttccccttctcgggagtgcgccaatgcctgggccgacccaaaccctgtccccaaatggcgagaacaacaacgacatcatccaggataataacgggaccatcattcctttccggaagcacacagtgcgcggggagcgttcctacaggtaatggggctggcacgagagcagcgccggggaccgccgtgagggcgcgcggaaatccagcccgttatataatggagcagacactgcctgcgacccctgctgcaggcatgcatttgtgaaggcggttgtgattatttggtatctgtttccatgtgtcatgttgggtttgcattgaggctccgcgactgcagatggaaagcattttgtgaataggtttgctgccttcgaggggtctccctccatctctttccttccacactgataaaaatgcatgctgttttcccccgctgtccaaagggagacaggcagtagcacttcctttcctccttcccttttagattttaaaggagccattaggtagcagtgccaaaaggcagaaaacgggagggtggggagaaaaacgtttgcgcttaacctggagagtgtgcaggaaagatggaatcctctagattaagctgcagtctgtgatgttaaaccgccagattgatggagctttgtaagaattctgctcgctgattggtgcagggattgacagcagaggtgatagtgtcagacattcaccaaaattttctccatagaaccctaggtttattagaaagagactggactgcaaaggacttgaaaaaaactgggcgctgttatgcattttctaaggagtttatggccaccgcttgggtgggggagcctttccttcttatttacagtaggaaggtgattcctggtcttttgctgaggtctgttttgaggatgggactgatcttggtcattgtattgtgagccttttgattaatgagttggcctgtacggttggcatcatttttacattaacatatctggcaatatgttccagtagataagctcattaaaattgtttgcattgtttgataaggataacaatgtaatggagaatgcagctagagtcttatgcagctcaaggccagacttgaagggagactgatagcttcggtcatatttcctctgaagttcttttgtactggggtagttatttttaaatgttaccttgataaacgctaacaatgcttttgctttgaggcagagcacacatacctctaaagcgcatcctctcagctgatgagcaacaggaaataactctttttttcctttttagagccgtcatctaaacattcagatggtattatgggtagaatattgtgtgtgtaaatgttgcatatcacaaaatagaaccagaaagtaccctacttcctttctctttggccaaagaaatgcagtatttgttgactcaaaaaaaaaaaaattataagcaacctttgccctgtcatctctggcagttacataaatacttggagttaattttggctgtgcccatgaggtcaccaaaatctcatgccttatggttccaactaatgtgttgatatggcattcttacagatttcaagtgcttgttattcacttaatgtaaatcaaaattcctccacaacttctggagatatcctttcagagaccctgtgattggaaatttgggcctcttctcctcttactcctccacctttttcctctgtgaccatcccaaagcctaaaaatagaatttaaaaacaaaaaacttgaagtgattttaaatctcactagtttgaactttttttgtagaaaataaatttgaagccttcattttctaaatgatttaatccctgctgtgtaggtagcagttgcttttaagacagaattcgaattttaccccacgggccaaaggaagttgcctggttgggttttattactcatgtaaactaacttgaaacggcagtggaaaatcatttgacagaaaggttaaatgttacgttttggtgacagattattgctttaaaatgaaattttatttacctctttaattcaacccaggctattatttgcgtttcctaaattatttgcagtttgctttctgagtccctataatggcattcaaaattatgtaaaaaacaaaactgaattttaataaagatcttactgaacaaattcttaagtccctaagagcatcactgcatttgtatttgatataataggattactggatgatatagcgagaggtgtcataggctaaatgaagaaggaagcctctcaaattgcatttgtcttgtgttatacaaagggtgcacatggagacagacacattcgatgtttttcttcttctgtttttctttcaaagtggatgtccagtgtaataattaccacttatttttttggaggggcataggaaaaggaaaaatgtgacacatttttctatccaggaagcattccatcattattttggcatcccaagactggaatattatagccatttaattgctgaggaaacttggaaggcaatttgaaagcgaagagtagagatttaaccaaataaaagttttgccttggctataggtttggtatggccctcaacaatgaagatgtgcctggaagttctgggtggagtcccttatggtggggttggggttgagtgagcccagttccctggcaagatcagagggaattctttccctggatcctttattgacttctaggtaggcccccgaacaggtctttatcttaggctttcttttcttttctttttttgcgacagaattttgctcttgttgcccaggctggcatgtaatggcgcaatctctgctcactgcaacctccgcctcccgggttcaagagattctcctgcctcagcctcacgagtagctgggattacaggcatgcgccaccacgcccagctaattttgtatttttagtagagatggggtttcaccatgttggtcaggctggtctgtaactcctggcctcaagtgatccacctgccttggcctcccaaagtgctgggattacaggcgtgccccactgcacccagccttaggctttattttctacctttgcctgttgtatataaaaatatctagcccccgttgttagagagatattgtgaggctaaactccatatttaaaccaagtaatttcctaaaagagctatgtaacataagaatactgttgttactgaaaaagggctcttgcaggggctcttggacaagaacatgtctcaccttgctggcagcacaggtgagaagaggagggaacacctagaggatagggtggctctcctgagcattgttaatgggcaagcagtcactctttggagaaggagacattactgttatagcatttgcaccatattgttcataagtatgtcaaatttggttcctgacccacatctcttaacccaggtatctgatagtgtaaacaaagcccattttcacagcatggaacagagtgggtggcagctcattattgaaactagcttgcaccttgattagaaaagcaagcttcctttagaaaattacccctggattagtaattccaattgaaaagagtaagtacaaaaatggcttagcagactcatagagacatgttttcactcctgtgtgatttccttctcagcctcagcttcctcactgtgtttatgaatgctagaaatctatgtattttaagacctgcttaaaaaataaatgtggtgtgggccatccgaggtgacactgtttaattcacagagcgaatgagtcgtgctctggatctccctggagaggatgctccccatagctctgtttcatgcagatgctagttggaaatgagatttattaactggctctctgcccactgcatctttgtttgtatactccaggcttttaagaatgaatgtataagtctagaggactatttccacatgggtgttttgagcatgcgactacagtagcacatgtttctgaatactttaaaaaaaaaaattacttggccccaggaaatggattgcagagaaaagcaaaactaaaatttaagcctaaagcattggccataacatccagctttgccagttttaaaaaacatgctgttgttaaggaaaacaaagagaaatatcgtaatattgtgcatgtgtgtgtgtttttttgtgcacgtgtgtgtataaaagagttgtgaaagtgtgttccattcaatagaggctattgtaacatggctcacttttatcagaacataggcttcacatcacattccccaaaacagcagttatagattgcaaaagtctacgttcatgtctttattatgtatttgttagtatcatctaggtttaatactgtcaaaggaggttttccaaaaataaagatttttgtccttactatttttcttagtgtttgtaaaaatcagaagattacttgatgctttagtacatgcccaactctggaacttcttttacggattttcagagcttctgttaatggaatggtcttccgggtgctcttgctttggggagaggctcactcctgctctgtagctggtatctgttgacagtgcattatcttagagcagtgctgtgagattgtcctctggaattcagaaggttgatttccttatgcagcatcttttctttatttacagggacctcttgaagctgcagtgaataattctagattaattggaaggggaaatttgggactaatttaaatattctgtttggtttagagaattaattaattttacaaatatttgaaagtctgctctggccaaggtctgtgctagatgccccttgaaggatcttgagtcctagtaaagtccgatggaaaaccgctcattttgtaaaagacttacagtgttggtattttgcttagtctgatagcgaaagtggtttgcatttcctgaacccccagtgacccaaagggggaaaaaaagtttctctgaagtccagtgtgctgtaggaagctaaaagacactgagagaaaccagaaattttgctgaaaagaatgtaggctttaggatcaggcagaattttcactggcctggccaggtgtgttgggcagtggtagaaaataaaagcattgaaaagcaggcggggtagttggaacttggaaataagaagctactgaaagtttattgactgaagatagtgtaatgaaaacagatgcctactgcagtggatcttcagttttgaaatgagagctaaaaggaaaacgggatcccaatgcaccactgtgtgggtctagaatcactagaaaatacttaatgccatgcgagagcttgagccctctaatgtgcagagatcaggactaggtagatgttctctggctcaggatgtctttccttgagtagaagcaatgaatgcagctttgttccataatgagactggtacttagcccagacagtggcttttatatttgcagatgcccacttcatagctatcagtctaacttttaggagtggcaagtgtggagagctgccactattctgatcttcccaaacaatgaaccaggtttctggttcattatgaagcatcttcccttggcatttaatgatgtaaaaagttccgatgtggctgatgaaactgctcaggacactccctgtgactttggggccaattcctctgacagttagaaggttatcaccttggtggcagactccagagtggatggagtttaccctaaatagtgtgtgtgtgtttacttcttattttagtcaatttcactttaaaggacaaattgattttcttctctcctgtgagaagtatcttttttctacagtgaattaagttagaatatatatctaagaacagttttattcttcctgacttcaggccatctttcagctagctgcctctgtaatactacattgagtatgtcaaacttagccaatatctgaagcactattccaacagccctttttctttctaacactccacacacatcccattggtatcatacaaaccttgtttcttagctcattttaaaattccgattgtttatcttagtgtttctggcccttggtctttattattagattgagagaattctctcaaagtggaaacctacaattcacataggcaagaaattatgcaacatttaccttatagcataaatcaaagaaatttctcctaaatatgtttttataaaatgcctccccaaagatgatcatttactttaatgaaaataaatcattagcaaggtaaagactgaacagagttttataggccaccaataaataatttcttagtaggttacttaaaaaaaaaaaaaaaacactgtgttttcagtgtcaaatctccccaagtgaattaagattttactcacttgaaccaggacagagtttcttaaagaattactgtcttttctaagggagcagaagtttgtgataaatacatgaaatgatcaagttgacagctttgagtgatggtgtcctctaatgcttatctagttaagaaaatatggcaaaaactcaaactttctgtgatttctaggcctctctttgttccagcaggtaaaatgaccatgctggaagaatctgattttagcaatgactttggaacagaaagacaacatggcaagaggtttaattggcttacagttctgcaggctgtataggaagctggcaccagcatctgctcagcttctggggaggcctcagggagctttcactcatggtggaaggcgaagcgggagcaggcatgtctcatggccagagcagaagcaagagagagggagtggagggggaggtgccacacacttttaggcaaccagctcatgtgagaagtcactcagtgtcatgaggacagcatcgagctatgagggacccgaccccatgacccaaacacctcctaccaggccccacctccaacactggggattttaattcaacacaagatttagaggggacaacatccaaactatatcatatatttatatagtattaacacatatactatatatgtgtgtgtgtgtgtatttatacatatgtacactatagaaagtatatatacacatacatatatacttttagaaagtataattatatatgtgttacatatagtattaacacatatactacatatactatattcacacatatatagtagtaacatatatgtattatatatgtgtgtatgtatactatatacacatagtatttatagtattaacacatatactatatgtgtatatgtgtttatagtatatgtattaatactatacgtacactatactatatatactattatatatagtgtatatatagtatatgtgttaatactataacacaatggtgagaactgggcatatatagtatgtgttaatactatatataacacatatatatgtatatataattatactttctaagattatacttcctaaaggcattttggctatccataaaaatttatacagaagaaaatacaaatttttatagaaattcacattttaattgtgtgcaaaatcgatcctgaagtttatggccaatgtttgttgttgcgtatgactaaaaagatggtgctgttgatgtgagacacactttagatttctgtgatcctatttcatttttcatagaagtaatacttgtttttgttttgttttgctttaaagacattaattttttgttctttatttagtgtcagcctaccctggcaaagccctgggaggtaatttgtcaaaaacgccaggtaatttgtcaaaaaacatctctgggaggctttcttatgttcacagctatactttgattataaacagtggtatccctgattgaagggccctctgtgattccctgagaggtcttcatttggtgctgtgcaagtcaggagaaagtgaagctaagtgagctccttcccccactccctcacgccatctacttcctttttatcattttggagtgccagaaagtgttttcaggttctaataatgtcatttttaaaatccccactcttgggttttacacaattattgttacattaaagtttaagccaaaaatccttctttcagcagacttaccgagttcctttaatgtgccaaccttcctccatgctgggcccttggaatacaaagataaatattgcacagccctcccttgataagaacctccaggggcctggacagtgggcgagagtacgtggtgggagggatgtgagatggagaggttcccacacctgaccccagagtatacacagggtgtgtgttttgttttttgctgaggtgtggctgtcattggttcagaagtcttcctgatacttgtctgaataaaagtaattttgtgattattgtgttgatacttgggaagggcaaaattatcactcctataattttcaaaagctttcagaaatgtagcgtgtaagtaaaaatgtgtgtgtaccctactatgacctctatatttgtcttacgaacatagccttgaggcacaagcttgggcattgttgagtgatttttgtggcaggaagttcatttctgcttttcaaaaagtcgaggaaaagtaaaaggcttatttatctgttttgctcttccaatttttatatttgtattggtcatcactaggttaaaaatatttcagtatgctattacataaaaagtgaaaatgagatcatatattcatactttattcatagagaaactgaaaggatataaactaataatggtaagaactgggaagattaatcactgtgtacctttttatgttttttttttctaaactgaaactaaatgcattacctcatcaatcagtgatgtttcaattagccctttaatagcataggtttttaaaattaaataagtttcagtttgaacttaatgaggtttacatgttgaaatatgttaggaaacatctgatagatactcatgaacttaccaaagtcacatggatgacagtaaagatttgcctaatgcaagtaccattcttacattaaacatcagtagtcacaaatgaaatgtgctcctatagcatctgcctcatttagccctttgaggtttcacacatagcaatccatagtggagattttgtttcattttctccagagtacattgaagctgcctgtgtgttttgtgatgcgtccagcctgtttagtatgctctgtgaatcttacactaactgcaaaataatactctgtgaggattattttaaaatatcctctttgcatttttgttttcttctcatttatcaagctcctgccatttatcaagtacagcaaagggccctaaaactgagattgcaggtaattgccaattttttggccactctgagtgcagtcctctgtcctcctccaactcagcctaacctcccaccttagggaacttaattgggcaatatctggccttcatgtgacccctgtgtgtgatgacggccaggaaacaagccatctgcattcaccatgcatttctgtttcagccctctcacccaggagtctgggtgaaaactgagagaacccccagggagactgaccaattaagaaaaaaacaagaacaaagctttgaatatattatcctcagtatagggacctgctcactgtcagcaactctgaaataaaaaagcttgtggaacttacgagctgaatgtctgctagaaaaggaggaagcagaagacaggatcattgggagatggagtgtaatgggaagtgagtgcagcatggaggacagtgagggtttcttggggtgaacatgccagcctctagagagagtttagttctctgcctccctacccccaccccatctctctccctgtcttttcaagggcagagtaaaccttcccttcgacacttgttctccaaggacagaagaaaatgaagagctctgtgttagcctaggcaggggtctggcaggagaagggaaacaggaccaacaagtctctcccaagtcccttaatggggcctggaatacacagtaaattgttaagtttgagtttgggaagccaatttgggaagccaaattgataagtttgggtttgggaagccaatttctttccccctgaaatttttgacaggcagatagcattgtcataacaatgactttaagatgtcagcatgtacctatttccagcctgtatgataagtgtgtcactgctacctctactccagttcaaaatttggtctgtaccgaaaagggaacctggattgtcccctacctcctttcctaacctccaggaggaccagttggggtcctcaaagtgcacagccaggaagttgcttgaagaggcagtgaggtatagtgggcaaagcttggctctggtgtgagacttttactttctgtcccagctccatccctttctagggcaacatttttttagcctctctaagcctcattttcttaccgtgcatatggaaataatagtagcatcaacttcccagggttcttatgcagattaaatgtgttacagaacataaggtgtgccaaacggtgcctggtgcaaagtaaatgcctcaaagaatgttagctagtattattgcttgcagcttaaatctactcttttaccctgtattgataaaaatctataatctttttgttctaagtaccctgtacaatactttgcacatagcagatgttcattaaaagttcaaattgaacctggaaaaaagtcaaacaaattatactacagtcttttttccccctcatcaactttattaagaatttatgtacagtaaactgcagccatttaaagtgtctgagtcagagttttggcagtgtgtccaccctgaagccatcaccacagtcaagatgcagaacatttccatcacccccaaaagactccttgtaccctttgcagtccaaatcttctctgcccaaagccccaggagccagtgatctgctttctgtcaccacagattagattacattttatataaatgggatcacagagaatgcactcattagtgtctgactactttgactcagcacaatgattttaagattcatccatatgggatgtctcagtagttcatcactctttattgctgagtagtatttcattgtatggctataccatattttgtttatctgctcaccagttgatgaacatttatgtttccagtttttaggaattatgaagcaagtttctatgaatattgttatacaagtctttgtggaggtgttttcatttctctggggaaaatacttaggagtggagtgattgggtcatatggctggtgtttaactttttgagaaactgtttggcaaacagttgtccaaaatggttgtaccattttacattcctagcagcacagtatgagagttctgattgtttcacatccttggcaacacttactatcagtctcttaaatgttggccatccttatggatgtagaatggtatctcattgagattttaatttctattttcatgatgactaatgatgggtatgttttcatgtgcatattggccatttgtgtgtcttctgtagtaaagtgttcaaatctttttccatttaaaaaaataggttatctttttaaatagaattatacacatatgttttgcataataatatagtcttgaattgtattttaatatgtacaggtcttatattcttaacttgaatataaagtcccccccacacacacacacaaaaagacctagtctttgttcacaatgacttttacagcaattagttacatggtccatcctcagtaagtacatattaaatgagtctatttagcccgggcactgtggctcatgcctgtaatcccagcactttgggaggctgaggtgggtggatcacttgaggtcaggagtttgagatcagcctggccaacatggtgaaaccccatctctactaaaaatacaaaaaatagctgggagtggtggcacttgcctgtaatcccagctacctgtgaggctgaggcaggagaatcacttgaacccaggaggtgaaggttgcagtgagccaagatcacgccactgcactccaggctaggcaacagagcgagactccatctcataaaaaataaaataaaaataaaaaaacagtatttaatatgtaaatagagggtaaaatagtaacagaataattattttagctgagaaaaaaaaaacactgaatctaccttagaagttttatatgaacatgttacatttgggaggtagtcttggtagataggagatgctcttctagttctgtggagaagaaccctataattaagacattcttttctttgtattgtgtgtccccttcttgctagattccactattaaatttaagaggaaagtgtgcatagaaaattttttttctttaattgtaacaaggataccatatgttctcacaagtggcagctaaatgatgagaactaatgaacacaaagaagagaacaacaggcattggggtctacttgagaggggaaggtagaaggagagagaggagcagaaaaaataactaatggttactgggcttaatacctgggtgatgaaataatctgtacagcaaacccccatgacatgagtttacctatataacaaaccttcacatgtacccccaaacctaaagtaaacattttaaaaactaagtaaatgaaaagagggaggaaaaataaatgtaacaaggagccatttgcatgcttccaaaattttgccaagaatagccaaagcgttggatgccccccttttaaaaatttttgtggtgaagatccctaaacttgatctctttccattcccattccatctaatttggcagttttgttgttgttttgctcctgacttctctaactccctaagaagaaattgtctcaagtaaaatttagagactgggaaacaaaagcttagtaaggtcataggtttgcctaaaaggatcgactgagggacctcgttttggagaagatgaggatccttggctcccagaatctgttcagaaatctttccagctaaaagccagtttcttaactacatatgtttcaaaatccaaaaatgcaaagtttaagttcactaatgatttcacaaatgtcctaggcctactactagatttcgtgggtgccacttatttcgtttaacatttattcattttattgccaaaaggttcaggccgaatttcaggtgagtcgctgcctccatggtggcggcagtcagatgattctctctgttctggttgggactgagtggaccacagccactcaaggatcccttgagagttgcgagtgttctttttgatttgaggatgtgccgtgaacggaagccaaatactaatagacaggacatcctgtgattcccttagtttacgatggccaaggatgtgtgggtttttttgtttgtttgtttcttttttttgataagatgattacttggtttttttcctgttaacaagggagcctagatgatgatgtccatttggcttttaggactcttaactagcaaacaactaagcccctgcaaaatcacatgaagacattggaaaatctttttatgtaaggcagagatgatttggtcatagttcgcaatgaagtgaccgtcagttctattggcttgaaataataatgaaccaaagaggggaaatgaccgaagtcgaagttcttgaaattaaggatgttaaaataaaattctgaaatctagtatactgtggtatacctatacggttaagtattatacaaatattacatgtgaagaaaatatgaaaaaagttcacaaatgtaccaatgttaacagaagcaagatgattattacaaacgcttatatggattatattagttttccagggctcccataacaaattaccacaaaccgggcggcttcaaattgatcctctcacagttgtgatgccggaggctagaagtctaaaaccaaggtgttagtaaggccatgctccctccaacagctctgggagacccttccttgtctcttcccgcttcttttggcccccatgtgctccttggcttgcagcttcatcacgcccatctctgcctttcattatcacctggccttcttcatctgtgttttttacatggtcgtcttttaaggaaccagtcattggagggcccaccttaatccagtatatcctcaccttaactaatcatatctgcaaagacctttttccaaataaagtcataatctgaggttccaggtggatatgaatcttgcagggacactattcagttctctgtgtgtgtgtgtgtgtgtgtgtgtgtatgtgtgtgtgtgtgtatacatatgaacccatttttataaataactgtatgtgtgaaacacatacacacaggtacccctcaccagacacacataaaagatgtttagggccagatgtggtggctcacgcctgtaatcctagccctttgggaggccgaggtgggcggatcatgaggttagcagttcaagaccagccagcctggccaacatggtgaaaccttgtctctactaagaatacaaaaattagccaggtgtggtggtgccagcctgtaatcctacctactggggaggctggggcaggagaatcacttaaatccaggaggcagaagttgcagtgagccgagatcatgcaactgcactgcagcctgggtgacacagcaagactcttgtctcaaaaaaaaaaaaaaaagatgtttaggaagatatgaatatgagtgttataactgggtgatggaacagtggaaattttaattttattttttatctgtattttctgcattagtgaaaatggacagatttttttaatagaaaaatctggctttttgaataaacagtagcactttgacatcttaaaaaaattgtagatttttatttttactagcatcctactttaagtttgttgttactttgcctcatccaactttaatgaaatattttaactttaaataattaatcctttgtagcattatacatatataaatatacataatgaacccattaatatatttgtgatattaaatgtttattatgcttattattataacaatagctaaagctgaaataatataaagtaaaataggtttttgagacattgaatcaaccagtgtgattgtcaggtttttggtttaggtttggaaagccaaaaaaagaaaagaaaacttataattcttactcaattgctgaactcaaacctttttttccttaaaaatgtttttaaagtctctaaccctaggaacctagaaactcggtatggaggcaggatggggagggactttaccaaatttttaaatttcatctgttcaaattggctcaaatactgggtaacttttaacacatgtatctactctagaactacttcatccactgacccttcttatttagacatttgtgcctatagtaacatctctagttatttagtcaaaaagtttactaggtcttgtggtaatttcctttttcttaattatctttgaatgcttattaactaattgttactgttctgtctttatcccaagtttaacaaaacattctcaattcagtaatgacccctatccctaacatttgttaaactactgcagtatactgtattaaaaattttgtcctttgctcctgtaagtcctcatagcatagcgctgcagaatctaaagaggagactgcagttcaaaaagcttccctgcttccactgtccttcccaaacccatggtcttaccatgtatctgcccctctgtttttttgtttgtttgttttgttttgaaacagagtttcactcttgttgcccaggctggtgtgcaatggcgcaatctcagctcactgcatcctccgcccccctggttcaaggtattctcctgcctcagcctcccaagtaactgggattacagacacatgccaacatgtctggctcatttttgtatttttagtagagatggggtttctccacgttggccaggctggtctcgaactcctgacctcaggtgatcaacccgcctcagcctcccaaagcgctagtattacaggcatgagccaccatgccctctgttatttctatacctgatttggttcaaacatggcacaatttttatctgctttttactggaatgctcagtttctgtacttccctttgaaaattgtagtgatattacactgatgctagaaatgttgtaactttacgtttgacctgtgacaaggtagtagagaaggagagcagagagatactgcaaggagtgtgtgcgtgtgtgtgtgtgtgtgtgtgtgtaaactgatatttgtcaggggctgctaggtacttctaatgcaaaagtctgtcagttcattcttcattccagtaaataaataaagatgtttattgatttaaaaaattcttcttctgttccatatacaatatatacaatgatggtatctggttgcccaaacaagagtaccagaagaatagggaagggaaaagaaggatgaactctgatcctgggatggaattttaagaagatacagggaaatccattctctggctgaaatgagagaatcatttcacatgggaaaagaagttttggggacgatgccctacgaagctggtagtgaaataatgctcctagttttgatagtatttccccactgctccaccaacttagctgaacatcgtttatcttagctcagctgtagcaatgaccaaaatttccatttgctactcatcataaagtgcaggagagaacctgtcttgtatataatttgcagtttcttctttggggctggagcatgggtttgatgtagaggcagatcagtaccttgccaactgaacccaaggagttaagtttaatgttgtgctatttcccagtttgaagttttcaattttgattctgtgtcagagtctactatggaaataattaagaagagtagataagcacaaatatggctgggggcataaggatgtcttttggagtcagattcactggaatattttttgccactggcctgtacttcccttgtcctgttaataagcttaattttattggtacttcattttccattttcatttcaaaatgttctcatgagtttaaaaatcaattttaccataatgtaaatacagacctttggataggcaccaatctctaagagtagaatactgagaggcttgtctatttttttttaaggaatagctttttctaaacacatagtcaagataccaatctgaagtctttcattagctttgaaaaaattataagcagtataatgtacatggtctctgtccattttgactaatttaccacaaaaagcaaattgagaggcttgaacctcaaatctgtagtaactagaaatgcacgatgtgatgactcctacgatattaacataccttatatgttacagctggcagatttgccagccaaaaattcattcccagcgataaactgagtaactagccacccaaatctctacattttgagcttttcttcacagaaacttaaaatcatcttggttaaagtgaaaatgtaaaatgagatcttggtagaatttaaaaagacaaaatggctttattaaagaccacaattgtgtcctcacttggaattattttttcttcctgcttaatctcatgacataaacacaagagcagggagagtctcaattaaaagcaagaatcctggaattcatcctaggtccaaatccctgctttgccacttaataatggtgactagacaagtcactaaacctctccgagtctgtatcttttcctacataacataaaagcagcagtgatcacatggcattgttgcaaagattaaattaaaaaattcctgttttactctttcattaggcatgtggaaagttttcaataaatattagttattgtaacttctaatctagttccccttgtttactagtgaagaaaaggagatcccaaagagttgagacacatgtgcccacatttatccaactggttgatagttctggaactagaagctgctgcccctgatgcctagaacagagctctcattaagctgcagggcagctagggagcttttggtatctgtgttccagacatttccctactcacctttaaaaaaaaaaaaatgcctagaagacagggtcctttaattcactcaaccctagtctgttcctagccatctcacatagcactaggggcacgtattgatatttgccttttgtatgatttggcacacctttgtttgcattcattcagcatttatttattgtgtacctactgtgtgccacacacagttccagacacaggagataaagctgtaaacaaaacatattctataaagtttctgccttcatagagcttacatcctgggggcaagaggagtggacagatggtaaacaaacaagataattaccaatggtgttagtatcaccgagggcagagtagagagatgtgggagtaactggaagcggccacttcagaagtgggcatggagggttcactggggagttgacatttgagccaaacctgaagcatgagatgcagccaaccctgccaagtgctggaacaagctgctcttccgtggcatgaggtcttgagccccagttatccctaaggatgaaacttgaggctttgctctgtcatttgtttcttattatgagaagatttagaaaaagcagacaccgaagtacctgagaaggaactagcaccaccaagagtacaagagagctcagaaccaggaggtggggaccactcctacaaaatgtgtgcaccacaggactttgcctagtggcagcatgattgtttgatgaccgcatatgcttctgctatattgcatgcgcctgattttatgcagtggactaacaactgagcatgaccacccactatggtaccagcagcacctatgtcctgaaaggttgacccagggccctgctcgttgggggcagcgtgggcatgactggaaaagacctgggatcatgggaaagagctaaggtcagggtaagagggaacgaggccaagtagggctgggaaagtaaacagaaggcatatggtcaagaaggagtggatgtgctgggagctgagttggcgggggagggggtactgagaaaagttggtgccctgaggagaccagccaagccctgtggcatgggaatgagctctaggtcattgaaattattttcagagcatggacgaagccacccactgctagaaacagatggacatttaggcaaatataatcagctgcatttctgaccatatgaagaagcgtatgtctatgtggggcagggaagggttagccttttactctctcattgtacatgtcaagtttcattcatatccatggacgttatgaatgctacaaagaacttttttagaattccaaaattttgtcataccctggataggagccaaatttccaagtcatttcagggctgtagctattgacttgttaagtctgagtttagaaaacaaaacaaaaatccacccgtatatgctgttttgaaagtttgtcttttttgtttagttacgatagggtggctagccaaactaagccctgtatgcaaggagctgcctaatgaatagtagtggatgaggttaatgcagataaataacaatgaggctgttaaaaatggagttgattttcaaggtgacttacggaatgtcctattgtaggcggttggagacacctgtgttttaatgatattctgttggttttttttcttaaaacatatgtagaatacttggtgatatggcaagaaagagcttaatctccgtgttttgaaaaataatcattaatggtaaaagggatgggcaccctgaaaaagagtattatttttatgttcattctctcttggaggtggcagttattagctgtcgttaggagttctgattgtcagactaaatggaactttgtatgcacattaaaagcattatcattaagaagtgactgataatgaagagcacattcatattggaatgataggcagcctggaaaagcctgcagtagagagcaagcacctcaaacctgataaaactcacatttatctcatcttcctctaaacagcatagttttgaagattcttacattggtcttcttcactagttctaaaccatcaatgcctaattttgagagaaaaaaatagtatatttcagtgtctatattttaataaagtatgtgcatgttgtcatatggacagtgtcctgatatttctccatcatccttgtgtgaagtcagttccgtgctcacacccctgccacatggagaggcccggccgcagggagggtctgtgcctggaggagttggtcttgcattgtctgtctaatcccatcacagtcatagagccccgtaaaaataaaatacgtgcaggtctgcccacagcagcttatgtgtgctattacctggagacaataaatgacttcttaaattcccattccagccctagaatccatgcatacggcaattagtccacaagttaaacagaagctttaatacccagttttaggcgaaactccatagttcctgtaatctctctccaggagattttatcctgtcaaggtttgtctttcagagacaccctctttgactccctctttgctccatcctgatctccctcctcaaacaaatactttctctgtgccccacattgcaggtcacaaataaagagaaagtgatgaatctagaatgatctggtgatattctttccttgggtgaaatgtttaaatcctgcctctcgaggtattgaacctagagaatgaattatgcgcagatgaaaagcgggatatttctggttcaggagacacatttacactgtccctccctatggaagcccagttcattattaggggaggctgtgggagatttaacatcagccttttgtggtgaggacgctgggaaggaggcacgcaggcaggatctgtgtttacaaggcttttcagaggaaaagacgtttggggggatgtctgtgatgggactgaatatcttcattcccctccggaggataacatatattctaatgcagaagtagtctttgagaaaaacttttgaggtttcttcctttggctaagtatttaatctgtgggcatgaatgtacaatttgcaggttattttagaaagatgccacttctaagagaagaaaatattggtgattgataaatctctttttaaattctcataatatttgcagatacttagaaatgtttacaaaacggctatttctgttagaataacacaaaattcttctaagtaaaaagccttctttacaagcgcatttgaaataatgcacctcactttacctgctatgctggaacaggccaactttggcaatcctaaaacctttaaccaggaacaactctgtgaaatgagaactgacagtgtggccttgacctggaccgagcgaaagtccagtgactggcaaagaaagccattcttttggatcacaggtccttctcccctgttggcatgtgtagaaacactttgaaaggatctcaaacacctagtcagttggacttaatttccaaggaagcatcgatatttctaaccattaccttaataaaccacttgggttataagaaattcagaaatcattatatgctcaagcccaaagaaataagtttcttaggtgaaagaaaaatatactttttctttatatctctcttctagtctgctcgttgtttcatttatgtgaaactgggtgaagaatgcactgcatgtatttaccctaaactgttggtagtggattactttccccagtgatgggagaacatgttgaaaatagagattgttatgagagaaaagaaagacagtcacacatatcacacatatgggtatggttgtcactgcaacatgtgtgaacagagtacattggcatgcggtgggttgaactttcagaacttttgttgttgttttttttttgagatggagtctcactctgtcgcccaggccggagtgcagtggcgcgatctcggctcactgcaagctccacctcctgggttcacgccattctcctgcctcagcctcctgagtagctgggactacaggcgcacaccaccacgcctggctaattttttttttgtatttttagtagagatggggtttcaccgtgttagccaggatggtcttgatctcctgacctcgtgatccgcccgccttgtcctcccaaagtgctgggattacaggcgtgagccactgcgcccggcctcagaacattttatgttgaacatgaagtttccagttgaatgtggactcctttaaggagtgacataaagaaggtaacttaaaaaaaaaaaaaaggagaagaaggtagcttaaatccaaaaggccctttaaaggctcagcctccaagtgggtttggtataagtaaatccaggccaaatggggtctccttgcagcgcagcagatagcagtcaaccacttatggaggctgttcttctgcagatgaacttgcctgaatttgggaagtttggtaaactcagactttagatgatataaaaacaaaaaagtcaggctgggtactgtggctcacgcctgtaatcctagcactttgggagcccaagacagaaggattactttttgagcccaggaattcatgatcagcctatgcaacatagtgagacccctgtctctacaaaaaaatgaaaagtaagctgggagtggtggcacacgcctgtagtcccagcttcttgagaggctgagctaagagcattgctttagcccaggagattgagcctgcagtgagctatgatggcaccactgcactccagcctggactgccgagtgagaccctgtctctttaaaaaaaaaaaaaaaaaaaaaaaaaaaaaaaaatctggccaacgtgatggttcacacctgtggtcccagctactcagggatgctgatacagtaggattgcttgggcccaggaggcagaggttgtgagccaagatctcaccactgcattccagcctggactgcactccagcctgaacaacagagcaaagcctcatttcaaaaaaaaaaaaatcaaaataggttccacattaaacccttttccttatagccacacacctcaaatgggaccagagccagatcccgggacaacaactggcctatcatgaaacctgctggaaaaaatatacatatatgtatatatactgttttgtcctccaaaatgagtgatcggtgaagtgtgaaaagagaaaatgaggacaggcagccccctcccctgaagtatggctgatagtgtgtttgcaaggggtggggcagggcagagagacaaaatgaattacataggaaataatttcagttaacactcataatgctagctagcacatattatatatttgcttaattttgaagagccacttctctggaataattcacaaaccttgccaaatttgttcttgaacaaaattgttgagtattttgtagttaagctttaggtgcagaactggtaaaggtggtagaattcatattttgctcagtaggctaactcaggtctcattgactcacataaaactccatttattgtagtaagcagaaatacagtgtctaatgtgtctgattcaatcactactgcaaagcataaccttgctgtacctctccacccaacaccaccgccaaatactgaataaaggatgaaactgagcaaaatctacacattggccctcagctggaggctttcctttttctaaagtcatgtgtatcagtggtcactatccacagacaagctagaatcgtgactttgcctgctagaggtctgaagggatttttgttttttctgtgtgtttttctctcttctgtttgcaaaacaaaacaaaaaaccagctgggtgtggtggctcacgcctgtaatcccagcactttgggaggccaaggtgggcagatggcctgaggtcaggagttccagaccagtctggccaacatggtgaaaccctgtctgtactaaaaataccaaaaaaattagctgggcgtggtggcatgtgcctgcaatcccagctatttgggaggctgaagcaggggaattgcttgaaccagggaggtagacgttgcagtgagccaagatcgcgctgctgcactccagcctgggcgacagagtaggactctgtctcaaaaaaaaaaaaacaaaaagtgtattcccaccttccaagaaagctattctaatattcatgtaaaaagtgtgtaactatattgtgattattagtttattttcaagtaggggcaataaatgcaaatttgttttaaaataaaatttaaatacaatattaaagtgtggtgacccagggactgcagtgctaggaaagtgttcctcccttatctcctgcttgttgtgctgttgcactgaccagatctttatttttatttatttatcttttttatttttttttgagacggagtttcactgtcacccaggctggagtgcagtggcccaatctcaactcactgcaacctctgcctaccgggttcaagcgattctcctgcctcagcctccctagtagctgggactacaggcgcatgccaccaaacctggctaatttttgtatttttagtagagacaggatttcgccatgttggccaggctggtctcgaactccggacctcaggtgatccacccgcctcggcctcccaaagtgctgggattacaggcatgagccaccgcgcctggcctgcactgaccaggtcttaaacaacacagtgatctggttgagattccaattgaaagccacaaagtgggagacagcgctttgactttctcctttgcaaggatgggacagagagatgctcatgtcccagaggccatgtggcaagtcacctaagaataaactgttgtttccatgtaaaagacatgctgaagatccaaacatgagaataaaccccgcacagtgagttgctccttgttctgtaatagttagtatgaccttacctttcataaccatttatctttcttgactgagtctttgggaagtactccatgaattaaaaattagctttttgaattgtataattcctaccttccataggatgttgatgtaattggtaatatccctaaggactagcagtcgtgaattgaagtttgtgtccacttttgtaagggaagagtatgattcctgccctgctttcctcccaggattcttccaagggtcaatagaaccactttatctctaaaaagatataaaatttccttgtgttatccacacagcatttctgcagactaggtagggacaagtacttttacctttatattgtcatatagattgagaccccagaaatcataatgaaatcttaggattttagaatgtatccacctagggactaggacaatttaatactctctcacctgagtttaacatttggaaaaaatatataaatgttctgtgaatgttgtagccacttgtatcatttaagtttaactatatggaaagcatacctgtagaaaaagcaggagctgaaagaattgggaaaacaaaagggtggatggcagtgcaggaatagaatcctttttccactttggctgacacttcacttgcgggaggttcaggacagttccccttccagggaaagtgagtccagactcagaactctcaggcctaaaatcggaaaagctggcttgtttgggttcggggcaaacattgggagcaaagacagccacagagtgaagtgcgcttagaagtaccttgctgaaatttggaaagaggaagatcgattataagaatattcccatcagcaggggtgttaaatagaaattaactatattgatttcattgttattaatttgaagtaggtattgaagtctactcatttaatgtgttgttattttattttaggaaatggtgaaaaatttcttgccttcattggttcacttattcttaatctgtcttctaaactagttatcccacaggtcccttaacacatggtagcccctgccacagggcttgtgaggactacagctgtgttggctagcaatggtggagatttgagtggtatgcctggtaactaagtacccagaatttttctaaagcccagatctggtgctgttttcattgtttacctgatcatcttaatgaactgcttgaaggcagatagtgccttgacttacctttgtgagctgaatgtctgtttacattatgaaaggacaattgttgtccttaagtgaatgttatcagcaaagacctggaggaaagtgtgatttattgacaaactgcagcaaatgacctgcttccttgtttatatggatttttaaaaagctgtcattactcttctacctgtacttctgttgtatattaatttctcttatgtaaccacagaacgtttttactcacttgtgtatgggttatttttctaaaacacagatctgtttgtgtcttttctgctttgcatttagattttttttaaatcatcttgattaaaaatttcatctcaatttggtttggtgccatctagcataaccctgggcctcgacaccacatcctccatcagtacattgcccggtaatgcagaagctttccattactgcctgaagaagaaaccgctagaaaagcccatcagctgccaaaagttatgccagtatatgatcatttcatcagtccaaaatattttaaattttgaattatttacccttactaagattatacataatttacatagatgattttaaaaattgactacatttaaaaagcaaatggtttcgtttaataaatgatagactaaagaaaacagtggaagttattaaccaaaaagtaaaaaaccttcaataatggtgtacaaagcagtaattatggtcacactatctgagattcctatgctgtgagatttttcagatccttacgagaagacaatttagagataagggtgcttctgggaatggagtgatagatatttatttttacatttatttctaaatgaaaccttcatttagcactttaaagtagaaaacagatttttattgctttcatgagcataaataggaactccaaacacaactatttcataaaatgtagatttttgtctaaaacctatatactatagattttgctattatatctagtcatgtttaaaaatattacttctatatctgtaaataccatttttcactaaaaggaatcaggagcgcttggagaaattactggttttaggtctgaggcaagaaatatacaagttggccttggaacatctcgtcatattggaaaagaagaaggttatcaaagaccactaagactgtgtcaaaagaacttagaggctagcttgaataagctcttgcaagcttttatcaataaaggtataatttcaatggattgaaacatatcaaatatgtttaagtccatggattcataattatacttcaaaatataagaacaaaaacttcattggtcatgtttggagaatattagggaactactcatcactttgaaaactggcaaatagagaaaaagagttaggcacctctcctgcctttcctcgatgacctgtatctcagggtacctcagggggaaacttctctttgtagaattattccagctaataaatcaagaatgaataatagaatatttgaagttttagtgaattattggatctaggcaaatatcagagctaacaatatcatggaagcaggcagtcagaggtaatagttatctgccttctgatggaagttcaaacacggcgtgaaatagtctgtttgatgcaattgtcatatactggcataacctttggcagctgatgggctgttctattggtttcttcttcaggcagtaatggaaagcttttgcattaccaggcagtgtattgatggaggattaggtgtcaaagcccagagttgtgctagatggcatcaaatccccgtcccattagaacttgaataagatcaaggctctagatggaattatcagtctgtagggatgcagaggacagcggaacatgttaaaccacagcagtgtgatacaatgagaaaaatccagaatgtggaaactatcagacaacctagttccttcaacaacaactttttttttaattgcaaggaaagattagaaatagagaagaaactttataaagaaatttaaagaatgtatcaaagaatcataatgtatgaaccttatatgaatccagattcaagcaatctgaagttaaatttgtattataatatattgaaatgcatatttgatataagtaattattttcatttttaggtgtgataatattctgttttttttaaaaattatttttcagagacacactgaaacacttataggtgaaattatgtgattattggcacttactccaaaataatctggcttggtaggctaggatgggattgacacaaggggagttgataggagtataaatcaaacaagatggtcaagtattgataattcttgaatccaaggggtaaacctaactggtttgttattctcttctctctccttttgcatgtatttgaaagtttccaaaatagaagttaatacatagctacaatatatacataaacatacatatacaatatatcaatatatatatattccacaaactaggtaaaattgcaaagtttcatccaggtttaaatattaaaaaaagaatcctttatcactgcacacctactagaatggccaaaccccaaaacactaacgtttccaagtctttgtagtgagtactgaaataatgtatgaaactaacagattactctggtgtatactgctacaaacctggtaactttttaatatcacacgtagacttacagtcaaaagggagactctaaattgtgttataaattaggaatctcagaacctgaggaacatttggatttagttggagagatataaaatggtactgcatgaaaaatatgtgaaatttaataattttaatgcaaatatgtaaaatagaaaaagatgctaaagggcttagccagagcaggacttttacatgccctggagtcctgccaggatcttgacctcgaataggtatcttttgtgtttctgagttaatttccttgttgttaaataaactttgttttttttctagttggggaatggcggtcaatgtgtattctacctcgataacccaagagactatgagcagacatgacatcattgcatgggttaatgacatagtatctttaaactacacaaaagtggaacagctttgttcaggtaagacatattcttttaagtgtttacctaaatatttacagtctgtcatgtggaatgtgattttatgaaccacagctgctatattttgggtaggaaaaagtatatattgctattggcatgtaattaaagggggaaaaactcagatataactaaaggacgtattgggaaaagtgtttatgagcatccaggagcacaagcagagccacacggacacgtattggaaaggtctcttgcttgagcttcgtaatgcctttcactggctcctagcctcttctctgtcatcccatctgccatcacacttgcctcctgaaaacaccaattggttcttacaacactcctcctttaaaacctctagggctccacgttgtcctcactacaggataaacttcaaactcttttcatagactaatgaggtccttattagtctcaattccaccctccacatctctctcccttatacctcagacccacaatataatctttgttccctaaagactctttcccttttgtatcccatagcttttttcatggttcctttgctgagatctttccccttcttttcatttgtgggaaaatcttgctcatactttaaaatctggttcacctgccacctgctctgggaagcattccccagcctcgcaggctccgtggtgttcctgaaacactgtgctcatcctccaaaatgacacttgccacgtcgtgttaggatgtctaactccttctagccctgaaggtgctgagagtccttgaggacaggactgcgttttgttctttgttgaatgcctgtagttgcctctacttggtatgaggtaggtctgcaaggaatatatattgagttaaacttctttaaaaaataaaaatatttgacttcaatgacaaaataggaggatgttttaaaaaacgtgctgctaggccaggtgtggtgacttacgcctgtaatcctagcactttgggaggccaaaatgggaggatcgcttgagcccaggagtttgaggctgtggtgagctatgattgtaccactgcccaacagcctaggtgacacagtgagaccctgtctctaaaacaaaacaaaacaaaaaatatgctgctagtaaattaattcattcttaggtctgagtatttatgaaagaaataagcagtcctcctttggaaacagggaatgtttccttccagtaaacaaatagataagagatttcttctttccctttggcttcaacatgaaaatggtattagaaaataccactgaaatgtatttgtgtgaaatttcatgagtcagaataggtaggaagaagtcaacattgctctttttcccagagggtcaagtataaagattttatacagtgcagttagaatttcaaaagcccccagtagtcactttcagatgttgtctgagtccaacacccaccagtgtaaatattctcccttcaccaggtctggacttgatcagaatactcctagagcactaactttgagtatgattgacatccttttccctgtgatcatttttcccacgaggaagacagtaaggttggccagaacttaggcgttgcctcactcacaaatctatgcctaggtctcagacatgaagtcttgtgatttatgaggtcagtagtgggtgctagctaaccactcctttgcccttcaatacaagatagagaaaagctgacttagactacgatgatgatgtaccaggcatgtatattgttgatctactgaaatgtctctaaaagttactttcagaaacaacttgtattgcagcttatgcaacttcagatctctacatacccaaatattactgtgctgttcttgctgtgcattcttgagctaatattttatttttaacttgctgccaaaaaagaaaccaaaaacagtttctgttattagcaatcactttgttgataacacatacccctttgtattgtaattgtgaaattgtctatttcttcacaatgcctaatgcatggttttccttcagaaatactcattttggagatgaatgaactgcaatttgcaactgctaaggggcaaagacaaaaatgtgtatcttacccacaaagtgggtatatgtgcatttggataagggaaacaaggttggttatcaagaaaaagagacataggaaggaaggggataaggaaaaggctcacagagaaaatccccaggcatgagtcttaaatgttaaaggaaaccatgaggaacttcctatgctgaaatacacttggagagtttttggtagcaaatgaaataagaacaaattgtaatttttagatactgtagtaaatgtatttataagcaatatacataatctttgcagatctttgaaatttctcataaagcaaattcaacaaaattttaagggacatttgtaaaggattcatatatggtgatcttaaagcattggtgtacatttatggcctttgtagctacactgccatcaagcgtggcttgatttaaaaacacaaaaaaacctgtagaagcaattttgatcactatcaaacagatacacataattaccattaggataacttactggctgcctaaaattacaggattgatggttcagaagaatgaagtggatttaaagtttcctttctgctctgaaatatgtttctcgctagaaaaaaaaaaggaagttaatctccatagtagagaaacaggtcttttattttaggtagcagttttctcaaggtataaactatagactctattcttttataatttcctggggagctgctgaaaaaaagcagatgaccttctaaatcggtacctctgagtatagcctagaaatctgagtttaacaagtacaagtttaagtacttttgtgctgcagcctagagcttgcagtacattttaccccagaccaacaaaaatgaggttaaattatccaaacgtccttggaagtttccttgttcataatttaatctgtgacttttgtctttagcatttagcaggaagaagctatctttctatttatttatttatgaaattatttatttatacccttcattgttctagaaaatatttaaggcagctaggacagtgctattaggataggaacaaagccaagtattgttgacttaagtgacttatattcctcatacttatgagtagtcagatttcttatgtaatattttcttcaatgtttatttcaatttttttagtttactgtgtgggattttattttagcagtatgcccaggaaaaacatacaggaaatactttctcatatttaaaatgatttaaaatgtcaacatcatttcttactctctttcctgaagacttacgctccaatcctggtggttcccattttgaatttttttcctattgcattatttcctatttctgtttttaaaattttccagctaagagatctccctccagctcagtattaaaactaacaccagcttttctttaatttgtgaagagctaaaagattgcctcacattggtgttgtgttttactcagtattttctgcctttatgtaacatctaatttgtttccaggtaggcatttttaaaagctctttaaaggaaagatggcgtgagaaagtagaacacttggaaatatgtttgtagtaagttgcaaaacagtgaaaatgactcactgttatctcctgttattttatcccaagaatataacctcatgaaaattttctttgaacattaaatctgggtcatgtaattatatgggtatctggttttcatttatttcttgtgacaaacaacctttaagtttcaagtaaaaggtgagctatataaatggagagtgggctatcaatgaatgtgaatactacctataataattcagcaatctattgctcacctagatctattttgaaatgaataattgtagattttccatggtggagtgagaaggttgaaccacatgtagtatcagattggttcagcttatagatattttatattttaattcaaaagttatacagcttgggcaggggggtgatagggaatttttttttcattttttgctttagtactagctcaaactaatttactaaatcttttataaggtagcaatgagggtgaatggacagcatggtgctaaaaatctctaaaagctttagcaactttagataccttagtggaggtgatagagaagataggggacttagaggggaagaaaaggaaatggggagggaggagtagggtggagtgggagaaagtacatcttttccttgaaagtacatattttccttcttttcctctccctcactcctcacctcaagcctcctttgagacttctttgtgacattaattttctgtgtcttgatcctctgccctaggctggagctaagcagcaaaatcactgggtccaatgctgggtcattcttgctgcttggcagactgagtgcctgccttgactcccatcctcacaaggctagtgcagcctgcccttttctctttgtgcaccttgcctccctcctccccacccctccactagccgagcagacacctgacttggggcaaatgttaaatacagtctgcatgtagggctggcactgcctggactgtcactatatcctggactgtcactgtctgtcactgaaagctgttattttcctgagcattttagtattttaataaaatgtcatttgaattaaaccatttttagatggaaaattgagatattttcttgacttgctttaaaaaaaagaaagagaaaatgatcaggatttgattcagtttcaatttgtgcttccccaaattggtgcgagctttgtcttggatcaagtcactggtattttgttcttccaggagagcttctgaatttggctaatgatattgtagtcacatttgcaattctggttacgtgatggctatgtggaaggagcaagtatttagagtacactctggcattcacacaggtgtagccatcagatggccctgggacccgtggtgcaggtgctccgggccccaccctgatggccatcattcctgagcccagcagagtgttctttgtgaccatttttggccgcagatttgtgcctgttagataggttgatcccagcctcgtgtgttgtccctgtgcctcctctcttccatccacagagacctctgtcaggacaggttaccgatgaaatctgctcagagtctaaatttagtagggcttctcttattggctctctggtattgaaaccaagtaaggatattctttcagtgtctgtaagcataagagtttacttagctttataaaatcattgactgttatttgctgtaagaaagttaggtcatcttagattatattactattgttagggaggtaattgtaatggaatattattcatacttgtgatatattacatagagtctttttggtttttttgctgacagtttttttctctaattatttgactcatgctaattttaaaagtttacatggtctcagcatatcaactaattggagaagaaggggacaaaaaaaaaagagttggataatggtggggaggggtctagcctcatgttcaattgcttcaggcagtaatatatggtaatatactctagtgtctctactaatgcactggttgaaagggagtttatttttggagcaggatagataatacagtaggttttttttccctccaaatttgttcatttacatcttgacactttgctcccgaagatgaacgtaaattgctgtttctgtttttcttgggactttttgtttgtttactgtcttttgtaatgctgaataccatggtggtgaaaagtgtgtatgcattcactttcatttaccaaactgctctataattttttttacacatatggatgatatatctttgaaagcaaccagccacatcttcgtttatgtccttaactacattcaattctataatcaatttagttttatttaataggcatattttgagcctttctttgggctaggccctggggacccagcgataaataaaacatagtcattgccctcaaatagctcagtacagcagagtactgtcctacaaaagaccagagaccacactgtggtaagtgctggtttgcaagtgctttgagcatacaaagaaggaagtaaatgaagggaggtagggacatagggagtcagtagagagatttactcagattctttgggagtggctgggtgcttctggatgaaagaatggccatcgtttgggaaacacctcagaaatgtccccctccctcttaagtcagatggagtgacaagtgtgtatgtaggataatgtgtggggtacttagtttcatttaccctgacagactccccaggctaggggggcctttgtcttatgacacagggactctagtcagtaaaatgcatgtgctttagtgggtacagcccttaagtacatgaagcatattgtcatctctaaagaaatataaaggattttcttgatgatctcatcacatgagtatgtgagaattgttattactctacttgtttgaaggaactaggcatgcgtgtgggatattctcaggaaaccatagaattggccacttctttgggaggaatgcaccagatacttttaaatactaaagccaaacctcagtgataactgcttgggtctctaactgggtagatgtcatgtgactgcattagtatttatcacaggaacagacctacagatatatccctacatcctattacccatttctgctggagtctctcctggttagtgacgaacaccataaataaggggaaattagaaaaacaggcttagggaaaaatagatcacctggaatgccattgttttattgaagactaacaatatatatactgaacaaaaaatcaaggaacatgtgatcacagttaactttatatagtgccttaacaggaataagtgaatcagtgacatattagaaacaggattaataattgcctttgagaagtctcaataagttctctctctctctctcacagatacgcgcgcgtgcgcgcgcgcacacacacacacacacacacatacacacacacacacacacaattggtacaaagcagtaccattagtgggaatctcatatttttttccccatatgtgagaaattcccagatgtcatagttgagtgcagtctttgaggttcttattgagtatatcactaattcacaaatgctattgtatctaccctactatagtaagaccctgctgagatttacctgcccccaagccatgaataggtgggtggttgtgagcctagagatgaaaactgttgtaccaagggatgggtcatcaaaagaaatctaagttggatacagttaatgagagtgatactgaacatagtactaaggagtctctaaagcctcatcattgatttcattaacttcagtgactggagccctaactccatagccccagggatcttgacaaaggttgtgagaaaacttgctggagtccaaggacatgacaggttttaagactcatttataattcataattctaattacagaaacctttagagccatttctcttctgattttgtctctgttatatgataagttgctttcttttaaagtacataatgatatgcttattttgaaatcattcaccaagatcaataaaaaccagtatcttaacaagaaaaagatttatctttcaacatattgaaagttattttgaatttttaaaaacatgtcaatcactttatatgatggatatgttccttataaaacactattttgtatttaccatgatactttttctttttcttttctccctttcagtttagattatctaaagactttaacaggaagagtgtaaatttggggaaaaatagtcatttccttttataaatgaatttatgattacttaagcacctcatatgtttatctgaggaaagacttaagaattacagaaaccctcaaatgtttttccacagatgaactggaggatcttagaaatgtgttcataccctttcttgtctggtaggaagccaaggacctcattttattctttggttccttgtcctttgaatctaaaacatgcattttggagattcatgttttgcatctgaaacagtccaattcaagcccattcatttttatagctctgattatcttaaccggttacatactatatagttttatacattaggggtataatgatgtcataatgcctcagcttttatttctctctctctgccattttcagtgtgtttttatatgtattatttcttttaattcatataacaaccccatgaggaagaataggaatattttattcctattttatgaggctaaaagctccaagaagccatgttcacagctgataatgagaattgaggtgtccttggatcatagcccagtactctcattgctgtatgtgtggcagctgtggatgcaacgaagggttcactgtgtgtttgcccatgtggatgtgtttctgattctttccatatccatttagcagaagtcctttaagcatctcctctaagaaaagaaagaaagtctttatctccatcctttacattctacttgaagaaatgagacatatctggtaattctactaatgacaagggtgtgtcccaatggtatcatcatcaagaactttcttaccaaaagtaacgagacagagacatttgctcctagtcttatgaagttcttccttctccacctgctgcaagtagagtggggaaagagccgcctgttctctctgattgttctccttgttccttttcttcctctaacttctttccctccaagcaagatgaggtggctctgaaattttgccacctgccatggaggaactttgcagctctctcaggataattcttggccagtgaaacaacaaccaggatgatgcctccttagacatttgcatgtgcatgtctctgcactgtctacatttgaatcccaagaatatggtccttttcttatttttatcccaggctagcttttgaacaagcttgtacctgagagaactacacatccttatttcctcctttctatgctattgaggaaattacaacatctcctaggataattttcttacaagcttggttcccacaaaggatttacttatcaagttatcactgttttccatgtatttaatccagttcaataaacctgtattgcagtagccatgctaagaggctccatcagtacttctccaaccccttctttaatatgaaaagttgatggtttcttagtcttacgtaaaaggacttactaatgcaacatttaagagtagacaccgatttcccatccagctctatcccttcattcccatgtctggtttcccaactccagccagattgcagctcctgaactttttccatatagccattctagatctgccagtgggtatggtagcagacactgtgctagtgaagtagaaagatgaattgaacatcatccccagtcttaaagatttactcaccagtcagccaggagagagaactaattaaaatgtaagtcaaatccctgttagatttctgtatccagtatagtgaaacaattttgtgttggaaacaggaaagcttcgtagaggaggtgatgttttgactaagcttttaagaatgagaagttattcaagtataaaagaggacgaaaggacattttagacaaaaagtttgatcaaggcaaaaagaagttgcagtgttttgtgcatgtacattgcatgtgtaagacatctgtaacattaaaattcaaggcagcgaaagagggacagtaatacttcaagtaataagtgctgtattcaaagaaaggaaagattatttccatctagaaaagctttttgtcttacccttgtttgggtctttggccaaacagtcattcaaatttagtggatggtcaataaatatttatgaagttgaattgaattgaaatgctattcaaactaggattttaatatggataggattcagacggagaagaagatggtgattttgaggaaagttaccatttagatatcattttgatattctacacattgctttatttattcctgcagtcagcagatatttattgagtacctgcaatgtgtcaggtggtggattaggattggaggatacaccactatacaaaacacaacacagatcatatccagttaggacctatccctttactaccaaagttctccctgacaggtctattcagagagagcaaattcctttttctcagcttacctgagtatgaagcaaaggcagagaaaggcccctggagaaaggtacacgtccagcctgtcttgccatcattcagtgtagggcactaatgggcagtctgtacatggaaacatctgaaatattagcaggcatctggtttctacacagttaagataatcaagccaaacatctccaaattcttctgctcttcaaaagaaaacatttttcctaaccaatttttttctgaattgtgtttttaaatttctagtttatcagacatgtagacactattaaaaaggagtgtcagaaatcactgtcaaatgtttgggcatgttagaattgcatacctggaaacagaataatgaaattgcttggcaactcgtaaagacaccatcatttttcagattgcgtttttttttttcccaccctgaaaccattacgtaattctgacaaatagcaaattacctgtgtttgtcccctccctcccaagggtgtgttcttacccaaatattaatactcataagctttttatgaccaaattatttgacatgagaagcatataaatgtgaaactaatgcgagtcctgtttcctgcagtttctcttcgcattctgcatgaggaggatcgttctccattttcatttcttctagattacatttgtatgacagctcatggaagaactttacaaaagtgtagaaggagccaaattttaatgaaaagatgtacatcaactttaaaattgcgcagaattgtgttaaaatctactatttaaaaacctcacagaaatcttttcctgcttctttttttttccaaaaattattccattcttttatttctactgtggtcatatgattgaatccctgaagtaaatactgtgcattcttcaaactgatttgggatccttctgatactagagtgtacctagaaagcaaagtatattttgggattaacctgggaaatataaagaaagcaactcataaagaacaatattctgttagtatcacagtctgcacgaatgttatgtggtgcctgaatgtgagttcctctctgtctgtaattgctggaggcttcctttggtgccacacctggccttctgggctttctctggacgggactcttttcagggagctgccggggaaggagcatcctcctctggaaagtggtaataggggatgttattggtgtagatgaaagctagaggactggactggggagagtggccataagtatggagttctcacctgcaagtcttggggagagggtgaaatggctgaaatctggggaagaatcctggagcttctagtctctagtgccagggatagtgacctcagcctcaaaatgagcaacttgagaaaggggcgcattgtgtagacgtggaccgtgggtttgcgctggtccactcataccagtatattttaccttatactaaaagcctctctgtgggctgccatacatagagttcatgtagtggcctggcctgtataactgttgatagtatgatgtgggtaatggttcagtagaaattctctgagaaaatggggaaagggatcagctttaggtttcttacttgcaatttaatttgacctaaaaatacatacgttctgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaaaaaaatacatacgttctgaaaattagaacttaaaaatggcattctctaaagacgtttgtgcccagaaatcagcattggtttgcctaccaaattagttaagcttcttcttttcctggcatttaaagccttgagcaatctagctgcattccacctttccaacatttatccccacagcctccctacccataacctgtatttcctcaaacgcacgtttcacttatatgccctgattccttgtctttgcttggagtatctcctttgaaattcatatcaaatgccactttgccctattcttcctgatcacattcaacaaaatgtgagctctctctctcttttcaatgatcagacctttacaaagccttacgctcattgagtacttgttttaagtcttcagcattcggagttaagctccttggggactgaaatgatcatgcaagtttggcttgattttatgtgtttgataatactgattactctttgttgtttttttattgggcagactttgaactaactgtatggaactaatatttatgtatctatatttataaatattactaatatttatgtatctaggccatacagtttagcacttatagttgttttgtatttttgctgtttttccatgtgtatttctccagactctcaagactaagttacttggttcttattaagactaaggtcatattcctcaataagtatttgctggtttgtttaacattgctaaataaacaaagtgacatctctccatgccacctacagatgggcatttctttagaggtgacctatgactacaaaaattagataagatctcatatcttttcagattcttaccttctactcaagctcttcttaagtcttaccttaaatttaagtcttaccttaaatttgaccttacatatttaatcaatcctttaaaaaataaagcacctttttgtccattaaagtagaagggtaatacaagtgtgtgagaatacgtgagtgcacatgtggagaagctatatcccatgatattagagctttatgaaactttctattttcatgaccctaatgagaaaactgacttcttcagaatgggtttcatatgtaactttcgaacttgtttttcatttgtagtaaaagctttttatgtcccctttgctcctctatctggaatgtcaaattctaactttagctccactctcagactctagcctgtgagacatcgcactgccagtttcagtatcagcctccctggaagccagtgacattttgtcctgcacaccattcctgccctgtgctcccagtgcctctcctacttcttccttcttggctcctctggagaagccaaatcatattttaccaagtcagacaccttattttggtaaaatttgatgagcacattatcctacaagaaatcactggtgttagaatctaggcatgaaactgagcgctggccactgcaccattaatcagcagacgaaaagaaatctgaaaccaatgagatattttacttgccagtaaaatctctattttctaaaatttactttttaataaaaatgttgatacctaaatcttaatcaagggctatttgttatataggtttttactccattgaaatttccttttgaaagatagtagaaaatactctttattcttccatgatgtttctatgaagaagcacttttaaaatcaatttgttacagtaatattaatatctgatcaattttctctacagcaggcctaacatttaatgtagttctgcaggcttcttaataaattcagatttaaacattacattactttttggtgaaaccctgtctctactaaaaatacaaaaattagtccggtgtggtggcacacacctgtaatcccagctacttgggaggctgaggcaggagaatcacttgaatctgggaggtggaggttgcagtgaggcaagattgtgccactgcactccagcctgggtgacagagtgagactccatctcaaaaaaaaataataaataaaataacattactttttaaaaaagtattcttggttcttgttgaaagcaggttataaacagaggatactggcacctttaactgcagtttggtgcaggcctataagattcttaaaaaggttttaagatcatatgaattaatgaaaaactgagggcatttatcagataaaagaccaatcacatgatttgacaaggccttttaattaatctgctgatgctcttaaaaatctgcctctctgcctgaatgattattactagcttatttcttttcctgtacaagaaaagagatgaaaatgtccttcaacagtttattctgtgtgttcaagggaaaagatggggtgcttttcagcactctcttcagttcacataagccgcctctgtgtctgtaggagttgaaatcttcctgctggctattactccttttcctctacatgggatcagtttgaaagctacttgtctttggacttatttacaataggaataaaaagcttctgacaatgtcaggtagtggagagaagcaggaagctcagctgaggaccatgggaattcaagggagcaatctcagttgaaaccggatttctgaactcttgatctttattttggcatttgtggctcggggcaggtaaggtaaacagtgtccaaagttccccttaacagactgaaataatactgtggtaactgaagctttcaagctgctcctccatgccaggaatgtgaaggatgcctatgaaaacaacaaaaagctactactaatttaatcagatttttgttagattagaatgatacagttgaactttgggattttaaattcctttaaaatgttaatatttcaaagcattatttcacaattgccattaaactccttacagcatgtatttctgtaggtagagagatttctgctgatgtgctggaaatatgtaaccttgtattttgcagcctcactttcctctttagtaaagccctgatttcccaaaggggaatgcttccttcaacacgaggtttgggcttaggtaatagttgcagttctgcaggaacatcagttcaaggaatgatgagctgaatgccaaaataaagctgggatgactttatgattattgcgtatgaacaatctaatatgaaggagatttttcattgctaatattcaactactggatagaaaatatggctatgttactgagtttgttaatgtcaagatctcaaagagaagtacatggaagatagggtcaccagaactgaatctggaaagggtgtgtgtgcccccaggaatattccaccagaggcagcagtgttattagtaagtctcctcttatattaactatgacaaaagccagtgatggctagaagcaagagcactggcaaacatcttggtcatatgaagatgagcatcattgtctcctaattagcagaaatatcaagtatcccttaaaagagaacttggtgacagactgagaattagaaaatcatctaattttagagaccagagatcagtccaacactgacgttttgcacataagaatactgttggcttagcagagtgtgacgacatgtcactgttcattcaagatgagaaggctcagatccaaaggccaacatagttttctgtttcctgccttcccattctttgttgatactagcttgagataataagcttttttacaaatcatttacctgtaatgattcacatcatgaagagtatgatcacatggatgtgtccaattaattgaggttgttgtgcttttcttctaacctttcatcagtaccaaataagattatggaaagtgaaaagttgtaactaaatccctcagtgatataggcatctctgtataatagttccttggcctgtgaggaaatcagatgggcaatttgagtagctgtttgtggcagaacccaatctggcttgatgtgtttttccacagattgtgttgcatttctggaaaagtgctgtgagactttttttgacaccaataagatatatatatacatgtatatatgagatacatatatagatatgtatctcatatatatgggcgatcaataagattatatatagagatgatgtttatttttatatacacattgtatatatgtaaaatgaaattcttatgagtgtatatatactgaaatggaaagtcatgacattggagcagattaatgatctatcaagcccaagattctactataaatagaaaaggtatagctgatacttctaacaccagtccaaacgatttatatgttctcttgcattttcctttatatttccttttagaattatctataaaaatctataaaaatttctaaaacttaatctataaaaatttccaaacactctttgaacctttcaatttttacatataatttcctaaaagcagcatagaaaaaaggaatgtttttcttaaaaaaaaaaaattgaagttcagatcagagtttaaattccactctgcaatttcttagctgggtgactttctgagccttgttcccatacctgtaaaatatgggaatgataataaaaatacttacctcttaaggatactatgggattcagaatgtttaaaatacatatgaaaacgctaacagattttacccaaatgtgggtgtttttatgtcttatgtttcttgcgtaatatattccataaatttgttattagagtaatatttccttttatctgaaaatttccactttaaaaatgtccatttattctgatattactctatggttgaaatcctgggatctggtgaaaatgaaattgtcttaggcttttcatgattttatagacttaaatcatacactcctgaatcctttgagtatgaatgttcatttttgagctctgccatcttcatacagcctcccagctgttcattttttattcctgtcctcacacttgtcagcttcattatgtcaattttgatgtataacaactgaaaccaatcttagggctgcaggggtacagacagtgtagaaagaatagttttttcccccctacttatttccagatcatttcagaatcttgtagaccttcacaattgcagcagcaccttgagcttatgggctcagagtatatcccatcataattaacctcttagtaggcacagcatcctacaatttgggttgtgttacttgaatgtgttaccctatgcttagcttttaaagcttatcttttacttttctgcagacttggtctctagggtcattcttatatttgagtggctttaaaaaattttatttatacctcgtcaattcttaaaagaatttttagcaactcttctcataatatctctttggggagtttggcaacataagaattttactgtttaccagcccttgttgtggttcaactgctatgcagatcttcattcattagccagatatttattgaaacccacttatgccaggtactgtattaaatgtttagatacataggggaccaagacaaataaggcacaagtattcttgaaacttatattgcagcgagggaaaaaataagccacaaactctcttagtctgttttatgctgctataacagaatacttcaaactgggtaatttataatgaacagttatttattgtcttcctcttctggaggctaagaagtccaagatcagggaaccagcatctggcaaaggtcttcatgctgcgtcattccatggcagaaatgcaagagacaataggggagagaacaagagccaaatttgcccttttataacgaattgctttcccaagaatggcattcatccatttcaggagggctgaaccctcatggactgcttacctcttagtggtcctacctcttaattaccatcacaatggcaaataaatttcaacatgcattttggaggggatatccaaaccatagcaccaacataagagttaatacaatgccaacataagagttaataaaacaggatgaggtgaaaaagagtgcttagaaggctacttcatgtggcatagtaagggaggacctctctgaggagatgacatataagctttcatctgaatgtcaagaaggtcaccatgtgaagttctagatgaaactgtgtaaaggtcctaattcaggagcaaatctgaagtgttctaggaacagcaaggaagccagcatgaagggagcttcctaaaaggaagttagacaagggagaaatagacagaggcctgataacagggtattttaagccagggaaggaatttggattttatgatagtttcatagaaaaccactgtgatattcttagcaggagagggatgtgatctgaataagggtaaccgtggcataatgagataaaattgtgtttattcaaaatgtacctcacattattgcaagggtagttaaatggcacaaaagtctgtgtatctgttgatgaggaacattctgatttgtggctgggtaagacttccaggacactggcaatgattcctgaatatttcagtttgttgacatctatttttatctgattaaagaagaaaatatagaatttcaagagcaaaagaggtggtcaataaggccaaatactattaagaggttgagtaggatgcagaaagaaaaacaactgtttgatttgatagcagagaagcttttgatgaccttgaccagaacatggtgaggttggaagacaattgaatttgtattaaattgaattggatgtcagatgaaacaatgaaaacagagaccatttgaagttttactgtgaagaggaggagatagtacatagctcaaggatgatgtgggatcaagaaactttggttttattttgtcaaagttgaatgatactggagcatatttgcaggatttaggaataacatatgcaggaagaattttgcattgcaggagagaatgaggatagcagcaggaatgactcagtgagtaagaggagacgtgacccagagcacaagtagagagttgaactttgataggaactatgcagtttctcaaagaacgtgaggtataaatcgtcatgaccttggattatgcagtggtttttggttataacaacaaaagcacaagtgacaaaagaatgaatagctaaattggattttattgaaatataaaacatttttgcttcaaatgataccatcaagaaagtgaaaaaacagtccacagaatgggagaaaatatttacaaatcatatatctgataaggaaattatatctagaatatagaaaggattcttacaattcaacaataaaaaagcaacccatttaagaaacaagcaaagaatgtgcatagacattcctccaaagaagacatacaaatggcctaaaaagcacaaggaaaagatgctctaagtcattagtcatagggaaatcaaagcaaaaccacagtgacataccacttcacatccattaggatggttagaatcaaaacgacagacaagtggtgatgaagatgtggagccctcatctgttgctggtagaaatataaaatagtacacctgctttggaaaacagtgtgatagtttttcaaattgttaaacagagttaccacatgacccagcaattccaatcctaggtatactgccaagagaattgaaaacatgtccatgaaaaaacttgtacacaactgtttgtagcatcattactcaaaatagtccaaacataaaagcaatctagatgttcattaatgaatggatcagtaaaatgtggtaattcataaaatggaatattatttgctgtaaagaaaaaaaatgaagttctgatacatggaacaacatggataaaccttgagaagagtttgctgagtgaaagaaaccagacacaaaggccacatgttatatgattctatttatatgaattgtccagaatagtcagatccatagagacagaaaatagattagtggttgccagggcctggagggaggagagatcatagagagcgactgctaatgagtaagaagggtttttttttggcagtaataaatatatgctggaattaaatagtggcaatggatgaacaattctgtgagtatgttaaaaaccactgaattttacatttcaaaaggttgaactttagggtatatgaattatatcctagctttactaggataagatctggaacaagacaaggatgtccattttaaccacttctattcaacattgttctggaagtcctagccagagtaattagacaggagaaaggaatgaaaggcatccaaattagaaaggaggaactcagggccgggcatggtggctcacgcgtgtaatcccagcactttgggagtccaaggcaggaagatcacctgaggtcaggagtttgagaccagcctggccaacatggtgaaaccctgtctccactaaaaatacaaaaatgagccagttgtggtggtgggtgcctgtagtcccagctactcaggaggctgaggcagaagaatcgcttcagcttgggaggcagaggttgcagtgagccaagattgcgccactgcactccagcctgggagacagagcaagattcggtctcaaaaaaaaaaaaaaagaaaaagaaaaagaaaaaaaataggaggaagtcaaattgtttgcagacagcatgattatgtatttatatccctaaaaactcaattttaaaaaactgttagaactaataaacaaattttgttgcaggatacaaaatcagcgtaacaaaagtcagcagcgtttctgtatgctgataccaaactatctgaaaaattaaggaagcaatcccacttataatcactaccaaaaaaatgagacacctaagaataaacttagcgaaggagctgaaagatttctacaatggaaacatataaaacattgatgaaagaaattgaagaggacataaataaatggaaagccatgccatgtttatggattggaaaaatcaatattgttaaaaagtccatacaggttaagtatctctaatccaaaaatcataatgcttcaagatctgaaattgttttagttctgacataccacaagtgaaaaatccacacctaatctcatgtgacagttcacaggcaaaacacattcaaacttgttttatgcacaaaattattaaaaatactgtataaaattaccttcagggtatgtgtataaggtgtatatgaagcataaacgattttcatgtgtagacttgggtcctgtctcctagatatctcattatatgtatgcagatattcccaaatcttaaagtatctgaaatctgaaaacacttctagtccaaagcattttggataaggtgtacttaacctatactacccaaagccatctatagatccagtgcaattcctgcaaaaaataccaatggcattcttcacagaaagagaaaaagataattttaaagttcacatggaaccacaaaagaccctgaatagccaaagcgatactgaacaaaaagaacaatgctggaggggactgcagcagatgggtgggctcctttgactccactttgcctccttggcaatgagtgggctatcccactctcccacggcatctgtatttaaaaaaaaaaaaaatactgaggcatcacatcgcctgacttcaaaatacactacagagctgtagtagccaaaataacatcatactggcatgatgtattagcctattcttgcattgctatacagaaatatctgagactgggtaatgtattaatattaagaaaagaggcttaattggctcacagttctgcaggctgtacatattggcttctgcttctggggaggcctcagcaagcttccagtcatggcagaaggccaagggaaagcaggcacatcttacgtggctggagcaggagcaagagagagatgtgggagttgcttcacacttgctacacacttttaaacaaccagatttcacaagaactcactgcttactcactatcataagaacagcactgaggggatagtgatcacccattcatgagaaactggccccatgacccagtcacctcccaccaggccccacctccaaaattggggattacaattgaacatgagatgtgggtggggacgcagatccaaaccatatcacctgaaaatagatacatagaacaatccaacagaatagagcacacagaagtaaatccacacgtttgtagccaactgatttttgaccacagtgccaggaacatagggaaaggacagtctcttcataaatgatgctaagaaatctggctatccatgtgcagaagaattaaactagatccctatctcttaccacatacaaaaatcaactcaaaatgggctaaagacttaagtgaaagacctaaaatgataaaactactagaagaaaacataggggaaatacttcatgacattgatctgggcaaagattttttgggtaagaccttaaaagcacagctaacaaaagcaaaaatagacaaataggattatatcgaacaaaaaaactccttcacagcaaaggaaacagtcagcagaatgaaaagacaacctacagaatggaagaaaatatgtgcaaactattcatctggcaaggggctaatataaggaactcaactcagtagaaaaaagaactaaataaaaaatgggcaaaagacttggttagacatttctcaaaagaaaacatacaaatggccacaggtataggagaaaatgttcaacgtcactaatcatcaaggaaatacagtgggaaccacagtgagacatcacctcaccccgattagaatggctattatcaaaaagaggccaggcgcagtggctcatgcctgtaatcccagcactttgggaggctgaggtgggcagatcacttgaggtcggtagttcaagaccagcctggctaacatggtaaaaccccatctcttctacaaatacaaaaattacctgggcatgctggcgggtgcctgtagtcccagttactggggagattgaggcatgagaatcacttgaacctgggaggtggacgttgcagtgagccgagatcatgacactgcactccaggttaggagacagagcaagaccctgtctcaaaaaaaaaaaaaaaaaaaaaaaaaaaggaatggctattatcaaaaaggcaaaaaaaattgttggcatggatttggagaaaggagaactctcatacactgttggtagaaatgtgaattagtacagccattataaaaaacaatatggaggcgcctcaaaacactaaaaatagaactaccgtatgatccagcaatcccacgactggatatatagccaaaggaaattaaatcagtatgcccaagagatatctgcactcatgtttattgtagcactgttgacaataaccaagaaatggaatcaaccttagtgtccatcagtgtgattaatagatgtttaaaaagtggtataaatacacaacgaaatactgtttagtcatataaaaaaatgaaatcttgtcatttgtggccacatggatgaacgtggaggacgttatgttcggtgaaataagccaggcacagaaagacaaatactgcatgatcttcctcatgtggaatctgacagagttgatctcatagaaatagagagtagaataatgatttccagagactggaaaggggaaagcagagggaggaatggagagagattggtcagtgggtacaaagttacagttaggtaggaggaataagctctggcattctgttatacagtatggtgactatggttaacaatattgtgttgtatatttcatattccccttgctctcaaatcccaggagtgtaccctatttagagctaacatctccctgacttatattgacctttctcaagacaagagtttttcaaatcatagcattatttataattgagaaaaattggaaaacaagcacaaggttaaataagcaatggtgaaataccaagtaaatattttgcagccacttgggaaaaaaatagcgactttgaatgttctcaccacaaagaaatgataaatgtgtgaggtgatggatatgccaaataccctgatttgatcattacacaatgtatatatgtattaaaagatcacacttgtaccccataatgtatataattatttatcaaaaacaaaatacaaattaataagttacctgtttttgaaagctattatttttatatgccatgaataacaaattcaaaaatataatggaaagaataaatggcatgataaaatttaggaaaattttgagaataagaggaggggaaattattctatagatagtaatacatgttatagagttttaaataagaatgtggaactgccatggagacaaaaaaggcaatttaaaatctagaaagagatctaagtacatgtattaggaaggcaatagatagtaaaaatagtgcttctcattggtggggaacgaatagattattaagttgtgatgttcaacacctagctaactttatcagttagtggtttaggttgaaaatagtagaagttaatcctggcaggcttaagtagaagaacaatctataggaaaaatgttgggtagctcagagtcaatggaaagccgagctcagaagatggacaggaaccaaaggatgctaaggagctgggaacacagcctcccttgtgtcacaagaataggatggcactgtgctgcttttgctgctcaggactctagaccccaccactctgccaccacaactaaactctaatggtccctgtgtgtttatatcatttcctcaactcagatactgaggcaggattcaaacacagagcctaggtcatgggccttcatccttattgttgtgagggaaagggatgcctggccactttcagcttctgtggtgggaggcagggcactatagcatctccccaggtagtaggtgtccaaatcctggagccaaaaatgacagatttccaccaacatttggaatgactaaaattagaaccatactttatatcatagacaaaaataaattccacatggattcagaatttaaatgtaaaacttgagaccataaaagtacttgacagaaatatgcatatttatgtattcttggttcgagaaagttgataagcaagatataaaaataagaaagccattaaaaatattgatagagcatattaagtgactcagaaagagaattatgatctgttgagtttcagaaagtttacattaaaaatgggtataatgtgattacatttttaaaacaggatcacatttttaagaaaatacacacacacacacacacacacacacacacacacacacgcacacacacactcctttccaaagaggattagaatggcatataccagaatatttcgagtggttctctggatgatgacactagagatgatttttccttccttccctcactatatggaagagggttttttttttttttcaaaagctgttatttctttttaaatctgaaacatgaggaatttggttggttggtttgtaagagtatatagtatctgggtctccatagataaattttatgctaaactctacaaaagcgaaaataacttctaagaccaggtaatgaggcagttgtgtttcaacaatcccatccatataaaaataatgttaaagtggcaattggaatttgctccatctggcggtccttcaaaagaaagaactggatagtgggtgatgactcaaagaataccctccagatcatgatgtttctctttcctcccccagtgtctttttttttcctttgatttgttttattttgtcttctctttaagagaacccatctgcttgactaggaacttactagttagtattcagggtatgtcatctaaaggacaccagatgcagagactctagagatattcgttatggcctatgttttatcactttacgctcttacctacaaaataggagttgccccagcatttcatgttttaacaacccttagattcctgatgtcttgttctctcttatctcagattgctgtctcagtaaaggatgcctaacctttatttcacatgagagacagagcagttcttgcttcctaaagtgagtcacccaagtagaaggactggctcttcacagaagtcttggtagtgtaaaggatgaggggaggcacttcatgttccagaaagactgatcatgagcacatcatagagagagaccaagagatctggagatagcaaagaaagaatgaacctaaaaatggtgacttgttcctattcttgccacttggttttctttcttgtaaaagaaaaggaatcattctggcttccagcttattttcctaaatgccattagcctatactagtaagaagatatgaatcagtaaacacagcttgccagaatttcccagttgtagtggtcatgttctaagagctcttcatatattttttcaaaagtcccctttttctatgatcatttccccagggggctcattggacatttctgtcatgtttcttagtcataaagaacatgactctgaacttctatagctttcagtatccatgtcttcatacttcatgttaatatggaaaccccattgctctggactggaattaaattagtattaacttggcttataacaaaatttaacaattaaatttaccaatttaatacttaataattaataagtataagtaataggtaataagtataagtaataatagttaataagtataagtaatacttaatacttaataagtaatacttaataagtaatacttagtaatacttaatacttaaattggtattaattgacttgtagttttcacctgtgtgggggttctgtagttttcacctgtgtggtattttgtaaataccacagctatagatagaaaacagcttgagcatatgtgtattttttgagctacacatttcatgagaacttttgtagttctctcatgttttcctctctttttcctcttaagtttattttgatgacttggagcaggtggtagccaggtggaagaaaatgtatatttcttttctctggtagaagctagaaggagctccttttatcctggtttccttggctttatagtgtgaggttctgttggttggttgtggaacctggtgatattctgatgcatggagtacaatacacggagtttagggttgggaagtggcaggtgctgtattgttgaggtacagtcccttccctctagctcccagatcctgtggacaaggagatataagcgcattggtaagaaggacacactctgctctgagtgatgatggtgcctgtaaggacaatccccttccagcctagcagtcctctaccacatctgggtacagtgagactcactccagtactgttcttgtttctttccaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaggagacttgtacctccataaaatgtgttgttttttcttaaaattgtttttgtgcataaatgcaaaagtccaggagcataccaatgggatatatcttgatatcccaacagtaggctggggtctgtacctagcataaagcatcaccctaagttcttgtatttttatgaggttttcatttcagattttctaaacttgtagccagtagactaaaaactaacagggctcacaaatgttaaagtgttattagttaaatttagcattgcagatgagaaacttttaatgtttgccagatgccactgtggttctttgtattttgttcttttggagaaacatcatgtcatggcagaaacagcatggttttgaatcccagcttcatgacttgagcaagttatttaaattctgagtctcagtttacccatctgtacaatgggactaaaaaccccttattcatggttatgaagttgacatgagaagcagtgtccggtatagtgtgtgcgctcagattctcaatgtccataatttgccctttttttctcccatgaattatacttttgtcctggagtggtgcaaatggcctggagtactttttctctcaataagggattattgctaaaacagtctctttctgcatgtttactgctatttaaatacatacttaatctatattccttatttaggatatatctcttagcatgaatgagcttggaaagaaatgaattttgaataagggaaaagagataaaccagcaggggagaaatggaaaactgttctttgcataaacagaggtaataaataggctatggaaatgaaaaataaaatatcaggttataaaagacagagattaaaggaaagtttgataaactatgtattttgtaagctaaggcaattaatatcttcttgacattcttatcaatatattaagaaaatcctgacttctcattgtcttggaatttttatttcaaaacatacattctctttaacatcttagccctttggattatttccaactttatgtcctttgtcatggttaatttccaattagctctttccatatgtatttaaaactagggatatataggttctccttacttttataatacctcttgtgtctttttcattcatttctctatacatgcttctagattagaaagaaaagaaacaccttttcatatgtttattgatggaacttgtcatacatcaaattagtgggctccatatctctctagaagtatatacacacagaatggatgagcagttgttaagaatgttgaagaaaaaaattattgcagtggaaggagactggccatgatggcctttgttagcctttctagctttagtatgcagtgatgtgatccaaaagtacggtgagagacagcattaagtaccctcattcatgtgtgtcatagcctgatggcacaatggaaagttctatgcttttgcttgccacctaggattttgaacttttgccctgaagctttcatgttgatagagaatgcagaattaagtccacagaagtaaatgccttcttttaacagctaatgtaccaccagtgtctaaaactatttataaatgttcatgtctggcaatagacaaaatatagtagtttgttagttaaaagctttttatgctctaaaaagcctctaaaaagttgatttctaacaatcaatatcagcataaacaaaaattttaaactcagaagacataaaagtgattaaataatacaattaaaagtcaattgaggctgagcacagtggctcacacctgtaatcccaacactttgggaggccaaggcgggagggtcacttgaggccaggagttccagaccagcctggtcaacattgtgagaccccatctctacaaaatttttttttaattgccaggtgcagtggcacatacgtgtaggctcagctactcaggaggctgaggcaggaggatctcttaagcctaggagttagaggctgcagtgaggtatggttgtaccactgcactccagcctgggcaacagagtgagactctgtctctgaaataaaaaataaaaattttaaagcaattgagttcacatgtggcaggaattcttccttgtaagcagacaattcactgaagtttgggggaagtgagagaagagcaacatatcaccaccaaagtctattacccaaagaatcttcatgaaaaatatggtatcttccaaaagattcccttctctttattttgctttgtacttggtttagtttctattttagctgcataaaaaacatttgtgcaaaatttattgctaattatttagtttaatgcgtgcttcagttgcttttttcttccaaattttcattgatatgtaaggtctttctacattttctaaagtggtcctattgatacattttaggatatcaatgatgtgtagctcccacagtggcaaagccttgttcaaagtttaatttctatagcttccattcatattgtcacatagcaaagctgtgagctgtgtgcttgtctgaatcacatgcttacacactcacacacattcacacactcacacacacaatctgactcacactctagctttgtaactatcttgtgattcacattcagctagtattcccacccaaagatgtaaaaggtaagaatccagtgataatataattcacatagctagatacctttccattttctttaaaaaaacagcaaattacaccagtgagaatggctattactaaaaagtcaaaaaataacagttgctggtgaggttgtagagaaaagggaatgcttatacactgttggtaggagtataaattagttcattgtggaaagcaatgtggcgattcctcaaagagctaaaaacaactaccattcaacccagcaatcccattattgggtatatacccaaaagagtagaaatcgttctaccttaaagacatatgcatgtgaatgttcattgcagcactattcacaatagcaaagacatggaatcaacctaaatgcccatcaatgacaaattggataaagaaaatgtgacacatatacaccatggaatactaggaagccataaaaagtatctattttattgatttaaatcttattcatctccactctctagtaactataatctttatatgagtgtatctcaacacaactgggctacatattacaaagaaatttaaaaagtttatcagccaggcacagtggctcacacctgtaatcccagcactttgggaggccgaggcgggtggatcacctgaggtcaggagttcaagtccagtctggccaacatgtgaaaccccgtctctactaataaacaaaaattagccagacatggtggtgcatgcctgtaatcccagctactcgggaggctgaagcaggagaattgcttgaacccaggaggcggaggttgcagtcagccgagatcgtgccattgcactccatcctgggcgacaagagtgaaactccgtctcaaaataaataaaataaaaataaaaagcttatcagtcttgaaatagcacaacattccaggcgtctgtttttccagagagacgttttgaggataaatgtactatgagtgggaccagcccctcttgacaactaaggatattccttttgtctggcttgttcagaagtactaaatattccaagaaaatcaataatgatgttttggtttagttcttttttttctatttttaatttttgtatgtacatagtaggtgtgtatatttatggggtacctgaggcattttgatacaggcatgcaatatgaaagaagcacatcgtggagaatcagttatccattccctcaagcatttaccctttgagttacaaacaatccaagtacactctttaagttattttaaaatgtacaattaagttactattgactataatcaccctgttgtgctatcaaatagtaggttttattcattctttctaacttttttgtacccaatcaccatccccaactccccctttccagccactagtaactgtccttctactctccatgcctatgaattcgcttgttttgatttttagatcccacaaataagtgaaaatgtgtgatgtttgtatttccatgcctggcttatttcacttagcataatgatctccagtttcatccatgttgttgcaaatgactgcgactcattctttttatgactgaatagtactccattgtgtatatgtaccacattttctttatccattcatctgttgatggacacttaggttgcttccaaatcttagctattataaacagtgctgccacaaacttacaagtgcagatatctttttgagatactgatttcctttcttttgggtatatacccaaacgtgaggtttgtaactcacatagtgattttttattgcaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtattgtcacaatgagattgcgggagttgctttcatctttgataatggctcagacccttctgttatttactgtgtgtttctgactgattcttctcaacagtcaatattttaatgccttcggatgatttctactgttgtctgtttcaccacatttatcttcctgtgacccatttgtcattagtctaaccatcttcatttaaactattaaaaaggcagagctatttgcattgtatcactgaagctggcagtgaaaataatgctcccaggatagatttctttttccttttagtttttcgagaaatttcaagtagcctgtttagattttgactgaagtatttttactgcttaattgctggcagtacagaccagcatatgaactgaactctgttgttaaatatggatcatcgtctctaacccttcaaaggaaattcgtgaactgtacatcctacctcctctgtaggcagtggcaatttttatgcagtaacattcagcaataccctatttatccagctttgtccaaaagtgaagtcgttgaggaaaaatatctggaacattaaaacttttaaaacttctgtggataaaaaaagaaaaaaccactttctaaaatatattataaacatccttgccataaacagcagaccttaccaagcagaatgtgttcttataaaattgggtcattattagaaacacagttgggtactgcacaattaagcatgaaatcatccaaaatcatgtttccatctcaattgtggaacccagtgttcaaacttgttaaatcagtaacctgaattttgtaaataaaacaaatttcttatttgtgcccaaactacaatctgaatgaagtagaaatggttaacaggaccacataggtggtaagagctttgaaatcacagttttgcttactgttaaacagcatttttatcatcttatttctggatttatggctgtattccaggcagactgaaaccattggaaaactggcattactttttgaaatttttttaatatttaaaaataaatatttttaaggataacatgaatactcatactcactagtatgaattagatgaattcttcatctgccttaaaatagtactcatgtagatgaagaggaatgaacaactctgggagagttgttaggaggcaaaatagactggatgttggtaatggctgaatgctgggataaaagagaaggagatgttaaacatgacttcttgtacaactggaaggatttggggttttgttcaagaagtgctgaaagagaaccagatttgggaagaaatcttgagtttgttttgaacatactaagtttgagattcttttgtgacatttaagagaagatctacataggcaatttttgtgttgggggtggtgcacatgtgtgtctggagctcaaaggagttataggctaaagataaacatttgtgattcttccacatattgatgtaatggaagctggaagcaaatactgaatgataaagggtagagtgtcttgagaaacttggacatttactggttgagtagaagaggaagggcttgcataggaagcagagaaggtgccagaaagaatgaaggaaactaggaagtgatgtgtcagggaagcagaaggtagggagcataatggtcaacaatgtctacatctgctgagaagtcaagttaaatgaggcctgaaagagttcattagatttctcaacttgaatgatttctccgttcagtagaatggtagagccaggaatggcttgaggaaaaagttggagaaaggaaattgagacagtggaaagatccaactttggagccataatgggtgagcctatatagaataaagaaaactaagcacagatctttggaaatacatacatttaagggggaggaggaagaagaggaagctgcaaaaaagatgaacatcaggaagaaaaccagaagagctcagcatcagagaacaaaaaccgtaggaaatttgtagaaagaggggtcaccaacagtgccaaatattaattgtggcgatatcaaataggatgaagcctgaaaaataggccaaagtctgactcctaggaggtgattaatagtccctcagagaattggtccattaaaatactgagggcataggcctagattgcagcaatttaacaagggcttgtggaagtggaggcagtaagagtagattcaacctttaacaaatgtgtcagaaaaaaatggaggaaaataaaaacatttggtttgtgtagggaaaagagtgatagtagcttcaggaaataagattggaaggaagatgttattttttttcaactgttcttgtttgcttttaggataaggcaatgtaagcaggtttgtaagatgggagacatgtctgtggagaaggaatcattgaaaatagaaaaagaggggaaattggagtatgacgctaaagctgaaaggaaaaggtgagatgtcaagggcatagataaagtgttagaaaggaaaagagaggatatttattttcttggagccaaagcgataggagaggctgggtaaaaattaagccacaaagagtttgggaaacaaacattgatggcagtttagataggccttcaacttttgtcagcagttttcatcagtctaggagctggggtggagaaaagggggatgttgtgccctctccaaagtctgggattcaggaggtatgtcgggtgggaggacaaaaagctaagaaaatcaagggtgtctgatatttctcatcttaatgtcattttctaaagctgtgaatgatggatagcttggactcgaaactcaactgccatttttttcaagttttctgtagtgagattggacagacctcagaatattttcttccacgatcataacctgtccttaatttttttctcattggtaccaatattcctccacacccaaatagcactgttactatgctaccttggcctcgttttctaggaattccctcatctgtctttcacaaaagctgcagataaacgtgtgccattttgatagaatgtccatgaacctgaaagagaaatatatattttctagagcttaacctcttgggtgacaatgctcaggaaacacattaaagtcaacagataataaattttatttttaatgttctggaaggcagtaatttcctgagaccatgttcctgataccttgaccatgtttacgttattggtcttaatcagggagaaatgatattttcagaagtcaaactgccattccctttctaataaaatatgctctgatttttgggcattgtagggtagtaaaactatactgggggtatatcacatatagagtgttattattaaaagccatgataggagaaaggctcctataaatgcattaagacctcattttttctagaagtcatatccagttattgggaatacagccaagataatataagccaaaatgtcttccaagagtcagaataggtgctataaaatgtatgcaccttagtcttcattcatgagtttctgaggtacttacccagagtgtgtttgctctttcttaatttagacataattgtaataaagatggggatgtggtttcttagcacatagctcattagggcaaggaatatacaggtatcaatagaaagtacaaacctcagttaaaaaaaaaaacttaaaaccttactaaagagcctcatagtatcctgggatctttattacaaaatcaaatcgttccattgcctctcagtagtctttagtatatgtatgacaccagcaggcagtcatcaatactctcataggtcccttacaattcttagaattgtcataattctctgtaatattgaccctgatttatttccctcatgagctctatttttacattatctaaactggcacccctgcttgtgggagtcactcaaagccgttctctttatacacagtctgcttttgttcatctgaaatttagagcaaatgaaaggtgatggtcagcggtctggaaaattcacatatctgtatcacatttatatcacagtgttgccaggtcactaacatgtagcagtaattttgttcccacctctaagccttggtcatttcttaattatctgcattagtggacgtaagcagtggctggtatcatcaaaaacaggtgatagtccttaatttttttttattttgagtttggaatacttgatttatttttttagtggatttatctctcccccaaaatttccttaggccaatattaaaattagcttatgtcctaactattatacagtaagagcagtaagtggcagctcccaaacattttgtatgacagagggaccagattagagtggaaaaagtgatcctggagtagattgtcaccatgaaaggactcagtctacattagcaagaaaaaaaattgtgcttttacattgtacagactacttatataagcatgcaccagagattgcttatgtataaaatagatacattctaaatacttggtgcatcctgtttttttaagaacatgctagatttttcaaccattttgatacagataaaagcttttctttatgattcagagaagccttagaatagtttggctgtggcttctctgtgtgtcgttggggactttactgtaacaagcttactgcataagcagaggctgtcacctaagggtaaatggctgcttggtaagttttattgtctacattctgaggagttgcatcttgaattggttttaatctaccaaccaggggcatgtattaaaatacacattttcacaatgatagatatataagtacatgcatcattgtgaatcatgatgtttgtaaatttattgctatgagccatatctgcaactcaagatagctgttggtggggattggtttttatgtgtgaacacttactaaacataaaaggaaattcaaagttatgtagttactatagcaacgacagctaagacacattgcagattcacatacattcatgtatttaaatcaaacgcccatatataaatatagtgtgatagatttagagttgctatggaaattgagtttgagctttctgctttccttagggacttcagtgttttagccttaaaatcagattaataggaatgccacaaaagtggtttcaaaaggaagcaacctaagtagaatagaataaagtatttgagcaatcataattaaatccctaaatgtagatttgaataaatcctaaggtgtttttcaagaacattgttgaatatttgaatattctcactcaacaattacccttaatgttgggttttctaaggctgtttgtatgactgtaaaatgtaatcatgtttattcatttatttgtttagcaatgtatgagcatttgttgagcacctgtcatctaagtactcatcacctctcaccttcttttgggaaataagaattgctttactttgttgggttttttgtttgtttgctttgctttttaagagaagcagtaaaaaatagcagtaaggagtggttttcatccttgttctgatcttggctttatggcccaggatgtagtcttttttggtcagcggaccacatgcacttgaaaagaatgtgtattctgcagtagttggttgtatagtgttttagaaatatcagttagatcaaggtgtttgatggtattattcagatcttctatgtgcgtttttttacttacctaataccagtgtcagagtaaacagatctgtattttatggatttttttgttgtccagttctaacatttgctgcagagtctgttgaattttcctgcattgatcatggaattgtccatttttccctttaattctctccatttttgtttcttgtattttagtgctctattactagatgtatatgtatttatgtatttacgagtgttaagtcatcctgttgaattgaccttttttgtcttcttctaaaaaaaaaaagggatacatgtgcagaacgtacaggtttgttacataggtatatgtgtgccatgatggtttgctgcacctattgaccagtcctctaagttccctcccctcacccacaacacccaaacaggccccagtgtatgatgttcccctccctgtgtccatgtgttctcactgttcacttcccactttgagtgagaacatgcagtgtttggttttctgttcctgtgttagttcgctgaggaagatggcttccagctttatccacatccctgcaaaggacatgatctcattcctttttatggctgcatagtgttccatggtatatatgtaccacattttctttatccagtctgtcattgatgggcatttgggttggttccatgtctttgctattgtaaacagtgctgcagtaaacatatgtgtgcatgtgtctttatagcagaatgatttatattcctttgggtatatactcagtaatgggattgctgggtcaaatggtttttctgattctagatccttcagaaatcatcatactgtcctccacaatggttgaagtaatttacattcccaccaacagtgtaaaaacattcctatttctccacagcctcgccagcatctattgtttcctgactttttaataatcactattctgactgtgtgagatggcatctcattgtggttttgatttgcatttctctaatgatcagtgatgttgagctttttttttttttcatatgtttgttggctgtgtaaatgtcttcttttgagaagtatctgttcatattctttgcccactttctaatggggttttttctttcttgtaaatatatttaagttccgtgtaaattctgaatattagaccgttgtcagatgggtagattgcaaaaatgttctcccattctgtaggttgcctgttcactctgatgatagtttcttttactctgcagaagctgtttagtttaattagatcccttttgtcaattttggcttttgttgaaattgcttttggcgtttttgtcatgtagtctttgcccatgcctatgtcctgaatggtattgcttaggttttcttctagggtttgggttttacatttaagtctttaatccatcttgagttaatttttgtataaggtgtaaggaaggggttcagtttcagttttctgcatatggcttgccagttttcccagtaccatttactgaataggagatcctttccccattgcttgtttttgtcaggtttgtcaaagatcagatggttgtagatgtgtggtgttatttctgaggtctgctccattggtctatatatctgttttggtaccagtaccatgttgttttggttactgtagccttgtagtatagtttgaagtcaggtagtgtgatgcctccagcattgttctttttgcctagaactgtcttggctatacagggtcttctttgattccatatgaaatttaaaatagttttttactaattctgtgaagaatgtcaatggtagtttgatggaaatagctttgaatctataaattattttgggaagtatggcctttttattgtatgaagtgttcctctttatctttgataatattctttgtcttgaaatctattttatctgacattaatctagctactccagcttttatatgcttactgttgcatggcatcatctttctccatgataagttaaatttctgcctgtctttgtctttataaagtgtgacagcatgtaatcaggtcttgcttttttattcattctgataatctttactgtttaattggagtgtccagcccatttacatttcatataattatgtaattattgatttggttggatttagagctaccgcattatcatttgttttctgtttgtcccctctgtttcttgttttgttgtttctcccttcctgccatcttctggatttttaaagtattttttagaattctattttaatttacttaccgccttttaaactacacctctttgcactaattttttaggggttgctctaaggattacaatatatattcttgttttttcacactatcctttaaattaatactgtacacctttatgtaaaatgtggaaaccctgcagccacccctatagttgtcatatgtattacatttacatacattatgaacctcacaagataatgttataacttttgctttaaacctacactgtctaatacacgttggcttttgaacacttgaaatgtgcttattcatcattaaaatgtgctgtgtgtataaaatgcgtgctgaatttagaaaacttagtatgagaaacagaatgtaaaacatctaataatttttgtattgactacatgtagaaattatatttcatatatgttgtatatgttttgcgtatgttaaagtcagtggagtttttttacctttttgatgtggctactagaaaacttatgtggttcacatatttctattagatggttatgctttaaacagtcatatctattgtagagaaattacaggaaaagttgtttatttcatatttttactattttcaacgttcttcatttctgaacacccaagttccctagcggtttcatttctcttcagcctgaaggacttttgttaggatttcttatcctgcaggtccagtggcaaaaattattttagattttctttttctgtaaatgtctttattttaccttcattcttaaagaatattttcacttgataaaggattcaagctgggttttgtttttccttttgttttattttttgcctgtaagcactttaaagatgttattccactgcatgtggcctccaaagataagaagtgcatactcattctaccctggaatggaatacatagtttttctctgagtgcagtcaaaattttctccttatctttggttttgagtagtgcgactatgatgtgcctaattatggttctgtttgaatttatcttgtttcagagttcattatgcttcctgagtctgtgaatttatgtctttggaaagattccaagcattattttttcaaatatttttttcagctccattctttctcctgtccttctgggacttcatttatccatatgttagagcttctgaaattataacacaagtccctgaggcacagttgattttcttcccagtacttattttctctcttctttagattagatggtttctgttgatgtaaattcaagtttaccctctctttcctctgtcatcttcattctactgttgtagaagtcttcatttttaaatttcagctattgtatttttctgtttacttttttttctttctctgctgagtttgcctaccttttcattcattatgagcatatttcctttacttcactaaacacgcttatggtagctgctttgaaagtttttgtctgctaattccatcattctggccatctcacaattgacatctgttgattttatttttctttgagaatatgtcacattttcctggctctttatatgtcaaataattttgggttatgtcttagttattgtgaattttagtgctctgaagactggattttgttatattgctgtaaagagggttgatgcttgtgagttaacaggcacttaactcaattagagtccaagggaaaaatactcaggaagttaactcccattcaaggggatcttcaaggggatctaaccttagcctcaggcctgtctgtgcctttatgcaagacttcgttttccttattattgcaaagtggcactaaatcttcatttaccttttgagaaactccttaatttaaccacaaatgttggtctttccctaaagccattatttgctctaagaaattcactttaggtcagtctatgatggcatttgacttaccggagccctgtagggtgggcacaggtactcttcttgtcccttgatggtcttgctatcaagatgagtcatgcctgtttattcttacaattttccagtagatgcctacttgatactgctattttacagtccccagtcacttatccacataccatcctacccaagtaccttacgtatgtctttaaggatcaaatattaattttagaaatcatgtaataatacaaggaaaagatgcatttttcttactagccccataattagcaagacttctcttcaaatagatgttagtacttctcattattatgcagaacactgtttctttctttctttccttccttcctttttttttttttttatggacggagtttcactgttattgcccaggctggagtgcaatggtgcaacctccgcctcctgggttcaatcaagcaattctgctgtctcagcctcccgagtagctgggattacaggcatgcgccaccatgcttggctaattttgtatttttagtagagatagggtttctccatgttggtcaggctggttttgaactctcaacctcaggtgatccacatgcctcagcctcccaaagtgctgggattacaggcgtgagctaccacacccggcagaacattgtttcttttacccaacccctaccccatattagcatggcatccttttgacctgttcatattaagaaactatcccgttgctaagctgcataccatttaatgcctactcccttagctacatcaagacttggagcaaatagaaagaaatattctaatggcccaactaattaaattattgtagaagatcccctactccctggaagaagagaggtagcagtggtttttttcttctgattacatgtgtaagatgtataaaagacactgctagacttttctcctcaaagaataactgaaactgcatttccctacattttagtctgttcaggcttctataacaaaatgccataaactaggtagctttgtataaacaacagaaatgtatttctcacagttctggggactgggaagtccaagaccaaggcaccagcagattcagtgtctggtgagagcctggtccacatacatggtgccttctcattgtttcctcagatggcagaagaggcaagcccccttaggcctgttttataagggcattgatctcattcatgagggatctgccctcacaacctagttacctcccaaaggccccacctcttaatactactgtgttggggattaggtttcaacgtatagatctgggggggaacacaaacattcagactatagcacctacctcttatgatgataaaaaccccagcataaaatatgagcagtgccctgccttgccaggacactgaatatttctgaatttaaactattgagcagagagaagagcagaaaattatgaagaattctggagtttcaaataggaatctcctggcagcgtctgtagaaaagcccaagggcttcttcctaggaagagccatacatttttcattgccatcctaatttctttgcttactgaggtagcatttttgacagatgatttactaattcaatttgcaatttttaattattttggctttctgggtcaaagtatgtacattgttttttaaaaaaaaactagagtgttttaaagcttagagatcaaaaactacagaatgttgtgatactattactttgcaactcagaatctgaatcttaatatgaatagaatttttcatgaaagttaagggaaatgaaaacatttaaaatgtggaaggaaggccaggcacatgcctgtagtcccagctctttgggaggccaaggtgggaggattgcttcagctcaggaatttgagaacagcctgggcaacatggcaaaaccccgtcttttcaaaaaatacaaaaattagccaagcatggtggcacacacctgtagtcccagctactcaggaggctgaggtgggaggatcacttgagcctggggttcaaggctgcaatgagccatgttcatgccactacactccaacctgggcaacaaagtggaaccctgtcccaaaaaaataaaatatagaaggagtcatcagtaatattagcaaatatttattgagcacatattaagtgtcagctattatcctaagaacttaatatgtattcagcaattctaaaagacagatcatattattaccctccactttaaagttgaggaaactgaggcacggagaggtttagtaacttgccagggtcacacactagaaggagaggacttaagatttaaggcctgactctgtgattccagaatccatgctctttcatcattatattatattgcgtctctcatatgtcatggatgtggtcttgttttctcctcttacctcctccccacactatgctgaaccacggtaaatttcacaaccaaattcaaattacatggtgtatggaggatatacaaagctctgcaatgttgcttaggcttgagacagcagaacatatgctgttgtattgcgatgacatttttttttatcgtgatttttcaaaagttcaaaaacatttcctttcatccttacagtaggttctagggtgagagagagttactatactgtagagttactgtctacatttatagatgcaggaaatgttaaaaccatttgttccaggcctcttattagctcaaaagcagaagtgtatacaaagccaagaatattgagccctagattagtagaattactaatctctgatttcttaatccttcaagtcaattagctctccgtgtgaatggtctgggtgatttgaaagtgaaggatagatgcaattggcatgtatttgggcactcagagtctgttccttcacacagagctctgcagaggagggcgagggtctccactgttgtcctccctgcactggaaggcagaccatcctagccctttttaaaacagcattgggtcattaatcttatatagctgttcctgatatgtgttgaaatattaattctataactaaaccccatgtgctcatctgatggatcattccttttctctccataggaataatatcagattttacttctcagcctagctgtaaacctcgccaggccacacaagacagtgacttaggattcattcttagtttccacagcagaatatcatagattgtctgtgaacctatttttctttattattgatacttttttttgttgcttagtatattgggcaggaatcgaaaacagctttgacttgtagaattttctagaatccctttgaattgggtgaactacactataactcaactttgtcttgctcaatcattgttcccccattgcctggcctgtagaaggtcctcatataattattgagttgatgagtttaagttgaatcattgcagcattcatcttgatcaaggaagatgtagtactcagtcaacacatggctgtttttgaagtgctctccagtcatttccatcacctgagaagccccttacactgtaacttagaaagtatgctagtacactacacagtagctcagaaaatgtttccttttgaaattttgtttcaatagtttttggggtacagatggtttttggctatatggataagtcgttttatggagatttctgagattttagtgcacccatcacctgagcagtatacactgtacccaatatgtactcttttatcccacactcagcccccaaccttccccacccccgaatccccaaagtctgtcatatcactcttatgcctttgcatcctcatagcttagctcccacttagaaatgagaacacgcactatttgatttttcattcctgagttatttcacttagaataatggtctccagctccatccaagttgctgcaaaatatattatttcattcctttttatggctgagtagtattccgtgatgtatatataccacattctctttatccactcattggttgatgggcacttaggttggttccatatctttgctattgtgaattgtgctgctataaacatgtgtgtgcatgtgtctttttcatataattacttctagaaaatgtttcttaccagttcctactttttggattccttgctctttttgtgaaagctttacctgaattctcagtcattcttttttactaattgatttagtttgtcaacaaatgtttgttgaagcactgtaagagattctggagatacatagtgattctgacaagacctgttttcaaggaaattaaatcctagtgggaaaatctgacaataaataggcaatagtaatagaggcgagttccttcagcatatataggaagaacacctgagctagtcttaaacatcttctataaaggtttctgaaaaaagtaaagttcaagcaaaacttaatgtataagtagatgttagccaaacggaggtgtattgaagagcattccaggcagaaagacaaggatgctgaagtcgaaagaatgtgctccattcagtaaagtgcatgttgttcagtgtggatgttgagatatgagactgcagagggaagcggggctcttcttattgctacaaaaataaaatcacaaacttagcagcttaaaacaacacttatgcattatttcacagattgtaaagtccaggcacaacttagctgggttatctgttttaggatctcaccagactataatccaggtatccactggggtggtggtctcatgaaaggctcaactggggaaagatttgtttccaagccccctcaagttgttgacttgaggctgcaggaccaaggcttcagtttcttgctgaaggccaccctcagttcctagaggccacttgcacctccatgccttatgggcttttccaacaaagatgcttacttcgtggcaactgcttcttcagggcagtaggggaagtctctctggtgtgtttgtcagcaagacagtcatgtagtaacataatggtaagagtgactcccattacctttgccatgttctgtgggttagagtcaggtcacgggtcttacatacactcaaggggaggctatcatacaaaagcatgaacaccaggaggtggagatcattagggtaaggggattactgtaggatttgtttgtcacaccgaggttacactttatagtagggagtcatggaaaagtttaagcagaagcatgctttgtattatagaaaacacattagagagggcacagttagaatctcgtaaaccagctgagaggctttgcagcaaaccacatgggagaagacagtggccttaatgaaggtagtagccatgcgggtgatggagaccgtaagatgatacagtcagcaaaattggatgattaatgggttatgggaagtaaagcagaggaggaaattggggataaatgttacacacatttctgacttactagtcggttgatagaagcagagatccctggaccaggagcctggtgagcatggggctcaccgcggagttctcccttccctgagctccagcctgccctgtggcctcagaccgtgtctctcttagccggagagtctggataagatggtgttaatggagcacaacaggctggccaccatcggaaaaacaaccgcaaacactggtcttgctagttattggtcaacaggggttctgactggagtctaaaggacaagacattatacacttagtacttacgttcccccaaaatgaccatcctagtgtataagctttttggttaaatgactgctgcgtaccaggagtgcagtagcacccttgatgtagttgttgtggtgacacctgtgtgtcgtctgcccagtgggctggctcagtgtgctgggctctgtcaccatcttcccctgttactgcagtaaacaggcgaaggggtactctaaattattgttgggatgtggtgtgtgtggttttcactggggtgagtgagcctcaccatttctgttgctctgagaatgatcaaaaaataatattttaaatgaagatagtgattggatgtgatacttaatgtgttttaaaggacacttaatattttaccaagatgcgaggggtgaaaagtcagtagtttattgaaagaaatagcatgttgaaataactatttaaaagagaatttttaatacttgagccattttaagatgcagaacgctttcctgcatttttccccctgtgaaaaattctctgaaaccagagtgactcaagcagagcctggaaaatactggagaatcacatgatggctaaaaataagcacatcatctctagcagggacagtaagcagcagggcagaagtaactcagtatgtgaaggctcacactcactggacatgctcaggagagtcaggccctctgtccttggcaggggcaggctttgagaccacaagtcagcgaagagaggtcctcaggtgctgaccactctgtgccacagcagccatgccctcggcaggcccctgacctgcagcgcgcctcactcgtatgctctcccaggggcagagccatttattttacactgtaatgacccctaaacagtggattgggagggaaaccggctgactcagctcttgttactgcccgttttctcttaagccctccccttggaatcaatagcacatgccattgatcacagaatgtctttttgttgctgttaacattgcaaaacataggttttgtgaaattgctggacatttggcgactgttctgtagggtacagaatagggtttcctaaactatagcattgcaagtactttaccaaaaacacaacaaatcttgtcttgggcactcactgctcatacccaggaaaattactgcagtagccacctagctggcctttctgcagctcccctcagcctccctggtctgttctcaacacagcaggcagagtgagccttttgaaagcaaagctagatcatgtcactctgttcaggatcctgcagtggcttcccttttcccttgcgaggtcctttgcgacctgcccttccagtacatctctgaccttctgtctacctacagtatcccattcttaccctgcctcacccacctgacctggctgctgagtggagaaggcagggcctttgcacccccattcagcatttcctctgcctggcctgctctgctcctggctgtccagacggccaccttcctctcctgcctcaggtcttggctcaggtctcacacttactgtgagagaccttgaagaaggaagggttactcctgcaactggcatgttccctgcagggaacctggaagttgtgactatggagtttgttacaagagctgttggcttctgtgaagaatgagacttttgagccccggtgaccccacacaggaggttctcgcctcccgtgtctgtgccagactgctgcaggactcccagcaagaggggcacctggcgctgccctgctggtgcttggtgttctgacctccgttcttctgggtggccttggtgtgagtgtggcccatgaaagtaccatgggtctgagttgaaaaactgaaactggaggaagacccatagtggatgcttaggccttccatgaaattcctatttaaaattgctacttacccacccgcagcccagctctgtctacccaaccctgctctgcttttctcttgttcatagcacttattttctagtttattctatcacttcctaatttatgttattatttattgtctagttcccctgttagaatgttaattccacaaggacaagcatcttgtgcgtttcattcattgtttgatctcaactgcctgttagcttcccaggtacataatagggttatggctcaataaaaatttgcacaaatgaatgaattaggataatttagaagaagcacagacggagatagatagggagtgcatggaatggaaggaacctatgccttggagcccattggtgggttatgggttaatcacattttttggttctaaaaacaaatttattgaagctgagcatatttacatgatgcagttgtgcatctttatacagtagttgttcactgtgtaaaaactgggttaatcaatttttataaaaatgttctttaaataaaaatgagccttattttcttagtatttcagctgtttttagtagtatctagaaatgggaaacaagtgcacttttgcatcatttgttgaatcaggtcttatttgctgagtaataatagtaatgtaagctaccatttattgagcacatgctgtgtgccagacccttgtgtaagcattttccatgtattaagtcatgtacccctcccaactctgagaagttggtgctgctcctcctttcttaaatgtaaagcaaggtggccacaaagccacaccagtcaggaagtagtggagctgggacccctaagaaggctctctggctgcagagcccccactcttgaccactgcactcactccctccctagaggcaggtgaaggatgtccaattccctaccaggtcttcattcccacgagattggtgtggctagtgcctgctgtgtggagctgcccctagctgctcaaggaggactgcccactcttaagagcctccactgaaaaggaagagctgcagacctcaccactggctgcactggtcagaacagaagtcctaagggctgtaaactgccaatttcagaattaaaaaaccagcctcctagtgatctcatgaatcagagcatcccagaaccctgttaaagtttcatttggatggaaatctgtccactgaggtgcttttttgccctcagctcagagcagattacagaatctacaaagtgacagtacggaggcagttttgaaggaaagactaggtcaatataacttgaatttgcagtaatcagaattctgtagggactggcaaccctattgcagtatgagggctgtggtgtcagttcagttactgaggaagtcctcttcctatggaattcactctcctcatcagtctagcccataccctttctccagcaatgacattacttttttttttaaccaagctcatcatctgttaaaaaatataatctctttgccaaggtgcaggggataagaaagtaatatcaaatccatccacaatgaatcaatacagatgcagtgtatcttctgccatagttgttcagctctgggttttcttcaattgagtgagaacggctagggggatggtttgggaagggaaggggctctcaaagtagagaaaaattgggattgaccatgaccagaagagtggtggccgcctgcatgtgtgtgtgcacacgctcatgtttttaatgtctcttgtcaacagtattaatgtcatatttttatctcctctgtttatgactttggcaaaaggaataatatggcagattatgtgaaaagaatttctaaattccagcagagtcttggccatgaaggataaagccaagtccagtgctttgatttgcttcatccttctgaatccattgggcctcatatgcccaacttgttgcagcgttttccataaacattaagcaagctactagttattgacattagacacggtaatgccctggcttcactaaggcagtgaatctgaccactccgaatttttttacaactatggttaaaatgtcagaatcatatttatacccccaaatcctaaaggcattaattaagacacaactgctcaaagactagcattgtaaatcatgtccagtgagcaaattcagagaattacagggacttagacagaatttatgcttttttcctctgcttctgagattcctttttattttgaaaggtaaaattagggaggtagaaaagcttgagggcaaaatggttacttgtaaacagggccactactaattatgttctcaggacatcctcaaatgcagcttgaaaaaaaatttgaaatgtttgaatcagctgcaagaaaaaaaaatctatatctgtattacagccaaagtaggtgcactctctgtaaaagctgttatgtaaatgttttccacataagcatcattgagccaagaggcctggtaaaggtacagaagtcaaatcactgatggagtggggcattctgggaagcaagaagatagctattgaggacttcagtatctaaaaccaggattggatgctgtcagagacatgtttggagcagtttacgagattggaatacagatggtagctcacataaaagtattctatcaatgttaagtttatgacattgataactgtgcagttttgtgagaacattcttgttctagtgcccaggtaagggggaaagagtatctggcagccccagaaattttagagtgtggttgttagaaggcagcgagacctagaaagcaaataaacaaaaacaagttcttaactctaaagagttatgctgtatgttaggatattgtcttttatttattctgaaaaagaaaacatgaaatcattgaatataatgaggacaaaaggtttcatttttatttttatacatttagtatttcttaatcatgtgacagctgtgaggggtaaattacttccgtttcaaattgcagcttgggatgatttaatgagcccactttacatttatttgaaaacaagcttttagtttaactgttaattatggggtttttttgttgtagttgttgttttacccaaacctcggaagatactaagatctttcccatgcctttcctgttctttaatttcttcacatttattcatttgaaggtaaaaatgtagttaagtaggcctgatctcacatatcctcatgcatcatttattttcctgttatcagtttttctccgaacaatagaatttcaagatccctctcattttaaatatcaaatactagttacctaagtgattgattattaaatgtttagaattttttttccatttcttccttcactcagcctgcactgtgtccccgttagtgaggcttaacggtggggcagaagcggtgcttccatcccacatgtgtgtaggtggtggagcagcagaggttgccgagcctgattttcatcgcctgcacctctctcatctcaaagggatccaggaggtgcacgtgtgtgtgccagtgggaaagccctggggccctaggccaccacctgacctttgcctgattcgtgagcacagatgccattttagggccgagactctgctgaaccacagcttggtgagtccaagccacacaggcaggttgaagttgggctctgttaacagaaagggatatttcctcaggggaagaaaacaaaacaaaacctgtttccccaagtggctgtgtgtggctagaagggggagagcatcagtaactgcagcagctgtgccctccctccctgccgtgagccatgctgagcgcctccagcggccggggattctccctgcgtgtctcactgctctcctggccagtgtcctctgcttcttcatagttgctcttccccgataacgtggctttgcccaggggtttggcttgccatgaccccttctacatcttatcaaacatttcagtttttttttcaagctctgtttgataataccctgagaatataattagtggtagccctttattgtaagcaatcagcttctgtttcttccatgattttttctttttaaattgacatcagactggataaggccagataccagaacatgagtgtgtctgatgatcctagctcagttattgcaacgacttttttgttgctgacctgcctatgaaagactgccagggtgggtgggtcgtcacatgctatctagggaagccccctctgcaaggctgtgtccctcaggaggggccagtgagcatggcacaggcttggacagcccagcatagaccactcagagttaagcatatactgactgagtttactccacctctcctaattgtgtaggtaaggagcctaagtaatttacagaaggtaatcttaagaggaaaccaaggaggagctctctttctgggaggctgatggtttttatttggtttccttcttgtcttgctggttctttgtgtctgtgactttgacattggcatcagctcctcaagcttcccctggtgtccttaccctggagagatgcctctgctaggtcttatataatgaattataaaaactattattgaatttctctgggttaggcactgtgattggtggtgagagcataaggtgactaaaacagatgaaacacctatgtcctagggtttatgttcatgggagaagtagacattaaagaaatagctgtaccacaacagtggaaagtgttcagggcactgtggcctcccagacaaagtgacatctgagctgagactggcagggtggtagacctacttgctcagaggaggtaggggacaggaaggaggcagagagaatacagcctgacttgcatggtgtattagttcttacagtgccataaagaactgcccaagacaggataatttataaagaaaagaggtttaattgactcacagtttctcagggctagggaggcctcagaaaacttaaaattatggctgaaggggaagcaaacatgtccctcttcacacggcagcaggaaggaggaagtgccaagcaaagagggaaaaagccccttaaaaaaccgtcagatctcatgagaactcactcaatatcacaagaacaacatggaggtaaccgccccccatgcttcaattacctgccacggggtccctcccacaacatgtggggattatgggaactacaattcaagatgagatttgggtggggacacagccaaaccacgtcacatgggatggtcatggagtcatagaaccctggcttgttcctgagaacattgaaggtgccataccagaaattcttagatagctgttgctctgtgtgagactgagctagagaacaaagactgcatcttaggcatttttaggggcctccagtgcatggcccatggcaggcacttaacaaatatgtgtgtaaggggtgttgatcataggtagtcttcgcactgctttctgttagacttcctttatattaaaatatgaggtattgcttataaaaagatctgaaagaacttgatatttccgagctgtctccccagctgttaggctggtggctgcctcagagaagattctttgccagatcaggtgtcctcaccctgcctcccctgcctgcttgtctacttgttttctttacccagttggtttgcctttgggttaaagaacttggtcagcgggacatggaagtagtgttccaggagtgttttatatgggcttcaacagagctgaagcccatataccagtcacaaagcaaaacgtcagctctctggaaccctggggaagctcttctgcacagatttaccctgagaatattcaaactattttaagtctttcccaatttaaccattctcattttaaagtatattaggcacctccctgtgtttttaaagaagtttattttttaaaaatttttaacagaaaggcttatatttaaaggctgtaatgctgtcagtgcttctagggggtgtgacttgcatccggagctaatgaccccaggcacctgaagacacaaatataaattttatggtctttctgtttgctactttgtaattaggatgttggttgaaacttgtaactgctgtcacatacctgtctttataacccttcggctcttgctaatctcttggtactaataaactgtgaagttggaaataaactgtaaaattggaaaccgcatcactaaaagttttatttacttgtttatatagttagttaaacttttgctctttaagcaaatacatgttcagctgagcattgtgctacgcactggggttacaaagatgagtaagatgtgtttcttgctctaaataagagcaggggttggggaattaggccagtgggagcacagagaaggaacacctgcaccacactgaaggggtagtggaagacagagatgccacttcacagggactgtgttcagaggaaaagggaatggacgggcccccagtagtggcttggaatttcataatccatgaagtacactgcgtatacattgggacatctattttggccgcagaggccattcttgtgtctgcgcgttgttctaggtagtgagagtctattgtgacctgagctccagataggcgaggtcttacctgaaaccaatggtttttcttttttccacttcacaacattattagtgatgctaagtggatcacttccttaaggtgctgactctcagatctccccattgtaagggtgtgttttcccctttagagtaacacatgtaaatatcttgttccccaaaaccctctcacctaaagtttacgtgtccaatgacgagccctttgtgaatcgcttattagttacggatgttgcaaaattgtgatttattttctagttccagcatttcttgcatatttagtggctgccagtgttccttaaaaaggattgaaaagatctttatattcttttctcttccctctccctctccctgtcttccagcccatctctttttcagtcattatagattaatagatttttatttatccagtgcattacaataaatgaagctattgttcttcctgatattcagctgtcccaagtgtgactagttgagagccccttcaagctcttgatataaatcctggagcacctccttgctttttgacacaagatatcctaagcttaccctgaacattccctgcaccatccctagaatcagccatttctcaagaagcccttttattgcagaataacatttagaaaccaaagtttgggcatcaggagtgccactgctatggagatgtcattgctcttaggtactttagtggctaaagctaggaaatgttttaaaagagaaaaaaatacatttggattgatatttctgctgaagtattaattggttataagatcttttctcttgtttgttagaaattcaattagggtgatacttttaagtttatctaaaaacctttcctcttaaaaatcttaaaatccctttgttctcttactcttatatctccagagggagaagggacaatggcattaacctcatgttacttgaggaaaaaaaaaacagcactcacaaaggtgagataagttgcccaaaacaaccgtactttaactgtgtacactcctgctgaaatatttatactccttctatatgggaagggatcactggaggtatctcttatatgttgttgtaagctcttttcatatcattcattttctatgtatctaaaacacacttttaatattgccagtatttatcatttattctgattgctttcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtaatgcatcagctctggccacgcctctaggagcagtgacgtgtgtaagaggtagggggcctaggatcccctaggactggggtaagggagggaagggtaaggaagaatccttggtttcaagtaagtgagaataaaaagaattgttcgaagacaaaatcagtagcccatgatgaataaaaagtgttagtcacaaatctcaaagctgtacattaagatggggcagatggctcagccttgctgcagacttcaggctaccttcccctcccctgctcctcagggccgtcaagagctccaggctagaccgttgcccatcctgcccacttctggccattctagatagtgctgcattagggtgagtctgcctccctctctttttaaaggctgggtcagggttagtctgtctccctcccactctcttcttttttcccttcttcctttctttcttcagctattagtagttgagcttattctatatgaaagatattacgcttaatgctggtaatataaaggtagtaaaatagatacctttccttccttcatagaacttggagatagcagttgcacacagtaagttattacacaagcaaaacaaaaaacctgatacttcccacaatggcagaagttgggtgctgcaggagcaccgaacccaatatttgggggatctgaaaggccacaattgtgttttaagtagaagagctttccttttaatttaatatgcctcacagttatggtaaaatctaactagctccactagtctttgaaattttcattataaaatcttaggtactgctcatctttcctaagattatatgtagcttaaaagtaataaaagcaacgggtagtggagggcccatcgaggagagccttttatcctggctaccctgccgctatgagaggagcctttacttcagggccccaggctgttcccagccgctcactgggcccgtcgtggtgattaatcttattcttgatgagccagcaagagtttaaaaacagcttttgtgataattgtatatttgtaatcaagaatctagtttaatggaggcagtttcttagctagggtgtttctttacaattctgatcactttatggaaaaaggtataaaaacaagccatccagcaggtaggacttggatttggaaactagaatgttctaattacctgctgattctcagtttgagccctgtttccaataatgacttcttctcaattaaaaggcagtaaggacagtcataatgaaccttggtccacatgcctcaggctccaagaaaatcagagtagacctaaaggctgtaatgccttggacctaaagttagtcctcccatatccatgggttaccacatctgcacattcaagcaaccaagtattgcaaatattcaaaataaaaaatagcaatacaaacataaaagctaatgcaaattaaaaacagtacaacataactttacattgtattaggtattataagtaatgtagagataatttaaagtatacaggagtatgtgcgtaggttgtatgcaaatacgatgccatcttgtatcgtcttatatcagggacttcagcatccatgggttttcatatctgagggacatcctggaatcagttcctctcagataccaaggcacaactgtagaactctttttccttaaggaacccaaattcttttggtatctttcttatcttgtgtttcttcatgactcctccctctcttccccgtctgccacacccagtgtcccacctctccagcccaaagtataaccacgtggaaaccttgaggttctctcccgcttatagcctgaaccgcccagccccacttcccctccttggggctggctgtaggctcccgctagctctccagatcacacacagagccccatccccagggaactcagacctctaaaatgcctccactaaaccatgctaccatccacaatgccactcagagaaccgagtgagaagagagaggaataggccagtgccgccttcctgttataatcctttcattacttcccaaaggcctgcctccccatttctgcccccaacaccttcacaccgaggaatgtgcctgcccctgtctgtccctcagaaggaagacacaccctgaattctgagtccttcaatcagtattactgagcacttactccaaatttatatccgtggttcactgttgacgttccctcctttttctgtcttggagccaacaggatgccccctgagcctggtagggggccccacaggcatcatggtgttggaacaaagaacactcgggcgaggagaggctgaggggagaccctgatgctgaagggtgaagcacagtcatcactgagaaagagacaagtgccataaacttagaggagtctcatttgcttggcctcctgcattttctcaggcaatttcccatgatgcactacagaagtaccactatgctagaccattcccatgatagaaatgaatcaaaagatttaggaaaagtcataaagaaagtaattagggactcgttctgtatagtgggttagccacccagaagtgggttggagtcagtggattagccaactggaagtaggttggtcttcgctcggagcgcgggtggggccacggatgggtgtcgattagcccaggcagagactatagccatcactgaaacagcaaggcctgcaggaacctgcagtctatggccacactgggaggagttggaagaatggtaagaagagtgctgcttctcattttctaagatcatctacagcatctccttcattgcttaagcatctgccataacccaagagggatgaggctggcattggtctttgtgagggggactatgacagtggaattttgcttgccaattgatctttcatcatgtaagttagctagtgttggtttttactagggaatgttggtagtggcagctgttacctaatgcatgtggaatatcactgaagcctgatttgcactaaagggttgtctggaaaagcctcagctatgtgttcattgtgcagaacaaagccctagggagccagacagacctattttcgtgggttggatgtgtccttgcctggtacagggggctgggggggggtggcacatctaagctgccacagatccatctgctggcactagcacagggttgagatggattttatgtccaaacctggggagaggttggtttgttttaaagcaggaaaggatttctagaataagagttttcttttttctggaatttaagctggtcaccttcagtttttttgtacatcttacaaatgtgcaagctatagtattaatagaaatgagttaaaagcaaactggttctccactgctttgcaagcagccacatgggggtgtcagtgagggtaaccctgaatctacaggatggatatggtttgccaggtgcacaggaagaggatggacactgcatgggctcagtgtgtgtttgaatgaatcagtaattccagatggataaagcatacacaaaggcccagaattattagaaggagagaggaggaaatttgcattccaaatgtaattttttgaaattctattaggggtgatttttaaggtaatgacagagagattttacctaaggagggccatgaaagacttaatttaccacctgaagcatataccctacataaaaataaacgaagggtttaaacaaatggggatcctcagagaccaggaacggggtaatagtttgggcctgagtgtagctgctgcgcctgtgggactatggtagactgagatttgaaaccagatctagtcacaaccccgtgagggtttctttagctctgggtgtccgagttcttggaccctcttttgaccactgcctcctcccttcacttggactgttctgtagccaccctgagaagctgcacaaccctggaaactctgaaccaggatcgaggggaagaaagaggaatgagggctactgtggtgagggaataggccttccttgccctcctgccttcccagtgacgtacccaaagcccgaactagagaaattgagacagatccactcagccaggctttgggtcttacccagttttcctcgtgtcacgaaccctcagtttctccctggagagcgtttgtctaatgtggctcagtatcatttgtgaaagggtctagctaagcgtggcttccatgtaagtgatctaagggacggagagtcctcaacataaaactaaatagccatgcttacagcctctctgttctgcttctctttcctcctcccattctccatttcctgcagaagatgaacaagtatttcagtctgttcaggctgctagagcagagtactgtagacagggtgacttataaacaacagaaatttacttctcacagttctggagactgggatgtccaagatcaaggcgccagtagattcagcgtctgcttgaggccccattcttcatagatggcaccttctcactgtcttcacatgctgaaaggatgaataagctcgattgggcctcttatcagggcactcatcctattcataagggctctaaccccatgacagccacctcccaaaggccccacctcctaacaccatcaccttgggtgttaggatttcaacatacacattttgaggagatacaaactttcagaccatagtaagaagttagaggaaagatgtgttccagcctatgttagcaggagacgaaagctcacttccagcctgcggggaaccgcacaagcagaaagaccactctgtccctggttaataaacgctcagttgcctgaagggaatgaccagagtgctgtggagaattggacgttttggcccagggtcaagctccagacaacagccctgttgtttctccctcagacttacacattggttatttctgcttctctctctctctctcttttgggttttattcacaggaattgctggtcatgtcttatactatattttgggtggttttttttcttcactctcactcccttgcaggtacattcattaaaacttgcccttgaaggcgtggaaaaggaaagggatttctactttgggaagttgagagagatcgagctactctgccaagaacacgggcaggaaaatgatgacctcgtgcagagactaatggacatcctgtatgcttcagaagaacacgtaagtgtgaggagcatgtgactcctgtgttctaaaatgactctcttggtcaaaacacagtagatcagcactccttagaatacttccccaggacctcaatgagaattactgctcagccaagtgcacctgatagtcccaaaggaataaacatcgttatcatcatgatctattgacccatgcctgtgggacaggcagtcataaattaatctgggaagagacaggtggggtggggaaggctttgacagaaaaatatgcttatgcagccaaactgcaagtggtctgcagctctctgagcaaatgagcattaagaatttgtatacggattcctccttcttcatgcaagtacagagtgtagttaaaggagaaaataatctagatgcttttcccatccccagaagccccataattgactgtttttatttcgtagctggttgtcttggttactcattgccaggacagactagagctgtgggacagccacatgcccatctcctttatggggaggagctgccaccagagttgctattcacaagtgctgctattcacaagtgctgctattcacaagtgctgatggagacccaggatgtggctgtgtcagggtgatgaaaagcagatgtgagaaatggaggaggaataagaatctaggaagcaaggagagaaagcggggcaggatgcatggcagagactgaggcaaggcaccccgggtctgccagtgccaggagagagaggcccagcagccagaggtggaggtgggagcctgatgtggcttcaccttccacagagccaagttgaggggttggggtgtccagcttctcttatgccaggctgatgctagtggaagtgtcccggtctctgggtgttctgagcctgtgatgttctgagggcctccagtggagttgtatgtgttgatatttctataggacatagcaagccatcagcaagtttactctcttattccagctgaatcccaggcaaatgtttactccatttatgcctcaaaatactagcagtgaaattctcctaaactgtaaggcactgtatctgtggtttggaagctctttatcacttttttttttcacttcttccaaatattttgatttaaattatttattggttatcaatagctcagaatttgaagccctgataatccacctggtttccatgatggcttcataaaatacggttctcagtattttcagatctgatggaataaaccagagactgatttgtagtatgtctgcagctgccacagtgtcacatatatgacgtcctgtgtgtacagagtgcttgccctctgtaagcactagatggactatggttattctcttcacaagcttatttgaggctaaatcagctgagatctccacagcgccatgagactgagtgaatggcgctgctgtctgcgataacgcctgctagtgggaataaggccggcgtgcaggatcaaatcttcttcccagccctgcacttcaaacggggaaaccctgagtctaacctcatgccagattttgtcccaagagggagtccatgtgcaggagcactgtctgacagtgaactccaaatgaagtgttggagaggtccactgaattcccggctaagataggtggacagcctcaggcaagagcccttgcctcctgggtgtgatttccagggggtctacctagatgaccgcactcagtttctgttctgccatacccatcaccacccgaccccacacacacatacatcccagcaccaccttgccaccatctggattcagagagccattcctgcaatgtacatgcaactaaaatgcaagcaccccaagaagaaataacactttaaggcctcatcattcattaagactaaataataagtttagcagacacctcttctgagacacctggttggggtttgaggtagaagggtctaggacttgacgtatattagcttattagctcctataattctctagagaatcctattaggtagctattgtcatcccattgtacagatgagggaaactaaggcagcagagaggttgaataactttcccaagtctaggagcagaataatttccatttgaaccctgaaatctgaatcctgagtttatgttctcccttctccaagtctgaggcaccttttaagtgctattatgacagtagtaatggctaatactgattgagcatttagcatgtgctagggattgtattcatttactacgtagattactgaccttaaccacatccctgtgaggtgagtaattacttatctacattttacagatgaaattactaacccaatggctcatagttaataagctccagcactaggatttgaacccaggtttatctaactcagaggctaaaatcataaggactgagttacctccctcgccgagtggtgggtaccatggagcagggaggaaacgaacatagtactagttggggaaagcctcaagattaactgtctacttgacagtcttcagttgaacacgccctgtgtgtgaagaagaaagtttccaaatttttacgtgggttttctctaaataactccccttacctcgttttgttgattttcaccttcgaaagcctagttgtggcctctttttcggggcattcatctgattttaaatgagcatccacaaagaacttcagttttcttctagccagtttgtaacttttttaaacccactttgttgttgtatctctggcactgcgctgacatcatcaaatagctttaagggaaggaagagagagggaaagagacagaggcattgccctgtaagtatatgctggggagtacccaaaattcaagaagagaattactcagagtaaccaggcagttgaatctggcagagaaaacagccttaacataaattgcatgtgtgggttaccagagcaagatgttcaaatgcagttactggcttaatttttctagttccaggatatttttattgcaactttgtgtctgcaaaactccaaaagagacacatcaggctatactgagttttctacagagagtaagccgtttgatctggaatatgccaggtgtccttatttggaatgtgacaagacccatttgtttaaaccttggtttttatgcagaaagaaaaggaaggctgcagtgggcctggatgccgtgctgggtgctttccatatcctgtgcatgcatgactctgccgagaggctcaggagcagctagatactctcctttctgccccctagcactccacctcccagaggtccaagaaatcatcctagatatcttaaagcctccaagcattttcatttcttcctgagaatatggaatctggtttctctggaaccacccagaagcacatagccagtcctacactgggggagtgagccttcctaaagctgtacccttgcctgccttcccctatgtctatggtctggaaaagcaacggttttgaaaaacaatgtgcttagtggttacgatgccatcatacaccactgcccccatctctgggaatcctgcctttgccccactgtgctttcccctgacattgtgtcctgttttctggccagccccacacttgtgtgatgggtagatttgcacccatgtgcagggatgatgtacatggcgtctgggaggaagtgccagcactttgttcatgatgctgttggtacagctgtgtgtacagagctgagatggcacagatgcctggtggtctgcctttcccagagccctcctggagctagaaggccaggttgcagcacatgctgttcagctaaacatagatggacatgctttgctttgacatttgaggtaggagtatttgctggggagatctcttcccctgagtgattacttaacactcttattttgtgatgattggcctctgattgttatatttaagccatcccagaatatggtgtttggaagatgtgaaaatccaggtgggagttttgagcagaaaatcaacagaggtggttcaattcccagttgtagagacctaatggaagtttccagagcagatacttattctcattatgttttcccctgatacgtaacttggagccacaggagtctgggctgaagcattggttacctgctccctgtggattctgtcagctgaagggcaccagcttatgaacagttacttgtttcctgcagggacaggctgtgcttctgtcactggagggcctcttgtcactggactaagtgctggctatagaaaaagacccaaccctacctcagaggagctcccagtcccagtaagggagacagacagggacatgactaactggaatatgtgtcagatgatgacaaatgtgataatggggacataaataaacttgtgtggggagcagataaaagccgcctggaggaccacgcagagacttcacagcgaagatggcatttgtgttggatgttacagggtgactgggaacatcaacagctctagagctaaggtagggagaaactgcatgagcaaagcagagaagaaagaccagcagccacagctggcaaggtggcaggagacaaggctgcagggtggtgccttccacagctaggaagccaggagctgttggagcttcctgatgggccttcctctctcctttgcccccattttcctcccacagtggcctagagccttcttcaataccatcttccagtttgcctctctatctaatgattataaggaaactaaagaatgatagttttcttacaatcactcacagctcaacggaaagatgtgaatagattgatacgcacatattagaattattaggtgatgctctggtgcattagtctcatatttggtataggttttgcctggcctcctacttagacatgggtttaagttcttcattctcgtataaggcatagaaaaagattgttttttcctgtgagcctgcaatagcattgtgtgggctgtgagctctcagttgtgatttgtaacaccccagaattacagatgtgttctgccagactctcagactgccttaacttgcaggccaagcatgagcaatccattgataaattgggagctttgctggtatttcccagtgagagttgtctggggtccacagttcctgcagatgcatgacatcacagaggggtcctgtgactgagatttaagctggatgtgcatgagaagcagctgccctgggcatctggaagcctcagagccatagaaaaggccagcaaacctgctgccttgttggatgtgtttggaaaggaggcctagcctagtggcttcctggccctctagtttattacaggctcaatgattacttgaatctaggtctttcaactttagctccattagcccacaataaactcccagttgtgacgtgagcaaatgagaatttctgcaaaatgtaaaacagttcctcatttctgaaatcttcttttcagaagtctaacatgcacagaaacaattatataaagaaaagcatactttagaccagctgaagtttgagcaatacaatatggaagacaccacactcacgttcaagagttaggatgctgaataaaacaatataactcaccgtggagggctcagagcccggctggagagacagatgtgtagccacccagcaagaacacacgcgggactgtggtgcgccctcccaccgaagcagaaactgaggataggaagcttggagagggaagccattatctcggggctgcaggcagtgagagaggcttcagggaggagtgactttctcataatttagaggagcatgtggcgggacagacagctgggagttcccagcccaccattcttgttaaactcccatgaatgttagtttcattcttctcccttggatgagaggagagcactggcttaggaaggccagtaactgtttcttgtcctgcgctggcccaagaagaagttctctcctgctcccctgagcatgtatggccacactgttggtgaggcactgactctgagctgagaggaccagcctcacatgtgccagacagaaggcaaagcagtgtgcagaggaagtgccaagagcacagctgctgtgatgcccaggggtctggggtcgatccggcagaaggggagtaaagaggggatcagggctctgagatctccctgaggtcaaagagcacctgcaattaaggaatttgggagtgcaagggtcaggaagacacatgatgtgatcagagagagcaagagattgggcctaacgttccagaagtggagctagttctaggtggtgaacacagggtggtcatggggtagggagagctcacatttgctgaataaggggcctgtcggcacggtaagagacaatgccagatttttccccaagttttcaacacaatgtcactgtctactgttggttgacacagaaagggttacttttttaaaaaaattacttgcacttctagaatatattccagagttctcccactaagaaataataatcacagctcacatttctatttaccatgtgccaaatactcttctaggcacttttcctattttaactcattaactcctctgttggattcgaggagtcctttgattcattgactaatgaaaatgcattgaaaatgctcctacatggataccttatccccaactttacaggtgaggaaactggggcccagagcagttaagttctagacccaaacccacacggcctgtaaataacagagctgggatgtgaactcgagtccatgttgtaaccttgacattctacttactgcctctcagaaaataagtggctcgtgaccttggctgatagtctgatagtctcagtcattcatccttgaatccactgcaatttgttcctctcaacacgacatggattgagtcttacataagaaagatgtggcaccgagaatccgatccctgacctcagtaacctcagcatccagtgggtggggccaaaagggtcaagacaagattccaaatcagtgtcatagcagaggaagaaaacaaatgctgcaggagaagagagaaggaattctggctcagtgatcatgccatatttgaattggctaaagatgggtttgtcctaagctccaaggaagaggggcccgacagacagggaagggcttgggcagttcagtgctcgggagccagcgtgccaggtgtgcgaggcatgggcacttccatatgtcccagcacatgctccagactgcatcacagaagctgtgtgcccttactgagggaacagggaactcctttgattagccatgctccctcagcttgggtaaaaaacagcaaatattttgtgtgagttcagaaaatgaatgaatgtacagatacggctgactgaggctagtgctccctggagttggtgttcatgccatgcttcactgggttagataaaggaataaatagggctgtttatttctaaatagtgggaagaacaattcacctatctgattctcagttgataaacataacgtaagccaaaagggccccaagcagtctaagtagatgtcccaaagtccttgagctaaagctcctgagctccctcattgggaggggcctctttgcctgggacaacccatgaaatgtggctgctgtcctttccttagcctgggaacctctaacactgctgctctggtatctaagcctacatcaggttagtaacataacaaagggtctccttcagggcgacactgccgagcaagaagaatgacagcaagggagggactaggaaatggagcaaaagcccacatccctatccattagtgaggagtgacaccccccaccaaaataccatggaggccaggggtgctgcttttatattacagcagctttactcatggttgtcatgatgctcttggatcactgtgtttggtttactcttttacaaaggttaggaaagtatgccatgtattctaagaagatttccttccaaaacaaaatagttgggtgcctaaagcctgacgactgtgctttctagaatgatctgttctttgatcacatggggaagctaaggcgcccctgcatatgtatcagacaccggaagctgggagacgtttgcatggcgagttgtgcctaactaagcctggtgccctccacagccttgagacgccatgctggcagtggcaatgggctgggatgctgcagggccccattcccagtcaattatctcagctgaaacttctcccctgcccacaggagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactgttgcatatgccagccactgcgcttggttcccattttctttgccaaggtgtattagcggacggccctctggccacctacccgagagatcgtagggtcacatacatccaacttcaccacttggctgcttgagattggttctgctcttttcttcatttctttccagaacaactctttcccaccccaacaccactgccaccacccctctttttatcctggtgtgaaacaatggtaatttgatatatggtatttatattggcatttttcaacccagtgtcactagatgtcacacacatttgtggtgctttgatgtttgcaagtctaacctctgaacataaatttggtcaaataattggaacaaagggaaacagatacttgatatgaaagccataatgacggtgacttgtgtcgtgggggaaaacataaggtcattttctccctctactcacaatactaaagggaaaaaatggattcaaagctaggatttcagggcccagcagtgttcctccatcagcatgttagacaactacacagtatgttgttagttttgaaagacattcactcaaggaaaacaccatctcaactttgcccgctcaccatgtcccttgcccccatgtagcccatttcccaggttatgctcttttctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaataacagcacagaaaaatctatgactcccaatatcttctagaataaagaattttccctctttaacacaagggccctccttgtcattgaccttagctaaaccatggcaattcataaatagaggaaacattaatgaattaaaagcattccttattttttaactaatatttgtacattttcttagtctctttccaagtctttgcctcttttttttctttatttttattttttcctttgacagatggtatcccttcctggatcattcatttcaccttggtttctaactttaggtttactttcacttgttatttgacttagcaggtgcaacaaaaacaagaaacaaatgtgcccaccccactttccgcttaactgaaaagcttaaaataaatttctgaattatgtatcctg

SEQ ID NO: 36181 - DNA, 26869 bp, Homo sapiens
ctcctcacaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaagaactccaactacttcagcatggactctatggaaggcaagaggtcgccgtacgcagggctccagctgggggctgccaagaagccacccgttacctttgccgaaaagggcgagctgcgcaagtccattttctcggagtcccggaagcccacggtgtccatcatggagcccggggagacccggcggaacagctacccccgggccgacacgggccttttttcacggtccaagtccggctccgaggaggtgctgtgcgactcctgcatcggcaacaagcagaaggcggtcaagtcctgcctggtgtgccaggcctccttctgcgagctgcatctcaagccccacctggagggcgccgccttccgagaccaccagctgctcgagcccatccgggactttgaggcccgcaagtgtcccgtgcatggcaagacgatggagctcttctgccagaccgaccagacctgcatctgctacctttgcatgttccaggagcacaagaatcatagcaccgtgacagtggaggaggccaaggccgagaaggaggtaagtgctggggcccctcctgcccctccaggcctctcctctctcaccccacccctccgaacttcatcttctccactcgggcttcctcgggtttggggcttaagtttctactgtccttggctcttttagaaaacatttatttcccctcatgccccctgtcccccctaatcccagctggggatcagaggttgctccccaatcccctaaggtctcaggagacagggacattttctagatgagcggatggagactcagaaaaggttgagggcctgaccaaagtcataggataaattcgagtcaggttagagagtatgacccaactgcatagacctcacttctgggctctgtgcctggctgaggtgtttctttcttcttcttctccttctccctcttcctcttcttcctcctcttcttcttcttttatttttttttttttttgctttgaagaagagataattcctccaacctgagtcggactggcccctggggaatgggttgtgggtgaggaaagatactagaaggagagaattttggggcccactgaaaggtccttcttgctgtctttgtagtttttattgtcgtacagtggcttcttgttctagctgatccccagctggtctcttgacttcctccacagcctcctttatccttctcccagctgggccctgtgttttgcgtgtgtggttgtgtgtggacacacatattcctgcaggcggacaccgttggggaagtttggagtttgtgtgtggatggcgtgtacgtgtacagctagtccctgacttaggatggtttgatttacaatgatgtgaaagtgctatgctttcagtacagtattccataaaatccaacactttattacaaaataggctttgtagtagaagattttgccaaactgtcggctaatgtaagtgctctgaacaagtttaaggtaagctaggttaagctatgatgcttggtaggctaggtgtattaaaagcatttttgacctatcacattttcaacttacaatgggtttattggtaaataaccccatcacaagttgaggagcatctgtatatgtgtttattttatgtgcacgtgggtgtttttgtgcctttgtggatgtttgcatgtattcatatatgtgatacgtaagtgtgtttgcatgagttctatgtgactgtgcctgtacttctatggggaggagcagaggcaagtgcaggcttgtggatgtagcatacctggggaaggtgatttgggcaaagggcccagctgtggccactgccctttgccccacagatgtggggctcactcttccctaaggtacacagcttcctgctgtgggtggccttcctggggcaaaccttcctggcctccaaagcagtgaactccactttcctgaagagcttctgcacacctcagatctggacagcagaggattccttcctgcccagccttcctgaccaggaggagctggttgattactctttcccttcatctctcacccacacccctggacagaaagggctgaggtagagaggggaacagactcacagattccttccagaagcctcgtttggcccaggaagaagatgtttccagcttcccccatcttctgaccccagcgtggcctcaggtttcatactgagagatatagatgggacggggccatgaaactcattctagggagtttacttgggaggttagacagaacaagaggcaatcatcctcatcacagcagctgagaaattgcagagcctcagacaaggttttaggaaatgtgaccgagttccagtcccagtttttgcctctaactaactgtaaggctgtgaataagtcctttccacgctcagtctcattctcccaaggggtgaggctagattgttggttttcaaattaccccacagagccctggaattcttagacatgtcttcgaggcctcaggatgaggagggggtaaagaagtgtcaagaaggcggagcattcaggttcccacctcgactacaagcaaaggacattcttattgattatcttctatgtgggtttggcctcaaatttggtctcaaccaaggatatctctgcttaagcctgggcacccctggaagatgtggttctggtgggcaggagggtcttgggcagccctatgtggatgtgccaggagctcagagttcagagttcgggttctggcatgggggccgctgagggactcacagttcttccttgagggagggctcatgatgtgggtcaggaggcagggctcatacacacaaacaggactggggagcgcccgtctagttacacagagcggctagaagttaacgtcaaaccgtagtagacagaatgccgggccaacagagtattagccaccccctcagtgtcctccctcaccttgcagatagggacacaggcacagaggaaggaaggggcctgtccaaggtccttgtttgaggaggaagccccctaagccctcttccagtgtttgagagtgcctcagggaaagggccccaaggggatgggattgggatatgtgtgttttaggagaaaatgcctggtcctctaaagtgactgtgatggtgggagcttcaggtagcctccgtgtgtgtgcacacacatgtgcacctgcagcatagggctaggcggggagaagtggagccaggaagccaggagactgagctgggcacacgggctgtctcggcctggctctgctggaatgtcacaggtgggggacattggcacagagcagggttagtgggtagatgggccaaagtgaatgagcatgccagtcctggcatccttttgaggcatctcctgcagacccaaacatcagcccacgcatagctgtttgcaagtggctttgttcagaacccgttccgcaggccagtggtgaaggcccaggtgatacagcctcagacctgcctcggttggtggtgtgaggctacgatgacacccagggctgtgggtgcctgtcttctgggcctcagctctacctacagactctgagcagagtctctgttagaaaaagatcgcttggtgcggcaacatgacagcaccttcctctggtggtccctgggtcagcatgtttccagtgccaccccaaatgtcacaataggcctcatacatgtcctcctgtcttcccctctgccactgaacacttcccaggctaggttaggtgggtgagattgaaatgtacacatacatccctttctgtgtcttatggcccttccttctgcctatctcaagcttcagcaggccaggatgttaagacctcctgggtggacggctggctgctcttggggggccctgcactgtcatggatctggcctgctctggggtggcagcatgacgaggcgtgtgtggaggtcactcagctaggagcattgctttggagaggcttagcctcacacctcctccactctctcaaccccaccatttggttcagttcagttctctcaccacatctgtggctttgtttctcgtctcattcccaattctaacacaaaagctgagccactggctgctgggcatgggcagccgctggtccttgcttttctgagcagcgctggtctgcccaggaaagctctttgggattcgggaaggggagccaggctaaaggccagggtgccctggaggggctgggcccactttccctggagaccttggtgactttgggggagaatgcttgccctgggacagggtgggtgagaaaggaggtaggggggcctctctgggtgctaagggggaaataacaaaataaaagaagcttggagacaggaagcaggggagcaaagtgacaggcaggcaggaggcaacccagtgtctgtggcacacacctgagtgccagtgccgggcccagcatgtcctacttgtagatgaagaaacaaggtcaaagtcgtcaagagacttacacaagttacagcactcaagagtggcagagctgggattcctctccgctattttaagcctttttgttcctgtaggattggaagggtcttcttgagatcaccgagtccagtggctcccaaacagcaatccccagaccagaatcagctggtgaattgttgaaacacagattcccaggccttagcccaggaggtattttaaaggtctccctagagaattctaatgtgtagctgggttgggaatcagagatctagtccaatttcaccacaaggaaaccaaggcccaggaaggggaggttcccactgtgcctgcgtccccatctgcaaggtgaaggaggagactgaggggggtgctaactctctgtgggcctggcattctgtcttcttccccactcttggctggagatggccagggtgataccttccttgccccatctcacccctcccctgacctgaggctgtgaggaggcaaaaggaacagtaaatctcagtcaaacagactaactgatcctgggctgttttacgtccgagtggaaatggggaaatctatccagcatttcagattcttatccagataattaccatttgtctgagagtacaaatttggcaattaactggctcatttggcaaatgtcacagccgatggcccatgtagtgaattcaggccaggggaagatcatggccagtcctctcctccctggagccagtgcaggtacacctatccgggtgggtgctcaggtgtgtctccacctgaagaccacgtccaggttgaggcactgctagctgctgcaccacccatctgctctcgggaaaacctctgctcacccaaggctgaaggatttcaaggttaggtggcccatgcagggcccgttcctggcatcagagagcaagaggcaaacagacaggtgtgggagaagggaacaaaggagtcatttagggacaggcctgggcagggaggaatgaagcggagagtaggaagtcaggagggaggtgtgggcagggcgggactgtggggatcagaggccctgtcagccatcagggccttcaaccactttctgagggaagagggagagagggagagagaaagctggggcctcagaggacaatggggagggtgctgggagggaagcgggggcaaaaggaaagagatggaactgccaaagtgccatctgcaaggtgaagggagcatgggagggcttaggccagcaggagtgaaggggaaggacgatgccacagaagacacacaggacagcctagtgccaccacctctaggtgcgcctcttgaagcacagaataggatctgagtcctgttgttgaagcttggccttaccgctttccaactgtgagaactcaggcaagctgtgtaatctttataggcctcggttttcacacctgtgaagtcggagggataatgccacttacctccacaggaggcttttgctggttaaaggagaaaagtcctggcacatactagatgctcagtaatcaacactgccttccttccctctcctagtgttgaaggagagcccagcgacttttaaaccttcccatgttatattacttcctatacaggaaaaattgccaagagctgaacagacacaaggtgcatccctagctgtcaccccaaatgctcctcccccgacagggtaggactcatcccagaggtgagaaaggaccattctagcagcacagagttcccagtccatgggaactccaagagcctgctgtgtcctgccggtctggtcttgcaagacatgctgtgggaacaaggccccttcccagcctgtgtcctacttcttcagtgccccaaagaaataggaggccaagtctctcctccaccctgaccgactcttctgcccacagctgcagacagtctccccttctggccctgccctcacaggtttccacatcatccgccaacacctctggctctactctccacccctcggtgctcaactagccctattgccctcttcccttgttctcttacacaggatggactcctgagggactggcctctccctgcccttggcctagacacttctttgttctaatccccattgaattctgcatccctgaactcactatctccttcgtctgtcttggccaatgaatccacgctcacctggggagacctttcctcctctgcagccccaaccatgcagccctcacctggtctccctgtgcacttctgctcactccaggcactcaactcctggccttcaccttctctggtcagaccttctgccacttgcaggtggttagtccaccctcatccccttttgtcctccttcatttccaccagtgtcctccaatcttcaattatccatgagctacgcttccctcttgcattcagcccagtgtcttgacctcaccagcctctctatgcactccctactgttcactctgtgtccggacagtgtacacacttcatctggatcccaatctgacagcgtacactatcctcaccactgaacaccaccaacccctcacctgaccacatctgctgtgctcctcacttgccaatgccgggcccacctgcccaccatgctgcacacactgctccgagcatggtgtgagtgaaagcacccagcctggcccctggtccatggaagttgcccacacaatagtgatgatgggaaccattgctcagacagtgctcacgctgtgccaaatgctttctgggggcttcactcccaatcccagggcatcccacagcttccctggaaggcaggtcctcttcctgctcccatggaccagacagggctactgaggcacagagaagccaggcaactttcagaggcacctgctgtcctgtgctcctggggagccccctctgagcccaccattgctcatttcatggaagggctgcccatctcctatttgagacaggacttttaccagcgctgggccctggcctatggtgggagggattgtgttttgttctctgctttcctttccatcagaccttgtcctcggggtggtaaggtggggtgaggaacccaggtgccaactcctccatcactgagctgggtcaggaggttgggggtctccagctgttccctgaccttggacttcactcaggagttctccagggatgagaaaggtgcttcggacagacccccagtccactctcttggactcttcctcacagctcagatctgcttgccaaatccagcctcctaagaggcctttggggctgtgggatctgccagcctgtgtttcctgggctcttgggctctgcatcgtcagagagtgtgagggtcgagtttctgccattacagtgggcctgctttctctgttttccactctctcaccaccttatttagtggctgctggcttctctccagacttttttccagagatggggccaaatctccatcctcatctccttaggtcctcttttccatctctggtgatggtattttccatgctatggcatttccggccgtttgctggtggggcaaatgctactgagaacaactctgaatctccctgcctggagagtccaggaatgtggtggtgggggcggggaggccagggattcaaggactctctgggaagctctgtggctcttgccccatgccttccccaccctccgggcaccttttccaggaaagccagggaagctctatctgccatcggatccacttccccgggtgcctgcaggaggtcccctgttagcacttccttggcccggtggggcgttcagaaggtgtgccgcatggtgttgcatgtgcccaggtgctcatgactcctggctgatgggactcccattcctagaggtttgtggcatcctcaccttgactattcttttgggctccgcaaggtgatggccagagaaaggggtgggactctgcattcaaaacccagtggtagtggggagatctggagcaatccaaggctctcttggatgctttgttctgtcaggtggagatcatccacctattgtccatgctagaaggggctttgagtgtcctacaggacagcccagcagaacagaggcttggctggatgggattggccttagcttcatgcctctccttttgtctctattgtggctgcttttcagagaagggcatttccccacatgaaaggtgagtatgggagtgaaagctaatgtcccagtgtgctactgatacaacctcttcctaaaccaccccagaccccaacagtctgtgtcctcttcctgagcaggggtccctacaacctcttcttccactctacactgccttcctctccagccttctccttccccagagcccctgggtaaaagtctccgtcttgccaaaactgcagaatgccttccctttcccataaacaggttttatagctgtgcctgcccagacggagtccacgccggcggcaaccctggctgctgcttgcaacacagccctacgtcatgccatagaaacgctgcacactgttactgccacgagacactccctgggctgggctgggctgagctgggctggatccccttcctttctcttcccattgtccccaggtccactgaaaagggcaagcaccctgtaaatgagtttccctcctgctcttgctgggtggaggagataggcagaggtttagcccttaaaaagacatggctaggatatccagccctagtggcctgagaatacagcaagatggtatttaacttactgctagatccttggcgactggcatggtgcctggcatatccgaggtcctgatgaatgtttgctgaatgaagagctgaatagatgagtgatgagccctggctgcgagtgtgccccctgagtggagccgctccctggttctctggttctcttccatctcctccccctgacttctccaatcctggctctttctctgcagacggagctgtcattgcaaaaggagcagctgcagctcaagatcattgagattgaggatgaagctgagaagtggcagaaggagaaggaccgcatcaaggtgagcagcccccaagctcaccttgctgctcccttacccgacctggcctgcctggaaagacgcaggccttggctcccatttgagtcccaggcccacgtagacatcccaatatgtttcttctggcttctcccacctcctctgacattctcaccaactccccttctcagtctgagccaggcactcaggtgggatcctgtctgtgacctaatgcccatttcatattatcccagcaagtaaagaccccagactttcctccagtgtgtcttccaatgtcctccaatgtctgttctgcccacaagactccccagccaccaaatacacaccatttcttctctacttatgccattttggctaaatgtatgtctgccatggtttgggtaattgcaaaccacaatctgaaatcactgcctgcttgaccctgactacatacacagccagcatacacattcattttctgaatacacatttctacatatacattcattttctgaataatgtttggttctggttagggtttcagggagcatattgtgacccatgggagaactttggggcccacagggaatgatggctcatatcaacccaccaagaggaaggagccacaggtagataagaagcgtggactgtgaacaaacctggctatctctgtcagtaggtggcatccctcagtgatgcctttgaatgagattcttggccaaataggcttgccaggttggggcagtgggaatgccctgatcctgtgctggaaacctaaagacatacccgactagggtgatttctttccctaactaaagccctgcctaatctcttccctgactctggacctccagagcttcaccaccaatgagaaggccatcctggagcagaacttccgggacctggtgcgggacctggagaagcaaaaggaggaagtgagggctgcgctggagcagcgggagcaggatgctgtggaccaagtgaaggtgatcatggatgctctggatgagagagccaaggtgctgcatgaggacaagcagacccgggagcagctgcatagcatcagcgactctgtgttgtttctgcaggtaacaagccactcctctgtcactcaagccctcgatttcacaatccactttttgagacccccctccaacatccatccatccacctatccacttatccacctattcgtctatctgttcatccaccatccagccatccaaccatccatccattcatccatctatccaagcgccattctctctgtttaattttttaaatccaatccatttctttacctactctcaagatggcaaacaaatatcaccttttaccaacttcaattgatatgtgctagcagtgctctgggctcagtaggaaagagttgtgagatcagtgaatcgggtagagggggagtggtgtaggagtgctgcatatttgttatcttggatctagtccgtttgtctattcatccattcatccttccatctgctagagtgttttagatactactgcatgcccagtactctattaggtgctgtggcgaatagagaagtacaagacatggtttctgcctccaagcaactgcaatccagctgggaagataagacatgtacaattaaagaacaatatagaaaagtgtgtaattaaatgataaagcatatggctcaggagataagtgcctgtagaagctcagagaagggcaggtgggctggaggaagctaagacagctttgtggaggaggtggagtttgaactgggtcttggaggccggttaggatttgagagggaggacagagtcttcggtgaggagtaagggaaatgagaagtgcaaaggcagcactgagcatggcgtgtaaaagttgaaataccactgtgggctgggcatggtggctcacgcctgtaatcccagcactttgggaggccaaggtaggtggatcacctgagatcaggagttcaagaccagcctggccaacatgatgaaaccccatctctactaaaaatacaaaaaaaaattagctaggcatggtgtcacacacctgtaatcccagctacttgagaggctgaggcaggagaattgcttgaacccaaaagacggaggttgcagtgagctgagattcagcctgggtaacagagtgagactcgcctcaaaaaaaaaaaaaagaaagaaagaaataccaccatggctgaccccaaattctatagtaattccttgcatttctttagtgtgttcactcccagtctttgcagtttgtgtccctctcataaaccctatgaggtaaacagatgcacccactttagaggtgggagtcgtggagtcacacatctgaacgctagtgccatcagggatgttagcatccagtggcttttagttgaaccttttcatgttacagaagaaacaaacatccagtgaggaagagtggggcttgcagcgctgagacccccagctgcactgtgagagcccctggcagagaagcgtcctcatagctcatgaagacccaggcagttaatggttctttcctttcttggtaggaatttggtgcattgatgagcaattactctctccccccacccctgcccacctatcatgtcctgctggagggggagggcctgggacagtcactaggcaacttcaaggacgacctgctcaatgtatgcatgcgccacgttgagaagatgtgcaaggcggacctgagccgtaacttcattgagaggaaccacatggagaacggtaggtcccctctcgtggctgggccccaaggccatagacctttctctcccaaatcaattcctgctgcctgacatgggctggcctccagtgagcttcttctcattgttcccacccacccacccacccttcctcaggccgtttggactaggatacagggattctaaccctcctcctcctttgaacttgctgccaaagttatgcaactataggaagagacctccagagcagggacatcctgggcactggctccacaaatgcctcctctctgtgggttgtccatcaaactcagagactggtttcgttcagatctacatctaattgccgggcccagcccagcagctgtgtggatgctgccactagtatgggccagattccaaactggtggctttgcagactctagcagacgtgacctagaactgcagccatgcctggagggaggacttgcctgtcatcatggccatgctgagcagtgctgagcccagaggctggacttggcctgttgagctgggctggggacggtgggacacagtgtctctgtgactcaccagctcccttgaagtcagctcttcttctgagtcatgctgtcccctcagaggtcaactgaatcatctcacagaaaacctctgaacctgagaaacaacatcgtcaagtccttttccacccagtccctttagggcctgaagcctgggcactttccccaaggccccacccggtgtcccaggcgttgcacggggccttgagagtacagccttgttaatgactgctagacgtgaataccccaaaggaaaggacccctgattgctctccagacacagcatatgattctttgggggaggagaagggggtgagggggataaaagtgtgcagaagggttggggttcaggaggccatttgtgcaccttggcgatggcaatatcacatggtgtccctgtgaaatgtgggggacattcaatcacacacaaggacagataagccatttcagcaagacaatcatttggcttcaaacggcactcagatcccgaaatcctccttctaatgacaatagtgatgatgctaatggtgatggtgacagctgacaatgattgagtgctcgctcgatgccgggcatttcactgagcttctcacgcacattaccttattttccctgtggggtgtactgcattttacaggcgagaaggctgaggctcagagaagcatcctttcaaagggcgcactgctcggtagggggtacggcggggttgaacactctgctgttcagtctcccatgccctctcatctgagaagctgcggctggcggtggctgcagaagtggggttgaggagtgtgataatcatcgtccctggggtacaaactcggcagggcagcccctccggtgaggtccggccaggcctgggggatggcctagactggggtggggtgagccttgcagaaactgttcaggctcctggccgctcactgtcccatttctaggtcacaatgctggccacggcctctgtacaggtgtggccctgcgtcctgtacgaggtgtgtggcgaggtggcaagcaggagcagggatgggcactgctgattcagtagcccacacctgtgcctggggccgtgggggcggctcctctgcctctgtgttgttttttcgtgtggctgctgggagtgtgtctgctctaggaggtggtggccggtgagtcagacagtggagtgaccatccactcctccccgatgctagcctgcccaccagaccagggactcgtccacaccctcaaaggcccctgcgctaagagacaccaggccacttcatcctggactctgtggggcacagggctgggctaacacctaggagggcatttgtttattctttgagtatctgctgtgcaccaggacactgataggcgcaggtgatgaagatgaagaatgagggtctcaggcacatttctcctcttgctcaggagagagagagggaaggacagggaaagtagaagacggggaagtcgaaagagaaaggaatggggtggaggtggctgagggaagtcaagtgtcgagcagcagatctgtttgagttagggggtctgcagttgagtggcccctgccatagcagctcactccactgcctggatccctgggccatggaggccaacactgggacctcatcccctcaccttaggctgccagcagtggctgggactgaacccggaagtagcgagccagagctcaatccccaactctgcccttatcggcatgtgacattgggcaagctgcttctcttacttcctgagtctcaatttccttatctgtctcagggggatacaaccacaattgatgtatggatcaaataagaaatgggcattaatagcaccttgtaaaggtgaagtgctaggaagtgttgtgcacacaatcgtatttacaagggcttagttcaagagggtggatggctctttgcagacaccttctccaccaagagctcaggaaccgagtgaatgctgggcagggcgtcatattctctgagaggttggggaaacttggatctgcctgggagataggggaagggctatggggtgactcatctgagccccaaaagtccccagtggctggctcctccttcccacctggctcctctgctgacccgaccctctgcttcctaggtggtgaccatcgctatgtgaacaactacacgaacagcttcgggggtgagtggagtgcaccggacaccatgaagagatactccatgtacctgacacccaaaggtaagagggagcccctcaccccagacctagtgtctctcctgctgcccaggggcccccaaagtccgtgcagtgactctcagccaggttccttctgagtgggggtgatggcatgtccagtttgcctgggaaagtcctggcatctacgtgttgtcctgatgtgatgatgaacaggtctgtgttagctctcagaagtgtcctggttcgaatgagaagttacctggtgccagctcctcagaggcattcctcccgggccacacaggcagcacctctttgccctccttgccttctcacttccagcccacacctctgcttctctttccttccggaggtctcctgggctcccttctgccaggccggtgctgtgttttgctttggctcaggttttgtaggggctgagccctgtgagatggctgccgaccccaggaccattctgctcccctaggcagggagagtggtccctcctcttctgagtttcctggctctgcaccctggcccccttggccctccctctcaggccctggacagtcccagcctgcaaggtgccggcctagcacagaccagtgcctgcctgtccttgccctgtggtggcctctcacattcttgggcgccagcaacaaaccacagcaatacccgttacataagggtgggtgtgccagccctcggaccatgagggtgtgtgcctgtgcatgtgggagagggaggctgggggaggagggaggcctgggtaaggcacaggggctggggagggggaagcctccgggagctaatcagtaattcacacacgtctttcacacacacacacacacacacacacacacacactcacacacacaatgggagaggcttgggggatttggagagatgagctcaacagaaaagcacctgtgccgccccacccagtttgaaaacaacccctgggcttcttggttgttgggctttccctcctctgacattcctggtgtgggccaggccccagccggccagcctgcctcctccctgcctggggtgctgtgcctttgggcaagttctgggagtgccggccccagcacccctctcctcagaacccctacctggcctcgccctggccctgtccctcctgtctctcccttccatccatggaccaggccctggggtgccatcgagtgccctgacaggctcctgcgggtctctcctgctctgtaggagactgagggcccagtgtgagcctcctgcaggttgtgggagggggtggagggaacagcagcacccactatgatgccaccccgagggcctagggcctggggcatcttgggcaggcctcagtacctgtatctgaagagaggggaggttgtgctcacatgctgggagacttcccagctctgcactgtgagtcagtctatgatgtctgtgatggaagaaacaggttcccccggcatccctgcccaagcactgtgggtagcctgtgccgaggacaggagggacaggaaatctgccctctgggagctcccaggctcagggtggagttggggggagaacaggaagcaatcaccaaggagatgaaagaaacaaggcccctaaagggactgggtcctgagtctgggagctttgaggtcagtgggattgacagtggctgtgactccttccctggaggggtgaatttccaggaacctgtgctcagtagagggagcatgactgcgaagggcagagggcatcagggaacacaggcacaaaggcttacaggaaggactggcagggccggaaatgggggtgtggtgtcatctgagggtcaggtggggaaggacagaggtaacagagggctagaatacacatggggagctcattgttttcagctgggtatcggtggtggtatcagtccccactgcttcctcacaaggctgttgtgagagcccaggtgtgcgggaaggaaagcacttgtgaagtgaggctctgatctcccgggaagcagcagcctgggtgggcccctgggaggtgtttctggctcattaggccacttccaggaggccccaccctcacgtggctgagagcctactgcttctgccctcgtggttgccatggcctctccaagtttatgctgatgctctctgcacggttactaacagagtccttctactctcaaaagcatgccaatttgggtgataaattagttgattgacttatgtcagacccaaaggacttctctcagtggtggaatccaggtcctgtgatgggcacttgggcaactttttgggggcaaggagtcctgatgagacaattttctgcaatgacagcccccttcatctgcttcacaggtggggtccggacatcataccagccctcgtctcctggccgcttcaccaaggagaccacccagaagaatttcaacaatctctatggcaccaaaggtaggtggtggctcagctcaagggtgcacagagttcatgtggggctgtgcaggcaggaggggcatagaggtgggtccaggggcacagggctgggaccccagtgtgagatgaatgtgggaagctaggatgggtggagggtccaggcatgggtagggaggggtcctacctaccgagcttaaagtgtgtgtgtgtgtgtgtgtgtgtgtgtgtgtgtgtgtgtgtgtgtgtacatgtgtgggggacaccattagttaggctggaggaaaaacagccaggaatctcggcatccctggagatccctgagtctgtgtgctcttctgatccctgaggaaggatctggggaaaactgggtctgagcagccaccttgggcttaagtgtggggaatgcgccaccccccccacaagtatgagggcacgaggacccaaagagaatctctactgatttgagtacttctgcagtgaaaagtcgtacagtggttagttgtcaacttggctgtgactggaaaggaaggcacggcaggaaatggggctggccctggagctccaggtggtgaggcaagcgagcagcaccttaagacccagatgggatgaaatgggtgtggggatgtggcttccccaggggaagctgctaagttcagggtctccctctgcccagtgctctgaggggaccatttgctcaagggcagggccatgcattcaatgagacctggttctgggagaccctggttctgtcctgggggctcctggtcacatgccagccatgcacagggagggaggggactgggtcagcccccaccctagacatagcactggaggactcttcagtgagggcaagactcatggagactggagggtcaggggcaccagagcaatgcctgggcctctacatccagaattggattcacagccgtgatcagcggcacccctcctccacatatgcagtagaccttgggcaccttgaggacagagctgtgtctgtcctgttcgctgctacaggcccagagctcaaaagtaggagggggtcaggaagcagttgttgagagagaggctaaaggcatgagtgaacaggagggcaaggtgtctggcctcgcggaaccctggctggacgtgcttactgaggccttgctacagaagctgcctgggatccctgtgggagggctttgcacaggggcaggtggccaaccccagccatctgtgacccctgagcccaaaagtcagcccccagccctccccacaggctgctaaggagtgagcttgactaaggaggtcactgatgcttcaagcctggcaggtgggggtgtggtgctggagaagtgtgcgtcacccatggggactctgagccccccactccagtgccctctgagtgccctggcagcttctcccacccctttcccactgccttcttctcctctggactatagaacatgtctgcacataggcatgtgttagcctattcaacttggcaactatcaactgtcttgtccccaagttttaggatgtgtttgtattcattcgttcgttggttcatgcattctatccatcaaccatacaatgagcaccttccaggaaccaggctctgtgccaggcaccaggtgtgatgcaggggccagacaggcacattcccagttcacgtgagctcactgcgggagacagacaattgaacatgtaattgcgacccagagggtaggggttgcaggacgatgtggggatgaagctgaaggcacatgcagacgttgggaggtgccatgtaagctgacacttgaagaccccacccatgaatcgccgagggtggcaagcaggagaagtgtcctaggcagaggacagggtctgggcacatagcctggggcaggagagaagatggagtgtctcagacactgaggcttagcctggtttgaatgtccagtggtggagggagggcagaggtgaagtcaagaagtgggagatggtgggtgggtggtgggggttgggggagcaactcacgacagagctctgggctgctcttgggactttgtcccttattctgaggacagtggcctttaggtagggcagggacaagactatgctttatattttagaaagatagctttggtggcagaaggatgggggtgaggcgtcactgggatcacacagtggcatcctggcttaagttgtggccagcggctagagagtcatagacctggctgtgtcctggtcctgcctcctctcccactcccagctgtgggggcctgacagcccttctttgtcctgccaggtaactacacctcccgggtctgggagtactcctccagcattcagaactctgacaatgacctgcccgtcgtccaaggcagctcctccttctccctgaaaggtgagcttgcccaccctggcccctgctttcctccacagctgcctcacacctcccaagccctgcttgggtctcttcgctgagctgctagttcctccctcacctcgtggaggagagaggcctggcctgagagcccgggagctaccgccatggtctttgctgaaaatgagggcaggggtgggggctgggccacatcagcgtttcccagggcttgtttcaccgctctctagtctctaactacacgctgcaacaacagctctcagtggtcaggaccgggggacatgccataccccctgcactcgacctctctgatcctcaggatgctgcttctcctactgcagagtttatttaactcccagcgttggctggctctagggtcctgtggccatggggcacctgccagcatcctgcagatccaatcctgcaggcgcccctttgggaaaggcaggaccagacgaccctaagtccccccaaggctgatcctcttttcctgcactctgtcccccgcctgcctgtggtgctcccagcactctgacaaggcagagtgattgacgcctcctgtcccctggggttgggggcatcctgagggggcaggcttgaaccagactctggctatgggccccagaccctcatgtatctcctgaaagatcccagggacagctctaatggctgtggtgggagtaaccctgtctctcttctggcaccccaaacatctggcctggaagtcaagatcagcacattgggtgggctcaggagagggaaaggggctatgcagggcagagagacccctgaacagtggtctctgaggcctcatcactcagttgtcccttccggcccagggtcctatactatacccaggacagggattcttggagctgccggcaagagggaggagacaggactatgggtggagggtcccagcctgcaggagccccgggcatgtcttagctctgatccgggcctggggagctccaggacttgccttggcctgtttggcttctagcaggcgcctttctgctctctgctcaagcctggcccacagagcacctggcaggggaggtggccgctctcaggtgtgattcagagcagcccccagaatgaggtgtgggtccttttggcccctctgggaccagcgctgtgccactaatgcctctctctctcccagcaggcactgggaaaaccccttatcagttcaccaccttgggacaggccactgcagagttttccaaaccactgggtcgcagtgggctgtctaaaaataatcccggtatctgcccattttccatccctccccttttctctcccacagcggggcaggtgggacatggggggctctctgccacttctagggtgtgccggtcccttctccccagagctccctggagagggatgcatgccccacctgccaccccagcatactctctatctggacttctgcctgctgcacaaggcgggtgtcttgggccaccctgaccccacccctgtttccattctcccctctctcatggctggcatgggattttctttctgggaactgagagatgaggcctgaattacccctcttaatctccactcaggatccctggaacccccctttccaaggctgctcccaccctcagatgcaggaagagacccaggttctttgctctgtctcctccccctcctccttgctcagtgccaacctgggaagggccaacccaactggcagcctggcggtgctcatcatgagcctgacctgctcatcctcgcttagagcagggcaggagaggggctttcccgagacagaccgcatgcagcctctcactggacagagatctggcccaggacagaccctgcttatttcttgagggcctcagcatccaggtcatggcctgtgtcttcccaggcgtccctgcaggctgatggctgacactgagagtgccttcactgtgctgtgaaccagagctcctttcaggtctgtctgggctgaggcgcagggagtcaaggcggccccgtcttagactagcatctttgcaaccaagctcagagagcgcacctgctccaggcctcttgggcttgccatcctaaccctgggtggcggccacaatgacagattcctgcacctctctaggccctagtctctggctagtgaaacaggggaggggccacaaagccagggagaaaaaaacatgaatttgggttttggatttccggcactctgtcccccgcctgcctgcggtgctccccagcacctggtttgctgcttatgagctgtgcaactcaggcagactgctgagctcatagatacggggccaggctcagtgaggagacatctacaaagtcccttccacagtgcttggcacaagtggggctccgtgaatgggaagcatcgtccaaacagcacaggggagtccaagtgagcgcctcctgccgggaaactctggcaggccatgcttatgcgtggcgctcctgggctctgggaaggggagggcccgtggtgtaaacctccggggtgggtgagtggaaatccctgcagagcagtgtgatgctgcgctggatgtgggggcaacactcccctgctgcctggtccagcccacctggccggctcctcctccttctgtctgctttgctgcctcctccctttggccagcctccccaggattttcggttgcggcaccctggctgctgcacgcgtgttcagacggctgcatttggtaatgggctggatgatgcttggtggtcactttggagaaggcagctgtgctgctctgggcccgggcacccctgaccaccagcgctgctccctttgacctgaatctcttgtcttcccaggctatccctccctcatgcggagccaaagccccaaggcccagccccagacttggaaatctggcaagcagactatgctggtaagggaagtgctgccgggagggcctgggcacatccagagacctgggcactgaagggggctccctggaggcaatcggttccagggcctgtgggaggacttctctgggccatggggtggaggagaaggaggcagcagtggcctgaatacctgtacacagcagagggtagtagagacccagggctaatgggcaggggactagctaagcatacactctctggacctcagttttctgatctataaaatgggcagccttgatttttttatttggcaaatgcttgttggatgcctatgctagtggaatggcagcttgggttctgccagctctgggattgtaaaacagcccagtgggaggacaggcctcctcctagagatgggtcccacctccctgggggcagttctccagttctgacagcatagaggccattggggtgataatgtgggggtgggagagactggaaagtcgggaatagatatatttagggtcaatatctaatgacccgaggccaggcatatcagaagagcagcatgacagggaagcatggctttggggtccaggccacctgctgacggtggggtcctggatgaattagataccctctctgagactcttccttgctttttattatgtggggactgagatgatccccagtgcccgttagatctgacatatctgaccctgactgagacctcagtgatcggggactgtagttcacatgcagagcccccatgtgcctgaatgccttgctcctgaaggtccattctaggccctgctacaggagtcggccactgccgtggcatgtggatggcatcaggagctctgctggaaccagggccggagcccttgtttcttgctgtccttgcaattggaggtcagagcaggagaggtgatttgccctggaccacaaagaatggctggggttggtttaattggagaggatctttaattgctggggatgggagctaagtgatcgtgtatgtaatttggagctggactcaggggcattgcaacagcaggactgcagaaagcagatatggggagaaaaaagaaggtttctgttctagactcagtccttcccctccctactacatacttttccaccctctcagagcctggggccctgaagagaaggctcatcagcactttgaggcccctggcagagcaaggttttggtgtccagcaggcacccagcactgggagagtggagacaggcgctgggctgcagagaagctgagctgggaatcaatttccctgggggctggccccagctgtctcattgacttgctgtgtgactttgcatgaggaaaaatgattcctttgtgcctcagttttcccatccataattaggatgattttgcagctcttccacctgctgtatgtgctgtgacctcaagccagggaggggatgggagggtgaaggtagcattttgccctgatgcccacctaccactccaggcttttaaccagacaatgccattcattgacctgcaacccatattattgacccaatcttcctcaaagaaaggcttcagccatttccaaatctgttcactttgccctatgaattgcttggggtccaggctggcccctgggggtcaggagacctggtccaggctctgctttgccagtaagtagctgttcttacccctccctgggtctcagtttcttcctttgtttaataggtggtttaagcaaggtctgagcatccctcaagtcctgctgtggaccacacaaaggcaaggagctgaccaggaggtgtcagttccctgagagacagggccaaaggcagtgtacccttgaggtgtgtgtgtgaggggcaaatgatgtctcctgtattgggatctgcagggcatgggagtgggctcagtctctgacccagctcagggacaaatcctcttcctgagacccccgggggctgatggtgcttgcgtgggtgagcagcagctaagctgtgctcttccactccatcctggagggctgcctcctcagggccctgatgaagttatctgggcagggtggggcatgctgatttcatgaaattactgggagatacaatacatggagaaggctgggagagctgtcactgggctctctctccagagatgctccctgtaccaatggctgggggaagaggaacaggacgagagaggcaaagggctgtggggagcctgggaccgtgttggactggggcagttctttaccctctctgcaccctttctgtaagggaaatttatgcagagagaggcaaagaaaatcctggaagccctcaccataagagaagtgatgccgagaactggcagctgggggtgtgggttttggaggcagcctgctggggcttggattctggctccttgcttaccagctgagtgaccttgggcaagttgcctagcctctctgtgccttggtttgctcaactataaattgaatatgataatagtaatctatttaattgggtggttgtaaaaattaaatgagtgcatccacatacagccctcgacacagtgctgtgaagttctgtggagtagaaagtgctatataaatagtagctgtggtggcgctggaggaacctccttgagctgtggagagaaatttcgaccagtgtaatgcgggggctgaggttcaagctcacccactaactatgggaatggactccaattaggattccaatctggagatcctgacattagggaccagcccctgatcacagggtaggtaaatcttgcagatcaggccaaaaaggcccctagaattgtcgggtcttggatcactgctgcctcctgaggcaggttagggtagggtgggtctagctagcaggctcatctgtcgtctggcctcgctgaccactcttgtttcccccacagtctcactaccggccattctacgtcaacaaaggcaacgggattgggtccaacgaagccccatgagctcctggcggaaggaacgaggcgccacacccctgctcttcctcctgaccctgctgctcttgccttctaagctactgtgcttgtctgggtgggagggagcctggtcctgcacctgccctctgcagccctctgccagcctcttgggggcagttccggcctctccgacttccccactggccacactccattcagactcctttcctgccttgtgacctcagatggtcaccatcattcctgtgctcagaggccaacccatcacaggggtgagataggttggggcctgccctaacccgccagcctcctcctctcgggctggatctgggggctagcagtgagtacccgcatggtatcagcctgcctctcccgcccacgccctgctgtctccaggcctatagacgtttctctccaaggccctatcccccaatgttgtcagcagatgcctggacagcacagccacccatctcccattcacatggcccacctcctgcttcccagaggactggccctacgtgctctctctcgtcctacctatcaatgcccagcatggcagaacctgcagcccttggccactgcagatggaaacctctcagtgtcttgacatcaccctacccaggcggtgggtctccaccacagccactttgagtctgtggtccctggagggtggcttctcctgactggcaggatgaccttagccaagatattcctctgttccctctgctgagataaagaattcccttaacatgatataatccacccatgcaaatagctactggcccagctaccatttaccatttgcctacagaatttcattcagtctacactttggcattctctctggcgatggagtgtggctgggctgaccgcaaaaggtgccttacacactgcccccaccctcagccgttgccccatcagaggctgcctcctccttctgattaccccccatgttgcatatcagggtgctcaaggattggagaggagacaaaaccaggagcagcacagtggggacatctcccgtctcaacagccccaggcctatgggggctctggaaggatgggccagcttgcaggggttggggagggagacatccagcttgggctttcccctttggaataaaccattggtctgtc

SEQ ID NO: 36182 - DNA, 38871 bp, Homo sapiens
gccggccctccgccccttccctccccttccttccctccctccctccctgtcccctcctcctcctcctcctcctccggcgcccgcttcagctccccggggccccctgcccggccgggcgctgacagcaagggcgggggtccctgccgccgccttgtctcgcgcagggtccggctggggtagcggagcccccagtgcggccatggaccggcccctgtcgtcgtcggcggaggcggaggaggaactggagtggcaagtggcgagtcgcaggaggaaggcctgggccaagtgccgcagctcctggcaagcgtcggagacggaggatctgtccacagaagcgacgacgcaggacgaggaggaggacgaggaggaggacctccccggcgcgcagctgccggcagcggggggaagaggtcggtgctcccggccgggctccggggggaggctggtgggctggggagagtctcgtgcgccctgggcgcctgccacgagttctgggagagcctcgggcacggtaggccgaggggagaggggacacttccgaccttcaaacgcgcgcgctgaacgaggcgcccccagcgtcaacacagacaactgggtgccatccgatttccctgccaagggacactgagacgtgtcgcttaggctgcatttgccgtggtagattttcctacttgggagggtccagggtgactccgccgtcgtagtgctcctgggtggtaacgtgctgtcccctctctctacccccaggaaacgtgcccaacgagaagatcgcgatatggctcaaggactgccggtgagtgctccctggtccgcccgcgtcccgggggagatccgtgcggacgggacgccggagcagagccactcgggccgcgtccctgtgggtcccgcgaccgttgtaagctacaaaccggaaagtgagccggcggatagcttcctcctctaagcgattagaaatggaagtgctgtgaccgctgattatttggtgaccgtgttgactttacagttaggacttgagctactcacgcatcgtgttagcatcagagatcagaaatccagaacagataatcatgccatatttgttctgtttttatttgaaagaattctcacatctcgaacaggatattttgttttgctttagttttggcatctgtacaactggcacggaatcattttcctttcaaatgtgttttagacgagtttaatttacctaactacactaaatgggctttaattttgtttctgtttggggagctattaaaactagctaactttgtacttatagtttacttcttgaacatggaattgtcagatggcactggaattctcagggaatagaacttttaaaagcattcagactgcataaatctgtttaattacatgctttggcaactggtacaaaaatgtttgataaaatacagaggagatgaatcatgttgcacgtaaatctgactacagcaaaatgtacttgtttcttattccactttgctagttgtaaaatcaggaatgtagcctttaaacttttgttggtgtttgctttcgagcatatttttgctttctcaatttagattttcttaatattttgttcaaatattagagttagggtagtttgttttgttttgttgtggaaagtgattcatatgccagtttgcctcctctaaagacagacaagatattggctaccatgatattaatgccttgttttgatgaatcgactggaaccttattgaacactctttattacagaactcgtaccctttattggaagtgtcatagacccttctgaaatatgatgacatatatggaataacttctgtttaaagatgcacagaggcaaatacactgcttgaagtccttggaccccagatttacaatctagctgtaaatcaatctcccagttttcagataagccttagatattagatacttcactcaaagtatggatcaagaaattgtattaatgtgctattggttcatttaattgttaaatactaaaatagtctataatgtaaaagcttgaaattttgaatgtacatgttcaagaccttttgggtgagatctgataaaactagtatctttcaggtttccacttagaaatgtgtttgagaagttgttttgtaacttttacttaagtcctttaaagcctccaatctgactctttatttaaatacagtcctaagtacagtattggcttactttaggtttcttaaaataggcttagcattacaaatacatttataatgttttattgtttaaattcaagtgcatattcaaaagaattttaaaaattaagaacaagagaagaatcacactatagtttaatgacatataggatttaagattgtataagagatcctatcaattagacagtaaataagtgcatcttttttgagacaaatgcagtaggcaaatgttgacattcaccagggcacagtcaatccctgacaatttcagaagttttgttgccaatactgatttatgtgggcagattctgtagtctgctgctccttctctcatggattaccttcttgttcctacagttgcacctattctacacaagagtggcattcatttgtatccaggaaagctagaacaagtagtcttttaatcttggctatattatcacagattcgacttaggatatgttgcatctgtatttttgttttaaataacaactcaagttccttctcagagttgggcatctatgtattttgtttattatgtacaaatgacctgaagacagcattttacccacttgataagttctcaaatagtctttgtttcttagtgccgtccatatcctgaataaagataccgtgttttctttccttaaagggagtctttattttgataaccatttgtggggggactaagtaaaaactgcttgaattaacatttaagaaatggtagagattttgatagaatttggaagggagcaactataaaagtaagatatttgttttcgaaggaggattcctgttactctgcttatctaccattttctgttagtgcatagaccagtagagacatctgtggacagagtaatacaatgtttacatccaagaaagtagccatcagggaaggatgactttttaaagacatacattagaattttattaaaatatatgcaaaaaatagattaaagcttttattaatatatttatggtaattgcttgtgattcttttacgtttcaaaagcactaagttttaaagagctgccattgttagtatacttgtagaaagttttaacctttaattggcatttcagtaacatttccttgaaactgatattttcatgattgatcccatgtctcgtgaatttttaacagctataaattgttactgaagaaaggtgtgcatcacaaaacagaccctccaatataaaacaatgtgtttcttactataacttggtttcagagaattaaaagtgtttatttttgtatttgaaaaaaagatatttctctcatctgtatttgaactacaagaatgaaaaaattttagcaatggctaatcttaatgttgattctcaagtcaactttttagtaattttcaaagttaaatgaagaatatatatattttttagcttaaaaacaaagcgaatctcaagcttctacatttacataaaaagatagttgttggggcaagggggaggcattaggtgatgctctgaaatgctagtgatagattaacagatgaggtttaaggaaactattgggcctcatttccaactactcttcactttttaattttattaaggttaagttacctatgactgaagatttgttttcttctaattctgttttcttttttgatggaaggggttgagaagaacagacattttcttaatgcttattgtcagtcattctctcttttttgcaaagaaaaatgccaattcaaatcatttgtcattgccatttttgcccctaattgttagcacatcagacatgattaaatcattcctgctgaactgacctgatggcaggtatttgcttagttagtgaatattacttatgtaatctacttgcattccttgtgtgtttttggaggagagtttaactgtgattagaagcttattgagctgtaactctttaagtaaggctgtgtaatgacaactttccaaatagcctttcacaagactaaggcttatacgtttatatggtttcagtacacctttgggagcctcactggatgaacaaagcagtagtacactcaagggtaagagaaggttgcctttctaaatctgttctttatgacagttctacttctttgtcctctgggtaaaagtgtatatatgacttataaaagtgatattcatgtttatagtatatgctattctgagctagaagcaaaatggagaaactttgttataaaccgtaaaacagtagggagtttaagcaaattgcctagccttttcacaacgtgaaacttatatctttattgtccagttaggtattataaagactaattaaatatgaatatataatatgcaaatataaggaaaatacttattgagtgaacaaaagtttagtcaactttcgtgcagcatttctttgcttacatttactgaaattgccacacctaaaattttaccacctgttcaagacagaattctaaagttcaaagtacaacaagcatgtgcaggcagtggcaaggcatataaaaaaacatttacagtgtcaggaaaatccagctcctgacttaatatgagatggataagaagaatatttgctccaggatctggttttccatgaaactcttggtatgtagtctgattgaacatcttcaaaaatataagtttaaaacagcctataggttggcttctgagaactttatgttgctggaaaagtggtttctttacgttaaagtaaaagcttatacctgcttcttgaagttatataatcagaataatgtctgagtacattcaagtctgaaagattttactgtataagatattttgctgggtgaatttaactaaaacagtgattttatatgagggtggagaggaacagaacaccaggatgagttttcaaatgtgtctttcaggtgtgcttgtgagaaatggaggaagttttgaagatgatttgtcattgggagctgaaggtatgtttgtttggaagaactgtatttttgtgtagttttcaaatttaaaaaaaatgagaaagctgaatggtttcaggtttatgatcctcaagctaaatttaaaggtcttgaaaatggctcaggcatattttacattacctttctttgttaataatctagtcatagtctgtaggatacatgtagggatgactctgaaaaactatgtgaagtgtccatctgtctttcttggactaaatgcttaaaggaacagtttgtaacaaaccgtggtaatataactgagggaagaattgtcctgaaaaaggaaggacacttaaatatttatacatgggaaaacaaaattgaagcttatttttagcgcaaaatagacttatgtcatacttacagctgcagcttgtctttctctttgcatttaagtgtctcctgtcttttccccattttcctgatttttagaaaattaaaggggaaagacaaaatagcagagctaatagaattttattagaaatcatgctggtgtttattccagaaagcattagattttaaaaagtgtgttgtgctatttaaaagtttttacaagttatgtaatgttttccagtagatttataataaagctttcttgtacaaaaaataagaatttttaattattttactggtgttttaaaagctattttatagctcattgatcaaattgcatagattattcatagctgtatagctcagttattaatgtgtacttttttaaaaaaaacaaggatttttaaaaagtctttaaagcttacaagttggtgaatagtgaatttatacattgaatttaatattcttgattttttcctgtttcaaatgcatctgtaaagtaaattacttatttagaaccttctaacatttaaaactctggaatatgcaaatatattagttcttattatttctgttcatatattttcaagctctataaagagcttaaacttactgattcccactcagtacaattgaacatgttgtcaatccgttattaaaatgcactttgcacttttgatatttgccttggtagtttgataatattgaatgattttattggaaaccagaacctaaaaaggagtctcatgaaagagtaaatctattatgttgttttactgaaaattatttcaaggctatttccattcattaagtaaataattactgagtgctgtgagttaggcacctttctggtggatgtacaaagaaacacaaaattgtcataactttgtagatcagaaatgaaaagcaattcatgtgtgctgaaatagatgtgtttataattaattttattctttgtatttgtctataaatttaactttaaacattaacacttacctgtttagaactttaagctaaagttctatcataaagttgaaaggcaatttttaaaagaaagtttatattgaaataagtagaaattttcatgttatatgtgtgaaaaatcagttataaccttaaaaaaaattcacattagaaactgacatatactattgccacacttaatgttaaatcatgttttcctcttaagatattattcattaatagcttttaaatttaataattagtaccacatatatggtacatatcttcctcattacttatttctaacctgttaaagaaatttaactggttccctatacgtttttttattttaagcactcaagtgagagtagttagtttcatgttgccacaacacaaaaacacccttcaaaagctcctggccctgttcttatctatctgtatatcacttttaataatgcagatttaatggaccaagataagtgtttaatatatttggcatttaattctaatattgtaggtaattagatttcttgataattgtatcatagtagttatagtcctactaacaattgtgctctacgtttattgtttttacctgtagccaaccacctccatgaaagtgatgctcaaattgaaaactggtatgtagctgttttgttctatttcttttaaaaaatgaagacctttaatgaaaataaagttataaagttttatataatctgattttgttcgtagcaataatatcttggccaaagagagaagattacagtttcatcagaaagggagaagtatgaattccactggatctgggaaaagtagtgggacagtttcaaggtaacttattctgaaattgtgttggaattacattgtgctatagatgacctactcttatcattttttcaatcttggatttgaccttgatcatatgaaatcagaaagaacacaaaaagagcgtttcctgtaccagcacaactgataggagctttttgttttgttttgttttgttttgttttactttgagattaaataaaatgcaataaataggcttatactgctgctggaacccataaatgagtattttgagccctctcaacagcctgaaagaggaactccatagcggagtaacttgtagttgtagagaaccaaaattcattgttaaggacttgagttaactctgacacaaaaatcagaataaatttttctaagttacagcttgatatttaagcatactttttttcaacacattaaaccaaagatctttcaaatatatagtatagccaggcccagtggctgacaccggtaatcccagtgctttggagtgtcaaagtgggtggattacttgagcttaggaattcaagaccagcctgagcaatatggggaaacggcgaaaccctgtctttacaaaaaatgcaaaaattagctgggtatggtgggatccacctgtagtcacaaccacttggaaggctgaagtggtacccaggaggttgaggctgcagtgagctataattgtgccactccatttcaacttggctgacagagtgagacgctgtctcaaaaaagccaaacagaaaaatacccttgcccctctcccgcccgcacatatagtatattaaaatacatcagtgcatgtgcctatggaatccagtttaaactgttatccaaattataatattagaatctgagcattttgtctgaaacaaattgaaatgtctctctgttgaagttccatctctaactttcctgttttcttcagtgagtcttagaaagcttggattatcactggtatgagagagaagggatactaaatatttaattcccaataggattagagtagttacctttgtgtaacccacactctctgtaccttactcctcctacttcctgagtggaagtggttggagagaagttgaaagtaagctcctccctcgcttctctgaaatcagcttgttatctttattgttcctcctaggacaattgccactcctaggacaaggataacagaaaagctcaaatttcacaaaatgtccctcagttccttttaatttctgctttaatctgttcattccttattcttcatcatctgtcttctacttgttttagctgctttacagggaatctcttaaaatgacaaaacaaataaggtgaggaatcacgtagggaatctctgactgtgttcgttggggttagctcttttctgcaactctagcaacttgagacaatgaaccctttataagggctatttattccccagtacacatgtgtaaacatggtaaaataaataatggtttccagagcagaagctgagaaaaaagattttatcacaggaaatcagtaatatgtattcatttataatgtggtgtggactatcaatttattttatattttcatgtttccttttttgccccctttttttgtagtgtttcagaattgttggaactttatgaggaagatcctgaagaaattctttataatcttggatttggacgtgatgaaccagatattgcttctaaaattccttccagattttttaattcatcatcctttgccaaagggatagatattaaagtatttttgagtgctcagatgcaacggatggaagtagaaaacccaaattatgctttaacaagtaagatttttaagtgttaggcatattattttcttaaattatagcatctacagcaagatggtcttattttaaagccttaattttcaggaatagcactggaaagtaaagagattgattaacgcaaaagccatttttacatgttaaaattaagctattttattactccatttatagtggttaatttgcctatttttcccctcctccccaattcctgacttaagtgctaccataacttatttgcagaaccttattgttgtctacagattgcttttattcaagaagaaaagaagtaggagaggagccttgttaatcttaaatgaagtcagtctgtttcaggaactagtctggctaatttgatcagtttcactcatatctttgcttgttttctttctgttagccaaagattccaaaaataggattccaatcctgcattgttcatggatcagttttaagagatcaataaatccctcaccctgcaaattaggtataaaatatatgcttacatgcattttcttaggagaattttgaaagagtcttaatggagttcaagacttcagaatagaatcacaactgtagattcaatagctagttctttctgttttattcaatgttgccattatgctttgtgcttatttctgattttttaaaaatacaaattctagtgcttagagtaaaaatcttgctccttcccacccagtgaatgtagagaaggtttaagtgttagatgaggaaaaaatagggttttataatctttgtgatctaagtgtagtttttggaattctaaacaataatatgcatttaatatatgtgtatgtatatatataaatataaacatatcattaatattgtttcttttggtaggccgttttcgtcaaattgaagtgcttactactgtggccaatgcgttttcttctttatattctcaagtctccgggacgcccctgcagagaattggaagtatgtcctcagtgacctctaacaaggagacagacccacctccacctttaactcgaagtaacactgcaaatcgtttaatgaaaacactctcaaaactgaatttatgtgttgataaaacagagaaaggagaaagtagtagtccttctccatcagctgaaaaaggaaagattctaaatgtttcagtgattgaagaaagtggcaataaaaacgatcaaaagtctcaaaaaattatgaagaagaaagagtcatcttctatgttggctacagttaaagaagaagtctctggtagttcagcagctgttacggagaatgctgatagtgatagaatttctgatgaagcaaatagtaattttaaccaaggaactgaaaatgaacaaagtaaagaaactcaaagtcatgagagtaaactgggtgaggaatctggtattgtagaatccaaattagatagtgatttcaacatatccagccacagtgagctggaaaatagcagtgagctgaaaagtgtccatatatccacacctgaaaaagagccttgtgcaccactgacaataccatccataagaaatataatgacacagcagaaggactccttcgaaatggaagaggtaggtaaaaaattactgagactggtttcaagttgcagactaggaaaaaaagtaccaaaaatgcttataaaatgagaggtagctaatagatttatactagaaaaatttattctaattttgactttccaggtttatgtttcacaaaccaagaattggtctcaggataatgtgatgtcgaggtaatgggacagttcagtaactcctccagatctttatccactagttgatatttgaaccttaaccctcttttctctctcaagggtaagattttgatgctcaagaaagccctgagagagtatatttaaattcaaagcaatattgcataatagttagaaacacaggctttgaaatcaaacagggctttgagttttgtctgccactgaatgactgtatgcctttgggcaagcttttcttaacatatctcagtggtaaggatatgtgaaggcggctttggggatagttcttgttatatgactggaaagaacatgaagatattacgtacctgcatggggaggatagggaccctagaattagcaggtttgaaaggccactgaatagggtttctgcaagcccaaaagaccaatgtttggttacttgttatttgtgtccagtaatatacctgatagttaacataaatttttaattggaaaagataaaagatacttattttgaatgaggttcagctaaaactgcttctgaatagtaggagctgaatagcttggggcaggaaaactgattttaccaagcatctaccctgtgctgggcactgttcttggctcttgaagtacttcattgcagtctgtgaggcacatggtagtggtctcattttatacatgaggaaactgaggcatatgtatgctaatgaagagttgtggctataaattatataatgcgcaatttgtcttttgtaatttattacattagatgcgttttagtaatagttcacagtagttttaacatcacacaccattattttagggaattagaaaatgaaataattgattcagctcataaatgtcctcttaggtgagtgtctctctctcttgctccctccctccctccctcagattagtgaagatttttcatttattgtaaaatttcagttgctgatacagatttttgcctttttgtggtctgttaatactttaattacaactgaatagtgaaataaaaagggagtaggagcagcaccttggaatattttacattttgagctttttttcttttatttctttgtatatgtttatatttcttctatctttttacctcctggtataatttatttctcatcgtaatgagtatggaagatgactgtgatgactacattaaaacctctgtttgttctttttcactctgataactttttgactttgttttggtctaaacttgttccagcactcataattaaagtgtaaatttttgcctaccattagggccctcttctatgacaattagatatggcagttaatttccttgtttaatacaatagcagagcataaagatctaaacaaattatgttaggtaattgcaaatctgatattggcgactccgagtgaacaacactcatattttcaagtaagtcactcttcaaagaagtcaaggaagtttatttttaatttctaaaattcctgaattctaagctgtagtttttaaaattttttaagatgccatacacaaaaggttttttaaacacttataaagtgctagatgtacttttgtggcaagttaacctttaatgatagtctgggggttttttgccccctctactggcaaaaaaggttaatgaagaaagcaatgtagcattgacgtgaacatttttttgaagtacaagattacatgcattggtggaagaataatgggagattttttttttaaatgaatttatggtcgaccacagctacattgtaaatatggggaattttaaagaaaataatgtatcttcagatatatttaaaatatggataaaaacctcctggaagtgtgttttcatccctaagggaacattaaagagagcttgtagaacaatggataaaggaaataatgtgttaactttaatttcctcttctcccaaacacttgaatcatattgacaaatgaagagaacaatcttattgaaactgacttttagatcctattcagtgtagtttgttgctatttttcttttggacctctttccatgaggtttgattcttgctgggaattttcttcttgtgaaaaccatgagtaaatataagttagagctccctctgtctcagtaaatcagttctcagaaacattatctgagcatgagctgctttaggaagctaggaaggagaaaatgttgcagatatgttgactgcatgaagctgcctaatccatctgagacaagaggtaagatccaacagtcaccagaagcaaagagacaaaatacttaaatgtaaagagagctaaatagatgatgagactgctcctggcctggtacaatgaagtgtctgtttcttatgttagaaaaggaaaaggccagagactttcagttaaaagtcaacttgccttataaagtgtcttgtagactgtttaaaatagttatgaatgtttataacgatgttttttcttttttttttttttttgagacggagtcgcgcattgtcacccgggagtgcagtggtgcaatcttggctaactgcaacgtctgcctcctgggttcatgtaattctcctgcctcagcttcctgagtagctgggattacaggcacataccaccacagccagctaattttttgtatttttagtagagatggggtttcactacgttggccaggctggtctcaaactcctgacctcgtgatctgaccacctcggcctcccaaaatgctgggattacaggtgtgagccaccacacccagcctataactatttataaaaagttattaaatcctgttcttgaatttctaattattccaaatgacttgcttcattaattcttgtgttcttcttgaatggcttattttgaatacgtcatggtaactctctgaagccatagattagtagtgtgaatgattcacaagttaaaccaaaatgatccttctcaagcagatgttcatcttttagatgtaaaggaaaaacttaagaaggagaacttttatctcagcatttctgtaagaagttgactgtgtggtcttcttgacctttaaatgaatttttatttaaatataaccattattggatatacacataatcttttttaagctactgatgtgttagtaactgtttctaatcctgtcttcatactaattattgatttaactaatgtacttgacttctcatttttagctgttaagttttaggatttttctatgtttattggtctgagttaaaataatcccacatcagtcagatatttgacagataattaagttgttcctttggccttttaaatgtaactgtgtatgttttgaagataagcctgccctggaatatgaactctaacatatgacatgcacagatatctgctactctaaagcccaattaaccactgttttgttatttgatatttacctaaaagaccttagtcaatttttattgaaaatttacctgacagtaaaaataaatgatatttttgtgtgtatgtgtaaaactcgatagtatttgtttaagataaacatttgcaagtaatttatagaatcataaactagtacggaaagagatactttattcattttctagtttcttccctttacaaatgaggaagcatcccctccctcatttgatattgttttatagcagtggttcttcaccatctttctgagggctataatattccttttgatatcagtgcttcacagggggaaggagcacagcgggtgtcagtggaggatggcagaggaggatctcctgttgtacattcttactactttactgtttgaaagtactttgacttacagttacatttgatcaccccaaggacctatgaggtagaaattttaattttaattttgctgttaattttaattttgaggctgagcatggtgattcacacctgtaatcccagcactgtgtggaggctgaggcaggaggatcacttgagcccagaagttagagaccagcctggacaacatagcatgacttgtctctacaaatagttttaaaattagccgtgcatggtggtgcatgtctgtagtcccacttctccaaaggctgaggtgggagaatcacttgagcccaggcagttgaggctgcagtgagccatgattccaccactgcactccagcctgggcaacagaacgagaccttgtttcaaaaaaatgaaataaaaaaaaaaaatacggatatttatcgcagataattgtcagaggccgttagccagtaagtggcatgaataagacttgaattcacgttacttgtgactatactatacaacttggtgaaggtcagatatgttggtatggtcaggcattgtacaagaactaatcatctgatgcacagcaccatgctactactttggaaaaagaatgatttcctctgacatttttttgagctgtcattaaaaattagacagaattgtaatttctaaagctctagttttgattttctttgaaaaccattttgatatacaatgtttattcaatgatgacagctatacagtctctttttaaactttagaggaagggttatttgagttagaacatccatgtattgctgtcctgtgcaatacaatacagtagtattgtgcctagaagatccctcttagtcaaggtaaacatgacagctgttaagaaaccaaagtggttcactgaaacaaaaagtacattttttaaacaagagaaagaaaccaaagtgagtgcctgtcattttagcagaacattgatttagaaagatacagtcattgtttcatgaaaacttttttaaatgaagtaacccaaatgtgtgggttattctaaagctgtttttcatctttgaatcccaaaacattgagaccatgcaattttatcactttggtttagtggtttttttttttttttatattatgaaacagttttgttatgaaaagtttcaaacttacttgaagattagagaaaataatatcatgaacacccattactcatcattctaattcagttttatttggctattcttgttaattatgaaaggctgcttatagcaaatgaccagaattctacggagcatttgaaaccactgaatagggaaaatcttgtcacataaatctaaattctgtgttctatatttgcttcataattctctgtggtgtaccccatctcaaatttgactgccgccttttgcacaattgtgaccaataataaaataagaaattcacccattatcactagcatgtatgtttctctcttcagcaagtgggtactctgattttgctgagtaaacaagaagaatcccaactttagttttattagtaaaatgtgactgtctcagctttttgaagtgctcctttcttgcacttaattatggagtttgtagtaaaaggagagagtagatttgtttttgccattgagtagcatcttgaagaatagaatgctgatgatatgtgtttattaaagtcatgttattttgtgattaatttcataagtctaaggaaatagaatatgtgataattctgtgtttaaaggtgagcagccgggtgcggcggctcacacctttaatcccagcacttggaaggctgtggcaggtggatcgcttgagcccaggagtttgagaccccagcctgggcaacatggtgaaaccccatctctaccaaaaatacaaaaattacccagtctcataacccagtctcaaaataaataaatagattaaatttaaaaaaaacatgacagtgagagatttggtatattaatgctgtgcctgagccagtattcctagaacataaatgcagaggcattggaattctgctataattttttgatctggttgatatttactttacagaaagatacttgaagtagaccgagcctgaatagaagctaataatagacattttattgaatataaaaagaaaacgcacattgttcccttgcatacaagacaatggttttcctgttgaacatgtatctgctgctttgaagaattattctaattttaacaagataacaaagaatagtagaatctatttttatatatctgatctacaggtgatggttttgcatgagtagtgtgctttcagttttcaaaagattcataaacttcggttcctggagctatgtagagcaaagaaatcacaaattagagcaaattttaaattgggtaatactatctttaacctttgggcttttaaaaatgttggttatttcactcttattcctttggaatatttcttattcttgaatagcttcataactaaaaactaccagagttttccctaaaatgtgttaactattagcgctttgattttttttttcaaggttgaaaacccatatgttcagctaggtaccacactttactaggatgttctttatgatttaagaaccaatcattacagagtaaagtgacagaaattaccgtgcatcttgcccattccctatgtatttaatgttgacatagagttaattatgttagaatagacagagtgtttgtggggtggaggtggtgatttaggaatctgaaaatttctaaattatgtacttgtgcagatagaaaaataaacacaaaaagacaactaagtttgatatgttctttgaacagtgttttcagggaagatttatggttaatatctttcattattttagttctgtaatgaaacctgcttttccacatacagctcccaagttatgtcttgaaagaatttcaggacaaagcagtcttaaacctgagcaatttttgatacctgaaagtttgggggagtttagaaattctgcagtggtagcactgtgttctattttcaaagatgcgagacttataattacctcaactgtgtgttggtcataatgtgctgtagtgagtgtattagtgtttctcctgggatttaccctactttgaagtttaacgtatagagaacttttccttatggatctgtttttcatataatagcaacattttttttgaatgaagcagttattaaaatttattcaaggttgaaaacccatatgttgggctagtttgcacacttgactacgatgttctttactatttaagaactaaccgttacagggtaaaatgatggaagctagtgcacgtctgatgcactaatttccatcagttatttttctttgctacaaacttgagtgctgttgttaactggaaaatagatcagaaaatttagttgtggagcattctaataattttgaggtcagatttcttaaagtttgaatatatatataatgttttggtgcacttgagttaggttgatttgtttaatagatatttattcaagaagttatacttgtttgccttagattcatttggttttaactacttaaaactcttcttaaggttcaaagtacggagggagaagctcctcatgttccagccacttaccagctaggtcttacgaagtcgaaaagaggtaagtggaccagtatccactagttctgagcacattatcaaatattagttgatttggaaaaggggttttatgtatcagtatttgtagtatttatgagtgtgaaaaggcaaagaacacacacaggtaggcatgattcactattgtttgtagaactttttttgtattttttaaaagactttttaaaaattagtttgctaattagtttgcttattctggaatgacctcattacacaattgtgtgtgctctaagtattttacactattgcataagagctagttgggaagtgatagagcaatggattaagactaccttttacattgttatgactgaaaaatatactggtattatctatctttggtgtttcactatataaatatagctcctaggtataacacatgaatattcctctagcaaaacccaccaattttttagcaatagttaaagctagttaaattcaaactatgggtcgaaggtgagtggttgtagatactgttcctctcttaaattattaattattgaccaaagaacctttgaatccatccctttcacttttaacttgcaacaacaacaacaacaaaaatgtgtgatctttggatttacaaaacttttgagctttagagaaagggaaagaggaagaagtgaaaatgaccactgaaggtaggactgtttatttttgaaactttacacatgctgaaccaccctgttttttttttaaacaaagattcgtatgtatgttcctagaataggaaattacatgtttgttgtctcctgatctctgaaattacttcacaggagacaatttgcataaatttttttcttttattgcaatatggtattaagaaacaagagcttcactctcactcggtcactgcagctctggttagactcaaaattgaactttactatttaattttcttccccttgtaagttcataaatttatgtatgtgtttctgagctgagttcatggtcatcaagaagtgtttgctttagataggtagacaggggatacattggaaaaagcagcttgccatgcattaaaaggaggataagaaaacaataaaattactttaaggtgttttaagagcaagatccctgtagtaggaatgattagatgtggtttatattcatatctgggttttttccttttcttagtcagatttttataaagtaacagtaaaatggttctgtgtgtctgtgtgcatgagagagaagagagaacaacatagttttcatcatcttgaaaagtatcctatatcctatgtaagtatcttagattgatcataactgtagagttagaaacactcgtaatatatttacttcaaaagtttaggaaaaatgcatatagcagtttgataataggacttttgaaatcaaaattatcttaatctcaaatccagtccaagatttacatactgaagcccagagaggtttagtgacttaatgtttgttacaagttagcattcggtagttatgttgagaaaagttcaacatttttcttattaaagaagacatacaatattttctttagtctaggagagaatagatagacagttgtttggtttctttatgatgatactagacaaagtttccagatttttttctcactttaatgtttcctctaacttcctagtttttaattagaaatcatatattgtatctttaggacagagatctaatccttttttatagttccatctttttctgttgagaactgtgtttttggaaacagaagtgtctgactaaagaacctagattgtgatttatggtttacaaaatagtttcccctacattctacttagtttctgaagtagccctgtgagatagatagaagaattattattatctcgttttgcagaggagagaagctatattgcttatgacgagaaacacagcaagaacttgaacccaggcctccttgttttacccattgccccaaacctgctctgaagtctgagcagtctacctgcattatgacccaaactgtgtacttagacagggcttagcaactgtgaggtgaacttggcagactgtactctcttgcagataaaacataccttagcagagagaaccagtcagagctgctcactctgtcttccctgcactcaggcacctgcccttgcctagccagatagacagtttcacttctaaatcgtttaaatgactgcattattcttttgttgctttaaggaaatgggtatcattgattgaggtcagcaaacatttattctcagcttattctaggtactgggatacaaagaagaatagtttctgccttcaaaaggctcacaatctagtttaaagatatgaaaatacgtaattatagtgataactgctatagcataagatgttaatcattttaccaagaatataatgccttatcagtactggtggtaacagcttattgcagttcagtttcacaagtattccaatttacgtaggcttatcaaggatatggaataattccttatatttcattttgcagtcttgttactatcaaaatgatattacaaaattattctaaatttttaatgggaaaaatgtattccatggaaactgagtctatagtggggtatttttcaaaccaagttgactttaatagattttaaattttatttaattatattatctggctctttttctatgtggttcatatcttaaatgaatatggttttggtaaacacactttatttagccttttgcttttgaagttctgcagaactttgctgtctcttgaagcttctgccttgatgaatgtaagaactgtacagtctctcccattgtggtagttgtagtgtggatagaatgtgaacatacttgctatgcttagttggcctttttacttatgtaaaacattatagatcatactaaccaggaattagaattttgaggcagaaaaataagcagaaagattttataagattaacaatattatgttgtagttgaacctatttggttgagttttatgtaatttttatgaaagaattgtttcataccttatacatttgcatcatttaaaacatcataaaacaccagagacatttaagtatgcttgcatttcagattatttaatttactggccttaattgtatttatttatttatttattttttttgagacggagtcttgctctgtcgcccaggctggagtgcagtggcacaatcttggctcactgcaacctccacctcccaggtttactccattctcctgcctcagcctctcgagtagctgggactacaggcacccgctaccacgcctggctaattttttgtatttttagtacagacgggcttttaccgtgttagccaggatggtctcgatctcctaacctcgtgatccgcccgcctcagcctcccaaagtgctgggattacaggcatgagccaccgcgcccagccctaactgtgttttttaaattgggaagataatagaaatctttacacactatgctctctatatgaacttctaaatttacctcctaaatatctttacatatttacataatggaaatggtttactttgggacttctgtttttattagagccatcttttacttcagttttcctccaaggataaaacattgattggatttaccaaaatagattataattagagcttaattaatgagcgaataccgagagattctaatagaagatctgatacagtttttgtttgaatttgagttacctcctgtactttgaagacataattttgcataagtaatgcatatttttctaagaagcagtcaaatattgtgtatcttatatctgctgggaatcatatctctgtagtaatattgctctcagtaatttcttatagccactttttttatttatagatcatctgtttcttatagccacatttttttattcatagatcatctgttacgtactgcaagtcagcattccgatagcagtggttttgctgaagattctacagactgcctatcccttaatcatcttcaggtaaaattttctgttctaataggcactatgattaacttcctcattttaaggtggtttttgtattactatatattttaatattgagtctgtataatctttatttttcaagtgacagaacaaaactcctggcatgtagatgttatctaagcatttgactataaattttagatttcattaattcttctctctgaatatgtttttaaaaatatctatcttccccttaatttttggaccaccagtaaacagagattattgtgatcattaacctgttttgtctgttgtttttcttatttttttaaccatcattatatttcattattttacagtaattgttttgcctatttaataactgacattaattgtggacctatagcttgctgagtgttatactgatttttacactaggttgtgtgagataacccagagaacaggcacatctttatccccaagaagcatatagtctatatgtagagtacacagaatgcacagaaaaagcatttgaaacattttttaagcaaattctaaagaaaattgggatgagaaaactcccaaagagcctttaggaacatagcatttaaggggtaaacagacaagaggcatatgtaagttcactgagaaagagtaattaagtgaacagaaacactgggagatggaggagaaactttcagaaggtatggaagaaaagataggaatgttgactggttttcaaatatgaatgatagcttaagagtgaggggtctttttgtccttttataataacatgaaatgacttggggaaagtgttcagctaagggaaataaccgtaagagaagaactgattcagaaaaatccgggctgaaactggagagataccctggtcttggagaggatatgatcaggaacccaggttggagggattcgctttgagtttcctttcagaatggagagaaggagggaatgatggggagagatacaaggaagtttttagatgttggggaagaatgttaggaagtgtttgtccattttctctatgagtcagtgtgttgtattgaaaggaaagggggaggttgttggaaagggaattttaggaaaacagtgaagttctgaaataatctttgtgagaaagtgagaggaaggagggatgtggttgctgctcaggagcaataaaacaattttgagcaacagcagggccacaactgcagtggagacagtgaaattatagaagcaccatgttggtttggtattttgttagtgactcttcttacatatattcttcatctttccacctattttcttttcacaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacaggtatgagaaaaagtatgttatcattagcttttttcttttactgctctgagcactttttaattcacagagaagctaaggcacatcaagtatgaactacctcagctttattttctgacatgtctaaacttaatctgcatctgccttcgttttctatcttccctcctgtttcaagggagaagctgtaactaaccctgatcaaagtcgatttctctgctcacaagtctgtctcctttccaagaggagagatttttctcgttaagtatcctcccatttttagtctatcatccactgtctttgttttagtctagaatcttttgtcatttctattattaaaaaatcttccctcttaaagttctttctctctttctctctgctatttgaacatgttgactaccttttccttttccaagttttctccctgttggcttctgtggcaccacgttctcctggttctgctcgtagctctctgactaagctttccccttcacctactgaccctcgatgctgtgcacagagttagtctacttccactggactcaaagactggaactactccagaccagaaaataacaaatcaggtaaagtgtgaatttgatttaaaatgctctgtatgtcttgtcacttttaaagtcattctcagatttgttagtagactggaaataattttcccaaaaaaattttgaaaataagtacgttgtcttcagttttgccttttacattttcttgaacattctctctgaatgaatcatgtttagacaattgagggattgaagaaaatgacaatgtaatatagtcatgagagcattcaacaaagagtcaggaggcctagaatgaatgtaatagacctcttatcatgacatagtagacagggagccacttggaaagtaaaaatcaaaggtgtaacttctcaagttataataagatatacctcctcttaactgtaagttttatcctcatgacaattgtcccctaacagttttctgtttaaacagaatgtgggtgtttcttattcctccttacaaaatatagttctgtctgtgatggaacttgcagctgtgattatgtcaagctggggatttccaggaccctgtccaccagtaccgtggtgcatctttctaggccacctagttcttctgctccagctgtggtctctttctcctggatatcccagcaataactcagctaatacatctccccatgcctaccccaccctacactagtggacaggtgctttctatgatgtggtctctgactatctctccagcctcattccttagctgtaggattgtgcacaggtctctaaacagttgtgtgttcttaggtatctgcacatggctgattttgtgttttgtttttttaaaataaaaagatgaagtttctgtttctcgcccacgtggagtgctggagacagtggtgtaatcatggctccctgcagtcttgaactcctgggctcaagtgatcctcctgccttggcctcccaaagtactgggactataagccacttttttttaaccgagatcacccagtctttgcctttctttgcataatcaagccctatttactgttaaggctcagttcaagtagtgttaccacttttgggaaagttcacgtaatctgaatttttctgtgttcatcatagcactccttccacagtattagaatttttttaaaatttcctttatttttctttacactgtgagaacacctgaaggctgggaataccttttatgtttttatctcactgcctaaaatagtggcatataggaaatgctaagatgtctgagaaagacgacaatgattgcttgctctccagcaaagttaataatcactataatctcatgatgatatttgcaatggcttctacatttttgcgttttgattttgtttttttttagtttcgcaagagggaagtcctgaaagaaatagatgtgaactatgttccttcgcctcctcctcccacgtagattgacttatacctggaacagctagcagtactaggtgtcattgggaactgatttcttttttcctgcttacaatatgaaggttttttggatccttttgtcttaaagagaaaaatatataggccccaaattctgccttttaaccccttaagtgatttggaagtattcactttaacattggttttaatcctacttttacttttttgaagtaccctatgatgagaggacctgatcctgctgctgctccatatagtactcagaaatcatctgttctacctctttatgaagtaagttctttcttacatctttgtgttccaaaataatttgtagaatttagaagtgtaattttgttatattgcattctagaatacttttcaggagctccaggtaatgaggcggagcctgaatttgtttagaacacaaatgatggatttagaattggcaatgctgcgtcagcaaaccatggtttatcatcatatgactgaggaggagaggtaaaagttcattttgtcttagcacacctcaaaaagcttttcattcaaagtcttctcaacttatattttttaaaattaggttttgattctactgctgtgtaccttgtatctgttttgtgaaccagtgtagataagattagtcatagatagtgttttactaagtaaacttgtatgccttcaatatcctaagggtagtggtaacctgctttcccgtgtttgagatatttgtgagaggataggggaagaaagactaatgtccttgtggatacacctattgtagttgatattgtactaatttctagaacctgagatttccatgccttctgttagcatatagtagttgttgaaagatttgtgattaggaatctccaaactgcatttttccaattttgtgcccttcaccataccaataggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatggtacgctacctggagggtggtcggagttttcaccaaaggtttatttataatgttccaataatttaggacgtgtgccttcatttcaagtcatttattttaatggtattaaaagcatgcatactgtttaaggagctttcccacaaatcagttgaatgtacaatttgtaataattgtcataaatagtatatttagaaatatgttgaaaatttttaatgataaattttaataacaggaaagaataagggcttatacgaaagttgagggtttttaaaggaaaaatgctagtgaattaacatatgactaatgtaaattttaattgttgcatgtaactgcagagaacacagatgcatattttgctgtttttttttctttcatgcctttaaataaaaaagtgttccttttaaactttttctttattttggattcttttccatttgtttttaaaggaatcaaatgatacctgtatattttcatacatatatatacatacacatacatatatgtattttcctaaatatatagatatatatccaagagaataaaaagaaacatgtttttgtaccacttttcatacttctaatgtttctttccataacatttgaacttcaacagttgtattatttttgcaaatatctttgaagttgtagaatatgttgctttgaaatgctgaaatagtgaattattctttgttaccttaacaatgtatttgattttgttaaaaagaaatggatgaatatacacacatacaattatgtgtgtatatactataaatgaagtagaataaacaatggtgtataaacacatatatgtatagcatagactaaggatgttctgtattgctaatgaatgtacttttcaacatggttttgatttatcattctgagaagtgtatgttggtgacgggagaactagaacatcctttttgcatattgtatcagttttaactcacaataatgcattttatgggatctgtgacacttgagagtaacctttgtgacataaagggatgcttccaggcactaattagccaattaattttattataaaagtcttgtgatttgaaaaaatatatatgtacattataattatatatgcatgtatgtatatatacacacacatatacatatatatattgttcttaccttttcagggaatgtgtggcagtagaagcgctgataacttgtcatgcccttctccattgaatgtaatggaaccagtaagcttctttcctcttaaatcactggggaagggaatgatacaacatttcagacacatagtttccctagtttagatgaaatatatgtttattttaaatacataatttgataaattattgttgattggaagtgactttcacctttgaaagtccattgctgtctgaagccactagaaagccacctgaattgcaatagtgatttatctttctgactaaaggaggtaatgcaccataaaaacatgtacagtggctcatgcctgtaatcccagcactttatttaaatggttgaggtggaaggattgcttcaagccaggagtttgagaccagcctagtcaacaaaatgagaccctttctctacagaaaatttaaaaatcagccaggcatggtgatatgtgcctgtagtcccagttactcaggaggctgaggcgggaggattgcttgaggccaggagctcaaggctacagtgagctatgattgtgccactgcactccagcctgggtgacagagcaagaccctgtctttaaaaaataataagccaggtgtggtggctcatgcctgtaatcccagcattttgggaggctgaggcaagtggatcacctgaggtcaggagttgaagaccagcctgaccaacatggtgaaaccgcatctctactaaaaatacaaaaattagctgggcatggtggcaggcatctgtaatcccagctacttgggaggctgaggcaggagacttgcttgaacccgggaggcggaggttgcagtgagccgagatcaagccattgcactccagcctgggtgacagagtgagactccatctcaaaaaaaaaaagaaaattgatttttaatttacatttcaggagacatgtgctttcacagtttgatcctggttctttaggtagttagagctgtaacatgaccacgtttttaacagaaatctgtctttattgtgttagacagattggttcatttgggggcaaaagcactatgagtaactatttttcactagttactcttccttacaagtgatttggacactttggtggtaacaagtaaaatttcatcctactatgtattctgtttacctgttttgttgcttcatctcaataggaatttaaattttacttaccatttttgcaaataaaattgagtagttattaaattaatggaatagatttatgtctttacaaattacatgattttaggcaataatgacaaccaggactttaacctttttagctaccaatcttaattccaagagagaagaataacatttttttatgatctccaggtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggaggtgggtaaaatctgtgtttcattcatttatttggaggtatatgttagaggagattttgtctgaatattaattatttacagaatgttcttttgattcactgtattcaataattttcacagagcttttaaattagctttcctgttgatcaagtttgtgtcaattaagatatatttgtaatggcatttctgcaaatttcatactctaatgtgaaataattacaattctctgtgttcagtatggtgaaaaagatatgtgaaggactcaaaataaacatgacgtactctttggacctcttgtttccacatctacaaaatgaggatttacagtttagatctcttcgaggattaaaaactgcattttatagctggacgtggtggcatgtgcctgtagtcccagctactcgggaggctggggtaggagaattgcttgaacctgggaggcggaggttgcagtgagccaagatcatgccattgcactccagcctgggcagcagagcaagactccatctcaaaaaaaaaagaaactgcattttataattacaattgataggagaaaatgattttgtgattttaataagtataaatagattgatttggtttggtgttttttattcaaaaatcaaaatatacgaagaaaagagggtttgccctaggtgatagcagcataagaacttgaagaattaccatagttatggatgaccaaaagaactgcaaaaggaaattacatatgattagtagtgaaagttcaaaagttgagaaaattagtaaaataaatgttttttgcactgagatcaggtaataggaaggaatagaatatatcgtttaaacagctcaatgcaattatctctgtttacctagtagtattctgtggattaaattgtacataagcaaatgtgaaatttgctgtatatgcagttctctagtatttcaatcatgttgaatcaaatcacattttcaaaacaagcattatagcagaagacttcatatctgtaatttattttcatgatatgactctaccaactaaatgtttaaaaggtcttaattctataaatttatttttcctacaaatgtaattatttttgtaaattggttttggctgcctaatgtttagcaaactcagcattcaccctactcggtcaggtgtgtctatgattaataatccattcctgtttacatgttttatatcaaagattagtttttgagtgaaattatgtaattattcttctccacactatatttgctaactgaggaagtgggttttaaggtaatttttttttttctagaaatgtgatggttttgttccccttagcttgctttggtatgaaagttttctttgaaaactttatattgctcttttaaaacaaatactccattcaatgcacacttgaatcctcatttttagaattttaatggcctgatatgtcctgtaggtgatttcctaagaataaagtgttcatttcagactagaacattgattctttggcttataagacacagcatatagaaaatttagttattcccattaggctgccttggtcctagagaattaatcatttaaaagaacctctcattaaatatgaaagattttataatttgcaaacacttaagctggtatgcaaggcaaatgttcaaagaatttttcagaatttgttatttaaaccattaattagaaactacttagttctgaatttggcataggcttgaggaaattgggtttaacatttattcttttactgtctacaaagggcctacccagcaaaatatgtatagatcaaacaaggcataagaggagtattgttgtacttaagaaaacaaattattttgaagtactttaaaagcatatttaatagtttaatgccagttataatttaaaaaattatgttaatattctcttagttacaatagttttctgtttataaagtatttaaaatttagtttggtttttattccagtcattcaaattggtaacctttttacctaaatacatactgtactaaattccaattttttaaaatcttggtgtacagctaccaagaaaattaaattagattctgtcttcctagcagatctgagcccctaatcccattaacaaagccaccattcaggaaggcaagatttaatcttgggttgaacagttttgcaggtgaggattaagcatgtttggcaggcactttcaggaaagttttcttactgcgttcatggatgcatgaaaacaatggtatctgtcaggcctttgtttctttcgttgtaccattaagtgaggtttttaaaaagagggttttcatcatttataatgtgttaatacagtagaattctttttttgaaggacaacattgaaagtcttttcagacaaatatttaatacactaattacatagctaaacttttgtcatattaaagatacctcttttctgcatgtgcattgtactaggaaaaaagtacacactgtcttaaaatttgcccaagtcatctgtgatgtatgtgatcagtggcctgaaactgtttgcagttactttaaaaatgtataaatgtgtgtaaataaaaagattacttaataggatgaatgaatacatgcccacagaagccaattcagcaaaattaaatgtcaaggagtaaacatagattgctttgtgtttagagagttatttgttaattagagttcatagacttgattcatgccttttgggatctttattagagcacgtctgacatgttttacccatgtattttggtaaatacacagcttgctcatgtgttcttatggaaatttcttttagtgatcacttgtaatagctgccacttagtaggcactcagtaagtgcataataagtggatgtgttcccacatacttcagacttgtagtcagtctttttgtattgtcgatcagcatgactttctcaatctcaggtagtctgtatttagcctacatttttttggaaattatgctcataaaggtaattttaccatccatcccagggtagtttcctcacttctaatccttccaacctctccatagcatgggagactttagaactaaattatttgtccatgcatttattcattcaataaattaataaagacattgtatcattttcagggccattttatctgtagtctgctttcgtttttctgctttctcttcctttttgtgtctgatattgtctctcacccttgtgctttctcactctctcattgattcattcattcagacgcttactgagttcttactgtatgctgagatacactgataaatgagacctgacctgctcgctgaaggagctcacagtacaccttccatctgacctcacccttcctattctgattcccttctgctctctagagggaactgtcttggcagtcaggctccattatactcccctcttatttgagaccgtcttgctacagagttttctatctccactgtcatctgaaattgttctttctttgttgtgacataccatgtaaaagctgccattctctgagaattttgtcccacactagtctctcatttatcaaaattttttgttcttatgtcattaatgaatcaataaattatttttcctttagtattttatgaaaccgacgaggtgtggtggctcacgcctgtaatcacagcactttgggaggccgaggtgggcggatcacctgaggtcaggagttcgagaccagcctggccaacatggtgaaaccccatctctactaaaaatacaaaaattagccaggtgtggtggtaatcccagctatgcaggaggctgaggcaggagaattacttgaacgtgggaggcagaggttgcagtgagccgagattgcgcccctacactccactctggatgacacagcaagactctgtcacaaaaataaataaataagaaatatattttatgaaacagtattcattttgtgtccattgagattatatcatgcttgatggtagggattcttttatactttattccaataatgcctgtactcccaaaaaagattggcacacattcctggtttgtcaagaatacattttggcgactgggcgcggtggctcacgcctgtaatcccagcactttgggaggccaaggcgggtggatcacaaggtcaggagatcgagaccatcttggctaacatggtgaaaccccgtctctactaaaaatacaaaaaattagccgggcgtggtggcgggtgcctgtagtcccagctactcaggaggctgaagcaggagaatggcgtgaacccaggaggcggagcttgcagtgagccgatattgtaccgctgcactccaacctgggtgacagagtgagaatccatctcaaaaaaaaaaaaaaaaaagagaatacattttggctagtttgttttttgagtgatgaagaataatgagatataataaaatggccatattgcattggtagcaggactggaaagactatactcattgttgtgaatatagatttgcagtggtcctaattcagtatgttgtatttctgtttatatactgtgactaagagattctggtttttaaaatatttgtatccaacacatacttgtttgaaaagtaaatctgaagtgctgtgtgcttcagaatcttctgatgttgtttaaagtttagaaatattgataaaaggtaaagtgaaaagcttatagtatttaaatatattccagtacagatggttggtagctaaggagtgttttgtttctttaaataactatgtataaatctatgtattgtgtaccaattttgcatgatagactaatacaggaccatttttggaaagattatagttaagatgtgtttgagatgtacttaggaacattgtaggaaataaatcaatttggctgacaggaaactggaaatgtagaatttttaaaagcttgttgagagtatcttgagtgcttatttgggaacacattatcactttatttcaggaaatacacatttatagctttcacaaagggctatttaaaagtgatgctgtatcattagagagaaaaggtggagataggcatatgtaagtgtttggacacctgtagaagaaaatcctgatggaattgtcatttcctcaggtctgtttgccttttccaacaataaaatgagatgtatatcctcatatcctatatgcatattggaaacaaaagcttagatggctggcagtgataccatgcaactaaagaaaaagttatttctttagagtttatggttgttttgaggatgttttttatattataaaataaattgtactaaatgataatttcttcttcccattttaaatgtgttaggttgaacaatatgtctttagataccttgctgtcagttggcataaacaggcagtatacctgtatactattttgcctctaaaagattttctcagcaatgagagcacttgtgtctctgctgattaccttacaaagttagacaatactaaaaacatttaagaagtccttccagattatttttttgacatgaggtaaagtatttactagaagttttttaacttatgaaataacattttctaatgtcctcaccttatgaattgtgatatttgtaatctagttagctgaacaattctagaccagtccttgggagtctgatctgggttggatgatagatggactcgattccccactccctctctgtattgcagggagattcacatgaaggtgaaattaagaaattgaatgctatttgtattttttccaaaaacaggaaaaaatgaattccattcatattggtaaatttttgttttattgtttttccaatctagattaaagagtctattgttggggaaatcagacgggaaattgtaagtggacttttggcagcagtatcttcaagtaaagcgtctaattctaagcaagattatcattaaacagaaattataggtaaatttttctgagtttctttgttgagctaaatgtaaatagtaactggcattttattctttgttttgttagtatacaggtttggttctctagttaaattttgagttttagaatgtatgtaatatgttattttacaatgtgaaaatttcacacaagcctatttgaagtgtaagtcaaatcccataatacaaatctccaaggaattacttatattgggtcattctactgaaatttcattatagtaataaatcctggaattggaccttcaaacctgaatcttattttgattataatggtatttcagatgtatagttttaaagaacaagattttgtgaattaatcacaacttccttttttttttttttgagacagagtctcgctctgtcgcccaggctggagtgcagtggcgggatctcggctcactgcaagctccgcctcccgggttcacgccattctcctgcctcagcctcccaagtagctgggactacaggcgccagccactacgcccggctaattttttgtattttttagtagagacggggtttcaccgttttagccgggatggtctcgatctcctgacctcgtgatccgcccgcctcggcctcccaaagtgctgggattacaggcgtgagccaccgcgcccggccgaattaatcacaacttctaagtatctttcctaattatttttatcttttaaagaaacatatcccatagattcatttctaataataatttatttcaaaaaactcttttatatgtctgtcttagtaaaacgaattactttcattttatctcgtagctctaattacattaaaaaatttttttgtagagatggggtcttgctatgttgcccacgctagtcttaaactcctagcctcaagcgatcctcctgctttagctctaacttcattttatataatatatattaataataattcttggtgaatgcaaaaagaaagaataagttgagtagaatagaactaaaaatattcattgaataagacatgagaaacaaatgtaatttgaaaagtataatatacaatttcagatataggaaattggaaagtattttaataaattatgtcacaaagcaattaataggaattattttttttaaagccagggatataagaattaactctcaggaagatgtatagagattacaggataatcatgtttctgtgtatatatatttgcataaaattctcatcttcctttaaagaagcttttaataacagtatttgaaagaggtttaaaactgacttctcttttcttttttaaggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcagtatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggcctatgacttgaatgaatagaaatgaataagctggtgtttgttttttcaaaatggaagtaatttagatttgttctcctcatacataaaatgattttagttcagttttaaccagtgaaaactttgtttttatgaaaaaaaaggaaaatggtttcccatttggttttatatgtgttaaataaatgtgtaaagtaaccaccaaatgttattagaatttttcttctagcatttataattttttcaactcctattgtgtttctttgtgtgtgatattttaatcaaaagtggttgagttgttaacagtgttctttgaaagaatctctaaaaggcttataaatgtttgaaatatcacacaaaggctgatttctaaaatatatatatattaaaacaataaagtatttattttgcctaaa

SEQ ID NO: 36183 - DNA, 11113 bp, Homo sapiens
ccagggtgatgctgaagatgatgaccttcttccaaggcctctagagccatcagcctgtgccaggcaccctcgacttgcctagaggcccccaaaagttgcagtccacatcagaggcagagtcagaggcctccatgtcggaggcctcctctgaggacctggtgccacccctggaggctggggcagccccatatagggaggaggaagaggcggcgaagaagaagaaggagaagaagaagaagtccaaaggcctggccaatgtgttctgcgtcttcaccaaagggaagaagaagaagggtcagcccagctcagcggagcccgaggacgcagccgggtccaggcaggggctggatggcccgccccccacaggtgctctaggaccctgggttagagctagtctggggcctggacggggttggcgctcatccgcgtgagtgagccacttgcacagtgggccggcaagtggggctggaaggcgcgtctgtctccctgctttcacctgtgccgcaatctggggggctgggaggccttcagcctagtcagggacaccgacatcaccctttagggtgttggccgccggccctgtgcgcgtctaggggaggacggtcccgcttggcgctggccgccccgcccggtgggcggtgggctggggccggggctgacgcggctttcccggcgcagtggaggagctgaaggcggcgctggagcgcgggcagctggaggcggcgcggccgctgctggcgctggagcgggagctggcggcggcggcggcggcgggcggtgtgagcgaggaggagctggtgcggcgccagagcaaggtggaggcgctgtacgagctgctgcgcgaccaggtgctgggcgtgctgcggcggccgctggaggcgccgcccgagcggctgcgccaggcgctggccgtggtggcggagcaggagcgcgaggaccgccaggcggcggcggcggggccggggacctcggggctggcggccacgcgcccgcggcgctggctgcagctgtggcggcgcggcgtggcggaggcggccgaggagcgcatgggccagcggccggccgcgggcgccgaggtccccgagagcgtctttctgcacttgggccgcaccatgaaggaggacctggaggccgtggtggagcggctgaagccgctgttccccgccgagttcggcgtcgtggcggcctacgccgagagctaccaccagcacttcgcggcccacctggccgccgtggcgcagttcgagctgtgcgagcgcgacacctacatgctgctgctctgggtgcagaacctctaccccaagtgagcagaccaggggctgggcccgggccggcagggagggtgtcctctgtaggaggggtgtcgaggggtgtcgaggtgtgccgccggcagcttttagtgaggtcggtgtttgcagagttttgggtccgagaatgcaggggtgggacttggactccctggggcagagcctggacaggcagagactgggcctggacacagggataaggctggggctgggtctgcgttgctcttggaatccttaatttcctgggcctcagtcacattctgctgttggggaaactgaggcacagaaaatggtagggatttcattcacgagcgcccagtctgaggagggggcaaagcaatcaataaccatccagagctggaagggctgtggcagcagaggccaggccccgtgcagagcatgggcccaaagcaggcctggagaagtcagggaagccagcctggaggaggtgaaagccagcggtccttctctgagccagggaatcaggccaggaggcaggaggaggggtgatagggcaggtaggggagaaggtgagaggaaggtcggtgctcctgagcatgtcctcttccagggcactctggagctgagcagagctatgcgggcacccccaggcaggagagttccaagtgatgggctagggccacgtgtcttgttagacccccattgtgtagggttaccctgtgagcccgccgcagagctggagcccctcaggtgggaggctggctgtgcagctggtacccctgctgagtacagcctcaggcgtcccttgactccatagatccctgggcgtgcccgtcattcgcacggtctgcatggagagaggcttactgcagtgtggaaaggcccagggcgggggagtccaggggctgttattgtggggcttggccactgctggccccagatcctagtgtgaaactttaggaaggaagcctggaggtatagacagtgtgggcagtgtctgccgtctcgggggccttgggtggcctgtgggctcagttcgtgttgaagggtcagcctctggcagaaggatagagaaagggtccagtggagagggtgggagaggagtcagcagggcataggggaactggcacagggcaggggccacgggagagataacccagcccagagccagttcccgcttgctcgtcctgactcaccaggaaatgccgggcacctgcacccctgcctgccagtctttctgtcccagtgacctcggggtctgctggcctggggttagcaacaggcaactaaagccaagctgggcatggagccctggtgagagggtgcccaggggggcatcgttgaagcctgtgtgccagaaatgtggggaacggagggacacagctgcatctggattgggtgaggggcagagagaaggtcatttgtaaacctctaggcagacaaagggcccttaggaagtgccagggctgggcagtcccctgggagctctggggcgctgcagaggcgccaggacagtgagccaagatgcgtctgtggagcagtttggggcagcccttcctgcccattctggcctacccctgggattgggaggtggccggggctggtgagatgcccaagacctgcagggctggagcgcagtgggctgggagctggctggattccagggctgctgtgagtaggagcagggttttatctgggtgacaggtagtcttggagcaggaagaagatcagatcttaaaggtggctctggctgctgggtgaagaaggaattgttggaggtgagggaaggagcagagaggccgggaggaggcttttgcagtgagccagcggggagctgatgggagccggccagggcgccagagtggcatgaggctgctgattttgggggctattttggagcaggacctaatggggggggggtggtgagagagtcagaggaggcatgatgacttcagagtttctgttccaaaccaaactaagtagatggaggacccatcatctgaaatggggaccgggtgggggtgcgggagggtgtgctgggcagtctgggcctgccagagaccaaggctgagggcctgggctctagcttgagtggtggtgctgatttggtatagttgtcctcatgccagcctcccctgcctgcagtgacatcatcaacagccccaagctggtgggtgagctgcagggtatggggctcgggagcctcctgccccccaggcagatccgactgctggaggccacattcctgtccagtgaggcggtgagtctccacctgggccagggaggggcagggaggcagcagaggagaggctcggagacagacaggacatgggcagggagcttgacgggtcttccaggtgagcgaggtgagggatagtgccccagtgacctgcccctcctcctccaggccaatgtgagggagttgatggaccgagctctggagctagaggcacggcgctgggctgaggatgtgcctccccagaggctggacggccactgccacagcgagctggccatcgacatcatccaggtactgcaatctgccccagggcacacgtaccgcccgtgcacgtgcatggggagccccacgcacattccgtcctgtgtgcatacccatgcccacctcggggcaccccctctgttcccgcctgtttcctccccgtcccctgcccccttgtccaggcgagcccctgctcagctcacccaccaccaccctgcagatcacctcccaggcccaggccaaggccgagagcatcacgctggacttgggctcacagataaagcgggtgctgctggtggagctgcctgcgttcctgaggaggtgggtgtgtgcccaggatggggtccctgtagccaccgctctcagagccacggcccctccctagtgcctcaggtggggagctgagctggatccccgccctctacccctgtccctgtcattctgagccaggagttgtttcccactcagccagggcactgagagcctcaggtggtctgacctccaccaggattcaacgtgggagcctcttgcgcccaccccatcagcaaagctctcagcagagcagcctctagcttcaaagaggataccccaggagggactgagaccccgccaccccttcatacaacactcctagtctccaccacctgaattctctctgctctctccctctcgacctctgagggcttctccagccaaccacacgctcactcctacctggtctcccaactctagagagggcctgggagcagcagagatgggctggtaccctcttcaggagcccaagccttagcttgtgaagccagttccatgatgcccaggggctagcggcccctcccttggctatgggcagccaaacagaaaagtgaaccccaggagctggcagggagggcagggaggctgctgctgtggtcccagtgtttgggctggtcctgaatgtgccccttctggtttcgccagctaccagcgcgcctttaatgaatttctggagagaggcaagcagctgacgaattacagggccaatgttattgccaacatcaacaactgcctgtccttccggtgagagtgttgggaggggcttgcgggagtgggagtcactcagcgggcaggagaggggagctggaaggtggagggaggaggagctgcttaggccaagaagtggaattcaaaccagcaacatgtgtgaggactccacggcctgcagcagcagcagcaaacatttcccaagtgctggctggggcaagcacacaggcagatgtttcacccattatcttatccttaaagcaaccctgtgaagtaggtatagtgatctgtctattaggcagatgggcaaaccactggaggaggctcacttgcccccagttacaaggggatgtagtggaggagtgtcctgagggcatggagaacatggatgggaggacttgatcccatagagaatggggagccattgagggttctagagtgaagagagggggctgtctggctccctgggtatggggctataggctgagcagggctggggtgacctctctgcctccaccttccaggatgtccatggagcagaattggcaggtaccccaggacaccctgagcctcctgctgggccccctgggtgagctcaagagccacggctttgacaccctgctccagaacctgcatgaggacctgaaggtagcgggagcctcttgccctcaggagcccagtgttggggggttcccagggagggactgggaggtgcccccagggaggagtggcagaagcaaagatgtggggaagacacgctccaggcctgtggacggcaccgtgggccagctctggtgcagcggtgatgcccggttggggaccctagcaggctctgaactccgccgatcatgtcctggggtttcacctgagaggggccgcctggggctgggaggggccgcctggggctgggaggggccgcctggggctgggaggggccgcctggggctgggagggcctggaaaagtttcactgcccctccccgattcagacacagcccagtcccaagcctgcagacacctttccttcaatcccctcagcccctcctatccacccccatccccgcgcctgactcccagcaactgaggctcagggtcatcggcagctggggttatatctgttatgggccaagaaatccacagaaaatgctgtgaaaacaagtagttcctttagcagggtgtaaagtggggggtctctcaaaaggaaggggagaggttctcttcccggtgtcagggactagcggccatgggtggcctgagtgtggtggaagcccgagcggtgaccccacatcccctggtactgatctccctggcccagccaagcacaaggtcttgtttatgaaggaatttatttatttaagtggcagtggacttggcctccgggccggcagacaggctctcctggctcctgagccgcactgggtgaccttggataagggtgcacagagccggctcccacttcctgtctgtgagcagggacctgaggttggcccgggttccctgggagtccttgagtgccccccgcccctccaccaggcacatgtgtcggtgtgtgtctgtgtctgcgtgtctgcgtgtctgcggctggcagcccttcctctccagggcgtgactagacatcctgcctctcctgtctcagccactgttcaagaggttcacgcacacccgctgggcggcccctgtggagaccctggaaaacatcatcgccactgtagacacgaggctgcctgagttctcagagctgcagggctgtttccgggaggtgaggaggctctgggctggtggctgggtcttggggagttgggggcagcccggacacgcacactagcacgtctgtgtacactcacgcacatgtgctcacacgcgcacatgtgaacacacgtgaatgcacgagcatgtgaacacgtgcacatgtgaacacacgtgaaggcacgaacatgtgaacgcacgagcatgtgaacacacacatgtgaatgcacgagcatgtgaacacatgcacacatatgaacacacgtgaaggcacgagcatgtaaacacacacatgtgaacacgtgaacgcatgcacatgtgaacacacacgcatgtgaacgcatgagcatgtgaacgcacacatgtggacgcacgagcacgtgtgcagtcttttgctctggcatctgcctctctctggaggcctggctacaaggcttcaagggaggtggcgagctccccatcagcagacagctcacacgcccctggctgcttgccctcccaggagctcatggaggccttgcacctgcacctggtgaaggagtacatcatccaactcagcaaggggcgcctggtcctcaagacggccgagcagcagcagcagctggctgggtacatcctggccaatgctgacaccatccagcacttctgcacccagcacgtaagccgctgcccacctctcccaagcccctctgaaatggctgcctcttctcccctagccctttcagggtcggagataggccgctggtgcctctctaagcccaacgagtcgctgacccgagcctctggacccctgggtccctccaaccacacccactcctgcagggctccccggcgacctggctgcagcctgctctccctacgctggccgagatcattcgcctgcaggaccccagtgccatcaagattgaggtggccacttatgccacctgctaccctgacttcaggtgagaacctggggcacctcaggaccactgtcacatcactgtggccaaggcctcacagggctggcattgggaacccagatcctggcagctgcccacgtgccagtcactgtgtgaacctcaccaggggctcattcttgtggccttcaccacagcactacgaggacaatacttcccattcccgtttcacagaggaggcctggagagctcacaggatgtgtccaaggtgacacggctagttagtgtctggctgcatggcccacactcttagctttacctgacactgcctctcacaggggagactgagaccagagaggccagcttcacccagcctggggggcctctgcggcctaggcctatgctctgggaccagggctcatattcgggagtggaggcttagcccttggctgcctgaagttctggtgggccagggacattgtttcttcctgggctgggtcctctgacatgttagggtaagtttgaatgggtcttgacagggttgaccccagcttcgccaagtccagtccctgtctgatccattccacccattcattcattcacccaccatacaagcacccatctgctcatccacccattccttcacccatctggctatccgtctatcttctcacccactcatcacctgtctacccatccacccacccacccacccacccgtctatccatccatctattcatccacctacccatgtaagcacccatccacccatctactcatccatccacccctccacccatttagctatccatccactcaaccactcacccacccacccatccacccatgcatctactcactcatccatgctcccatccctccacccatctagctctcatccatctgctcacccacccaccatccatctacctatgccaccaacaattatggagaagtctgctaggtgtcagcctctgttctagttaccaggatgcaatgaagtacaagggaagccaggtctcagtcctcccttaagtagctcattctgttgagggccagcaatactaatgacataatcaggcaaagaaacagacaattacaagttgtaaatagggtttaaccaaggttgtgaatgataggaggtgccgactttagagacaagaaagccttttgggggtggacatcttagcggagacctaaggggtgggaagaggcggtcatctcagggcctgggaagaacattgcaggggaacagccggtgcggaggcctgaagcaggctggggcatggctgctcttgggaccatcaggtggagggcatgggtgagggagagtgaagtgcagccccctcgtgggccgggcgttggctgtcgggccctgtggcactggccgggagtgcagggagctggtgagtaggggtgtgggtgacaggctgggctgacaggatgctctctttgccagcaaaggccacctgagcgctatcctggccatcaaggggaacctatccaacagtgaggtcaagcgcatccggagcatcttggacgtcagcatgggggcgcaggagccctcccggcccctattttcccttataaaggttggttagcttttcctgtggcctgacctgcctgtgagtgcccagcaagccttgggcacaccccgctgggagctgttaagagcagcgctggttctcggttcctcccgggtctcctgtgctctgatgctacttctgcctagccctggcggaggtgcaggccctgtcagctggaactggacagaccttggtttgtttacatgtccgatgggggcaggagctcccatcctgggcagccaaccaggcaacaccaaggactctttgtaaacgatagctgatcgtgtgcacgcaaggaaagaaccaggagggagagtgcagccaggctcagggatccccggacacctctgtccagagcccctccacagtcggcctcatgactgtcctcctcgtgggtggggccgagggccctcttcagctctctggagacaggggccgagcctcacccatctgccctctgcagcccagggccgccgtgagcgggattcagcaatggtggaatggaagacagaactggaagagaaagaaggaaaagatgagctctcgtctggcaggggcttttagggtcctgtggcgagctgtgagcaccgccagcattagacgtcacatccaggtggccccacggcccctacaggctggccctgcaatggggccctgagccctccctcttcatcccccaaggcctcaactagagggtggtcccccgagggcttggtgtctactaccgaagggcccaagacctcctgggtcctctcaggctcccccttccccaaggcagggacaggccctgggggtgccaccgtgggccctgccacccagaagtctggctgaggtctgggcaggggcagggcaagcttgacctctcactgttgaccctttggcctctgtatttgtttcctattgccgtgacaggtttccacaaacttcgtggatcaaaacgaggtcttccagttctgcgggtcagaaggctgacccggggctcaaatctgggtgtcggcagtcctgcactccttctggaggctctaggggagaattcatttctggccttttcatttttagaggctgaccgtaattcttgacttcaggctcctccatcttcagagccagctgtgggtagttgaatctttttcccgtcacctcattgaggcctcccctctcctgcctccctccaccacttttttttttttttttttgagacagggtcttgctgtgttgcccaggctggagtgcagtggcctggtcatggcatcaaggctcactgcagcctggacctcctggttcaagtgatcctcttgtctcagtcccctgagacaatcccccacgcccagctacatattttttgtggatacagggtctcattctgttgcctaggcttgtctggaactcctgggctcaagggatcttgtagccttagcctcctaaagtgctgggattataggcatgagtcactgtacccggcctgctctaccgcttttaaggacgcttatgatcacattgcgcctacccagagaacccaggtcgtctttctattttcaggtcagctgattagccaccttagttccatctgcaactttagttcccactggctgtgtaacctaacatagtcacaggctctggggactgtcacgtggacatctttgggaggccgttattctgcccaccgcaccctccgttcatcccctgccctgccgggcacctcgctctaccccaggaaaatgtgagctcgttttcctgctcggcatgtgctccccctaaggctctgctcctccctgggcctgaaagttccttctcagcctgagagggggcccttcggactcaggcatgactcagcccggctgatgcctctgcagtgctgagtcaggatttggggccggctctcttgggtccgtccccttttcccaggtactgccttacaaagctgtggccaggaagtggccggtataaaggatgcccaaggtctttgtacgtgtgtaggagttagcgtgtttgatattgttaatataataataattattttttagagtactgcttttgtatgtatgttgaacaggatccaggtttttatagcttgatataaaacagaattcaaaagtg

SEQ ID NO: 36184 - DNA, 254025 bp, Homo sapiens
gttggaaacggcactgctgagtgaggttgaggggtgtctcggtatgtgcgccttggatctggtgtaggcgaggtcacgcctctcttcagacagcccgagccttcccggcctggcgcgtttagttcggaactgcgggacgcgccggtgggctagggcaaggtaaaggcgggctcctccagggccaccccgggccacctgtggagtccgagtgttaactcctttgttctcagagccacttcagcggccgcccttttaagcgaagaggttcccttaggatgctccccgggtaccccttccgttcccctgccctcccccgacccgcctcccccttccaacccgaaggtagcagcgcggggagcccggggctcggcgcgagccgcctcctcacttcccattggctgagagcgccgggaaagcggtcacgtgggagcgcggcaggccagctcgggggccgccatcttggcggaaagtttcgggggagagcggttgggggcgcggaaggaggcgaggttccgggggtggggcgtgcggcagcaactgggcgagcgggccggggggccgcggcgagcgaggaggcggcgcggccgagaaggaggacgaggccgcgggggtgcggcggcccaggggagctcctcccccgtcccttcgccccctccgctcggctccgcgggccccgggcggggcgggggtacgtggagcggggccgggctggggagctgctccgagtctggccggggcgcaccccagttccgagcgcacgccgctcaccggaactttgtggcggcgccgcaggtgtgggggcccgcggaggtgtgcatgcggggcgcgagggcgtcgcggagagcggccgctgccctgtccggcccccgctggagcagcccggaggcagcgagcaaggagaaaggcaagcgagaggagggggcccgagcagggcgggcggccagtcccgctggtcccctctcagcgctctgcggccgctgctggctcaggggccaagggtcggagcgcttcacccgcccgtacccagtagcaggtggggagtgtggatacttgtgcgggggaagaggcggcctcaggtctaggctctttggggaggggacgctttcgaggagagtttggaagccgacttctgtctgttcttaatttggaggggtacccactccaaggaaaagctttccacgttgacagacaactgctgcgttttgagactctttctttgacttggtaaaactttggaacgtggggttttcaaataggctgcgagggttttctatttcgataggggaaaatgctagtttaacatgattctatcctttttcctttccgttgtgtgttttaaaggtgtgtgccctcttcctgattctggagaaaaatgccggtccggaagcaaggtgagagtttattccgtaactctgttgtcgatgtcacttgcttttccgtgtgtcagttttttgattgccgttttagaatcgtttgtgtaactttgatgagacagcacggtcctagctttattgcttagggaatctaagcctcatatcatttcagaagatggaaacacgaaaatgtttgttaaactttcttaacatttctctagtgattaagagaggcagttagcccccccccaacagatgtccttaataaccctgaattggtgttttagtatttcactctatcattcttactaagcactattctgtaagcaactgtgggatactaagaatttgtattttgaaatgttaaaaatttggattatgatgacaaattgtagataatctgcttttgcattatcaggtaatctgaaactgttgctaatactttgatcttttactttggcaaactaccagtacacatttattccaaactgctcactctcctccgttttctaatgtgatatatgtttaaatttttcttgtatttctttaatttttttttttattttttggtcattctaaggaatatgtgtacatgaacatagtgacatcaattgacctgaaggatttgcggaactatttagatgtcatgcagaattatttgcactagtatgtgatactttttttgtaaatagagagttttaatcaggctctgctttttcttctcagatacccagagagcattgcaccttttggaggaatatcgttcaaaactaagccaaactgaagacagacagctcagaagttccatagaacgggttattaacatatttcagagcaacctctttcaggctttaataggtgggaattaaaacttcgtaactattatgccagctaggctttatgctcctctcaattcatttattttaaacttaagaaaatgatgtacttaattctctgaggcattcggtaacttgaacatcttcagtgagttgtgtgtttttcataggccagtgtcctttcttaaaataactagtaaccaaaaaactttcaggattatttcagtggcttttgagaacattgtttcacatcttaatagcattaactattaaaagatgttgcacagatgtttaaggacctaaaaggtatgactgagttactgtgagcttgtttctgtatttgactggcatgtctctgaagtcattgaaagcgtgtgaagggttctgctgtgttgaagaacattcattcccttaatgtagatttctgtttgagcttggcattcatggagtcagaattttagacctggaaaataatcttagagatgatcttgtctagtaaccgtattttacaggcaagaaaatggaaagttttattcttaattgtaacttaatttgaagtggtgcattgtttgaaagaactggaaaaataagagtcctgagttcttttgccactaattgaatgatatatcccaagtcatttaatcttttctatgccaccatattagctgtagaatgtagctgttgaaatgacagaatgggtttaaagccttttttaagtagataaatcatttttaaaagcatcatctcatattttgtgtataatctcctatgtataaaacaaggtgacttgtctggctcttttgtccaggtacctcaaaaagtttgcaaaccaccgaactagaaagtttgtctcttccaattctaagaatgaagttttttttttttgttttagttatcaactatataacattttaacataagaagacatatacttaattatattacatttatttcttcagtaacttccagtcagatatggccttacatctatctgttgatagaataattgttggtgtgatttgaagactactttcaagtcagtgtgtcctgtcaggtacattattgataaatggatgctctctacggttttagaatgaaagatttttgtaaagaccacttgatgcacctgaacaattttgaaaaatgtaacattttaatagacttttaaaaacataaggatacatagcacagtgtaatgaactgccttttaactgttacccagctccagaaattcacattttgccatttttgtttacattgatggacattttttacacatttgaatttctgaggtttaaggtccgaatggatgatcaaattggattcctctggaaaaacagcaaaaagcattttttagttatttgttttctaaatcaacattgagcctagtaatttggtgcagttactgttgcaaaaaaagtatgttttttcgcaacagtatagagatatatatatacatatatgtatagataggcagatagatagactgcagacttttctttgtgtgatggctgtaacttaagaaaattaaatcgttagtgaaataacagaatctacatttatatttctgtctagattggggatgggtttgctgtgttcagagacatttttgacctattctgccttgcctgttttgaatgtgtctattcttacgtacaattgaactttgatagagttagctttcttctctttttttttttttttttttttgaggcagagtctcactctgtcacccaggctggagtgcagtggcgagatctccgctcactgcaagctccgcctgccaggttcacgccattctcctgcctcagcctcctgagtagctgggaccaaaggtgcccaccaccacgtccggctaattttttattttttgtattgtatttttagtaaagacggggtttcactgtgtaagccaggatggtctcgatctcctgacctcgtgatccacccacctcggcctcccaaaatgttgggattacaggcgtgagccaccgcgtctggcctagagttagcttcctaattactaagtttatatttgtgaatcttctaatttcattggttgtgaatttactttgacatttaaatttacttatatttaatgttctataggatgtggtactatatcacattttggtgtaagacaagtaatagattttaggagttttgaaatagataacgtttaatagaggttctgtgtgtttccatgctataattgttgatactacggaataaatacattctcttgtgtttcctgaataacttttaatacttagtctgaaaatgtttagtctgataagattttctttgtattttgcaactctaccattgttttgaaacagtgtcataaatgtactttaagcttgtaaactgccctaagctaaaccagttcattgtgtccatagtgtttgcagaaaaatccgactcagaagacagagtgccacttactgaaaggttttttctctcagtaagtggcactctgtcttctgagttggtacctgtggaccactggattaaaggagaacaggggtcttggccacctgagctgtttggagtcattgagtgcttagatttttcacttccttaatttggaaatcacttgtttaggccgcagtgagttatctagttatctgtttggggtgccaagtgtctttggattttcagtctgcattgatcatttattgattgattctttgaactggtagtttatattgacttttcatgcatttaaaaaagtttgagtctctaggggtttggtgtccccccctgtagttgatacatagattaggttcctgtacttttggattattcagagggacaagcatgtacgtactgtattatatttgttctaaaataccaactgttaaatatttcaatatctggtatatgtcatttttaattgacagtgtttctgtgttctgacacatgaaatagtgcattttataattgatactcgcaatgtaatatagaaatcattggtctagtgctgatagatacttggtagtatctttgaaggatggcttaaagatttaaaaattattgaaagcagaaaagtttttactaattttgaatttcagctgatgtattgtttctttagagctaaatatttaaagttgtatcttaacaaaagtccatgaactgcacatttgtttaaaatttactcccaaaacatacctggtgattatttttgtataaaggaagataaagtctgcttaatttcactctgtgatttaggtgagagcaatttgaaaacttgcttttgtattccagttttttgtgcttaagtttgaaaattttttgagtagacgggatatggtttgattataatcagagcccaggtattcaggtccatagtggtttcagttcattcatgattctaaggtgtgtgggatctgagatgacactgctagtccatagagacttcataccagtctaaacccctgcagttatttcttacgggatcagagaactcatctgctttccttgtgcatgagaaaaactggggcccaagattaggctggctttagagacttgagtaagttgagtcatgtgatttgtatattttgtctgcaataaataagcttattctaatgcagtgttttatttctgcagagatttcagaatgaaagtggattatgtaataatactgtccatttatgagtttagttaccagttcatttgttgccactctattaaaatctaatagtttcactagcccttataaaaggacattaccctatctttatttgtagatactagtttcaaaagtatgacccctttgccatcttcaccatctttaaatgtacagttcaggagtgtgaaatgtattcatattgttgtgaaacaaatcttcagaacactttcgtcttgcaaaactgaaatcctataccgaataaacaactgctcccctttcctctcacttcccagccccttgtgaccaacgtgctgctttctgtttcagtgaatttgatcatgttagaaacctcatagaagtatttgtctttttgcgactggcttatttcactcagtgtagagtccgcaaggttcattcatgttgtagttgttgacaggattttcttcctttttcaggctgaataatattccgttgtatgtatataccgcattttatctagccatccattgatggacagttgggttgcttcctcctcctggctgttgtgaataatgctgttaggaatgtgagtgtgcaaatatttcttcaagaccctgctttcagttcttttggatatttacccagaaataggattgtgggatcatacggcagttacatttttaattttttgagggcccaccataatgttttccatagtgattgcagcattttacagtctcaccagcagcacacaggatttccagtttctccacatccttgccgatacttaatttttttcctttctttttttgataatagccatcctaataagtgtgagtatatgactcctcttcaagtgtatgtaaaacataataaccaacatttattgagcactttctatgtgctaatacaaatatatcatttagtcattgtaatcctgtgaggtgtacattcacctgtatgaggtgtttgtactgttttatagactggaaaactgaagcactgagaaatgaccaatcttgcccttggaccctcagatgctaaattgcggagccagaaattgaactcaactaatctgaatccatagatacttctcaccgtcaaccattgggatattctttatcgttgtttttcagaactgagtattttaatctgataaagaatactaaatgacaagcatgcttaagacagatagcaatctttagggttagtaatctttaaatgattgtcactttgaaggaaaatatttataatggtgcattatgtttatgatgatggaaatcacacattttgaaaacagtgtttagtaatcagggtttgagatcttccagctatagtggtaaaatgtcaaaatttcttaaatttcttttgcattatattagtcccactgatgttacattttagtctcttgctaactgtgtgtgtgtgtgtgtgtgtgtgtgtgtgtgtgtgtgtgtaactttgtaggctagatttgagtaaggaaaacaggatatggatcacatcgttggctgaaacttcctgaaatggagaattttagtaacttctcacttgatggttttgattcaattagattgagttctttgctcatagtttgcttactactgctctgaagcagtgttttgattatgttgaatctggctgaattctctttagaaccttggaatcagagttgtaaaggcatctaaatatttcttctaagccatttcctctctgcagggtcatatttttcctcagtgcagaatccagacttggaccagatattaccgttagttgtcacgtctctttacttagggcacatttccacagcttttctttgtcttgtgtgagactgacttttttttttttttttttttttttactatttggagacagggtcttgctctgccacccaggctggagtgcagtggtggcttactgcaacctctgcttcccaggctcaagcaatcctcctgcctcaggctcctgagtagctgggactacaggtgtgagcccccacgcctggctaactttttctagagacaggtgttgcccaggctggtctcgaactcctgagcaaagttctgggattacaggtgtgagccactgcgcccagctgagattgatgattttgaaaaacgcagttccttccactcttacttttttttaatataattttctcattttgggtttgtctgatgtttccttgtgattagattcaggttttgtattcctggcttaggattctgtacatccagaggtacacagagtcatctgctctttgttgatgatactgattttgattacctagttgggtgttgtctgaattctgtatcctatagtcattgttttttaccccttgtggcttataggcaatatgtgggggagacactttaacaccatgtacatatcctactccttagcaaaatttccacccatatttagcatccattgatgattcttgaaccggtttataatatggttgttgaaaagtaagatttctaacagtaacactcctaggtttaccagttaacactttgcattttattctaaacaagagccttccttctttttttcccgtgtctttcatgaacttgcagatacctgtttttttttcaatgacttatcatttattaccatccttaatgacatttgtgctctgagtgatccagtgggggccctttcaagcttgtgtccttatgagatgccctcatcattttttggagcactttcttaatttttggcataacaagatgttccaggtttatcttgtacctctcctgccccagccctggaatcagccatttctctgagaagctctggttccttttagtacacaccttgttttatggaatatgcttgtgagtcatgtatgattcttagtctaatagtatctaaagtattcaagtgatttatttttgcctactagcttgacatctttcctttctttagtgtgtgaaacaatagtacaaacttttaaattttataggatattctttcttctaggggtcaaaaatgactttttaaatgaacattggtttagaagaaagagtatttgtgcttgagtagatttgactattgtggtattatcttagtatgtcatctgcccttcactgatgatgttaattttgattactcaattgggtattgtctgaataatcatacttgcttttagtaaatgaactgatagaatttttttcctctgaaatggtagggttatatttcagtgttcttcagctttctagttgcctttcctgtaaccctccaaaataaatttattataaaaatgatgcatgttctatataaaacatttgagatcagattattatatgtaaaataccataagaaaatattcacaccagaggttacctcctacttcatccatgggatgaatatcctggaatgttatttgtgtgtgtgtgtgtgtgtgtgtgtgtatgcgcgtgtatacacgccaccccccaccttcattttgcaaaacaaacttctaagtaaaacagttatttcccttgtgagaattgatacttaaaatcagcatgtaaggtgaaaaacctcatctagttaaaattatccctgaaaagccttcagaaatttaacactagctcttgttaattacagcacaattgttttttttcctctagtggaaaggaatgatttcttcacttgagccctagacgaagcaactggcttgtttgacttcttgtactaaaaacacgtaattatagaatcacactcagcacagtgagatatagcaagaagctcacattttgagaggcacatgaaaactcagactacctaaaggaagaatcttcttccttctcatttttttatttgtgacagtcacttattgggtagacagagttgcccttttttgcaggggagatatactgcagttgtatttgtataagtgtgaatagtatgatttctctgtactatacatattgtttttatcttctaaagtttatcgacaaatgtctttccatgtcagtagatttctaccattttatgtatgtatgtatgtatgtatgtatgtatttttttttttttttttttttttttgagacagtttcactcttgttgcccaggctggagtgcaatggcttgatctcagctcaccacaacctccgcctcctaggttcaagcgattctcctgcctcagcctcctgaatagctgggattacaggcatgtgccaccacgcctggctaattttgtatttttaatacagacagggtttcttcatgttggtcaggttggtctcgaactcctgacctcaggtgatccgcccgcctcagcctctcgaagtgctgggattacatgcatgaaccactgtgcctggccagattcgtaccattttaagtgactgtgtatatagattttttttttccttttcttttcttttttttttttttttttttgagacggagtcttgatctgtcaccaggctggagtgtagtggtgcaatctcggctcactgctacctctgcctcctgggttcaagtgattctcctgcctcagcctcctgagtagctgggattacaggcgtgcgccaccacgcctagctagtttttgcatttttagtagagacagggtttcaccatgttggccaggatggtctcgatctcttgacctcctgatctgcctgcttcaggctcccaaagtgctgggattacaggtgtgagccactgcacccggcctatatagattttctgtagtttttttaatggtttcctaggagcatttaggtttgtaatttttgtgaattataaatattgtatttgcatatgcatttttgtttcaattctttactatattcttaggacaaactcctagaaatgaattgtttggtcaaagggagtgtgcattttaaggctattgaggtaatttgttaaatactcttaggaatgttgtatttattttttaggaagtatgtggaagaatgaccaattcaccataccttaagcaatacagagtgttatccatcttttaaatattttctactctgatatatggaatatacctttagtcatttttctgttttattgtgcattttgttgattaaagaaatatccaaagctgtaagaaagtctttaattattttaatttcttttgtaaattatctgtttaatttgtgccccttcctcctcctttttcctttttcttagaggtataaaatctacattaggcctgtcaactctgccgtgtaaattgcaaataacttcccgtgttacttgcttttaaacttggcttttaaagaaaacatatatatatatggttgggtttatcaatatttttctttatcaatatactgctttctgcccttaatacgtttggaaacattcccaatgctctaagccccaacattattataatctattgccaagattgtaaaaacctgtattcaaattctttcaagactttaacattttaatgcatttgaaaattatcttgatataaagtatgagattgccttttaatataagtttatttatctctcatgcagtttaagaaattaatagatttttttcagcagttttgaatttacagaagaattgagtggaaagtacagttcccatatcccaaagccccacttcccttttccatcttgtaggccatgtgtggtggctcaacgcatgtaatcccaacattttgggaggccagggtgggaggatccttgagcccaggagtttgagaccagcctgggcaacatagtaagaccctgtcttaggaaaaaaaaaaatttaaccaggcatggtggcatgcacctgtcgtcccagctgcttgggagcctgaggtaggaggatttgttgagcccaggaggtgaaggcgctactgtactgcagcttgagtgacagagtgagactctgtctctttaaaaaaaaaaaaggcctgagctcaggtggctcttgtatataatcccagcacttgaggaggccaaggtggtggaattgctggagccagggagataacagctgcaatgagcatgatcataccattgcactccagcctgagtgaccctgtctcaaaaacaaaccttgcattagtgtggtatatttgttaaaattgataagccaatattaatatattgtcattagctaaagcccatactttacattagtagtcactctttgcattgtacattgacaaatctgatgtgcacattttttgctttgacacgtatccactattgccgtattgtacagcaggggtccccaactcccgtgccacagacctgtacctgagcggcaggcgagcgattgccacctgagctctgcctcccgtcaggtcagtagcggcgttacattctcacaggagcatgaaccctgtcgtgaactgcgcgtgcaagggatctagattgtgcactccttatgagagaatctaatgcctgatgatctgaggtggaacagtttcactgcagaagctcccccaccctcttttctgtggaaaaattgtcttccataaaaccggtctttggtgccaaaaaggttggagaccgctgttgtttttcaccaccctaaaaatcctgtgtgctcttcttcttctccggtaccccacttctacaccccccacacaaactcctgaaaaccactgatctttttactgtctccatagttttgccttttccagaatgtcataattggaatcataagtatgtaacctttttagattggcttttttcagttagtaatatatttacggttcctccatgccttttcatacctaatagctcgtatctttttatgactgaataatattccattgtgtggacatactacagtttatctactcacctgttaaagaacatattggttgcttcaaagttttatcagttagtataaagctactgtgagcgtttgtgtgcagggtcttgagttgacttaagttttcagcttgtttgggtgaataccaaggagcgcaattgctggagcatatatagtatgagtatgtatagtttttaagaaatgccaaaagtgccttccaaagtggttgtaccattttgcattcctgtcagcaatgtgttgccctgtgtcctcaccagcatttggtagtgttggtgctttggattttagccattttaataggtgtgtagtagtatcttgttttaatttgaaattccctggtgatatttgatatatgctcacttgccatctctgtctttggtgaagtgtctgtctgtatcttttgcctatttttttattggattgtcttcttattgttgagtcttaaagaattttttgtccacttgaatattagtcctttattgggtatgtgttttgccagtattttctccctgtctgtggcttatcttttcattctcttttccccatcaaataaaattattatcttctcatagattagaaatgtcaccggtattatgttaaattattacatactcttgggcctgtatttagattttctcccctgaccctaagttagtattgccttatttctttagtttgagaaatgtttcttggcttgtgggtttctctgtttaagattatgtaagttgtcaccaaaagctagaatgtttctttgcctatttgaaagttccctttctcccattcctcaccccctttgagagtatttctgggattctgcactttccctttactcccattgtttgcaaactttgaattctagcaagaaaataacaaaggtaatgaaaaatttttatgtaaaagaaaattatatatttgaaggcttctgaaatgtgtgatcttggagatttccagtttttttttttttttttttaatagataagaatgattctggcctcttctgttggacctaactgcttttcttcaagtttgatttttggaggtttcttagtgtacatgttagagctttgtgtggtcttgtttagatctgcgttcaggaatcggacttgtggaaacccagtttaggccaaaacagggaaagcacttgcagattatgaatggaaaatgaggaatagactgtgataagattgaccgagtaggtttcaacaaaattaatgttttcagttgtgagtcaaccaaaatctaattttttcctaatacatattttagtatttctgcattttcttgttttctcttcttgcttgctgtagtgtatcattattttcaaagaaaataatttttcgcagggtagtaaataaaaatgtaataggtgatttcaattctttggtatttggtaagctttctggatcttcagatgaatatagaatcacttgtagctattggcagtctcttgactacccctctgtgctcccattttctttacattttcatggtgaagatttaagtttagagttgtactcaagttaaatttttgcataggtttattgaaagactatcattttatactaggtagtaaatttggcaattcctgataaaatagtattgagagagatgacttttgaagcattattttgctatagttggattttgttttacatagtgtgatgtgtgtgtgtttgcgtgtatgcatagcacatatgtgtgtgtgcgtatgtgtgtatataatattcttaacaccctgtgaggtaggttaatattatcctcactgtacaagtgttagtttttaccagccctttacttggaaagttttgcaattccactggttattaaaactgaaagggggctgggtgcactggctcacacctgtaatcccagcactttgggagcctgaagcgggcagatcacctgaggtcaggagttcgagacctgcctggccaacatggtgaaaccctgtctctactaaaagtacaaaaattagccaggcatggtggcacgtgcctgaagtcccagctactcggaggctgagtcaggagaatcgcatgaacccaggaggtggaggttgccgtgagccaagatcataccactgcactccagcctgggcgacagagcgagactctgtctcaaaaaaaaaaaaaaaaaaaacaacccaactgaaaagggagttaagtttgtctctattttgtgaagtttgtttttaaaaggactaatgcttttaaaataatgagaagcaagaagtctaagttattctgtctaaatgttgcttacagttatgaattattctatacagggtaatgcccacttttactattcccttatccaaaattatacaagttggtgaataaggaattaagcgtggtgaatctaagcgttatataactgctacttacagcttcggaatagcgggaataattagtgttaataagtttttataattctagctgattgcaaagtcatttgatcttttaaattatcctgtgctattataaataaatttatcatttattttagagttttgtcatgactttaactgattgtttctaaagtagtataaaatatttaatttactattataaaatattcagactagaggatatccgaaagcccttctagttctttgattttaatttcctctttttttttggctttggctttggctagaagggcaattaaaaccacttgagggatttacattcccagcttagatattggtggtgaacggtaataactcctatctgtagaattcacagtaatgatattagctaccatctgttaggagcctattctgtgctatagtgctaggcatcttatatgtattatacttgagccttgaaacaattcacagtgctaagaggcaagttaccagaggttaagtagtttgcctgaacttgtagctagttggtgatggagttgggatttgaatcaagtgctgactttgaagtgtaaaaagcctatgaattttacactgtgccctgcaggttctgatatgattgtgatataatgaaataagataatattcactgtttaagtacattatacgatgggaattgatttactaatctagagtaaaaattgtgcttttgagttatgttgttatagcattgcataatttagttagaaaatataaatacttatgaatttttattttccttcttctagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagaggtgagataaaaaatgtgttctgaagctgttttttggtgatcaatttatttatgttactatgtttctttattttattaaaataatattttatacaagtggattttgttatggaagtataatttataatagaataaagagaatggggttaaaaatatttttgaaaagcaaagctcagattctctgttgcccctgttttaaaatgttatgaatgtttgaagtctgaaatacttgatttagactattaaaaaattctttgcatgatagacctcaacaaggcttcatctgtgtggtaattaaaatggaaatggtactttgaaaagatggttttgctctggtattctttcctagaaataggatatagttttgtggtctgggctgctaagttgtacccatttacctcaaggaatctcttctttattggcttgaaggatggcattcaaactcactagagactgaagagtaaacctgaacatcagcactggtttctacattttctgtaaagttatttctttgagtattcataactatcttagtaatatacttttttgtgtgtgttatactgttgcccagttggatatggtatagcagaggtatgaagcagtttgtaacaaagattctgcctaagaagcattagtcatttgaaagtggttatttgtctgaatttgaatctagtcctttctagttagtgtaagatggtgctgtgcctggaaaatgcgatgtttctgtttggtgaataataaatcagggaaaagtggtggtaggcctcaaccagatagcactttggtaaagaagttagatggcttctcagttttaagtaacagaactatagaattttagagcaggaagaatcggagcacatctgatcccttgtcttcatgttaaagatgaggaaactgagatccataatagaataacttgacccactttatttagctagtttgggcaattatacctttgaatttcaggactcttaacacccaactcacagttctctttattaatcctagaccttgtatgtttctttttgattagtgtaatgtttattgtgtatatccttattttctttacactttttttccatcactttttccaggataatttccatttccatactctttgggttaatacatcacttgcttttataatagtctgaggtctatttcaaatggatttttaaaatgtcttcagtcagtcactgctgtggtttgaatgtgtcccctccaaaattcaggtgttgccaatgtgaagataatgagaggtgggacctttaggaggtgattaggccatgaggactcctccatccttcatgggattaaggcccttataaaagagcctccacagcttgggcacggtggctcatgtttataatcccagcactttgggaggccaaggcgggtggattgcttgaggtcaggagtttgagaccagcctggccaacatggtgaaaccacgtctcacgtctaaaatacaaaaattagctgagcatggtgtcatgcacctgtaatcccagctaccagggaggctgaggcaggagaattgcttgaacctgggaggcggaggttgcagcgagctgagacggcatcactgcactccagtctgggcaacaagcgagactggcgataagcgagactccgtctcaaaaaaaaaaaaaaaaaagagcctccacaaaaagtttagcatgttagcttaactttttgctttctgccatgttgagatgtaacaagaaggcccttaccagatcagatacctggatcttggacttcccagcctccagaattgtgagaaattattttctgtttttcataaattacccagtctcaggtatgcagctgtagcaacacagaagggactaagacagttatttcacatttattgtcttagttctaggttagaaaattgcttatgtaaaaaacatgttaaactttaagagaattgaattgcttactagtattttttattgtccgatttatgatacccttgattataaagcctcgaattcttatactcgatttacttatttttataggcgattgtttaagtaatgtaaccattgaaagtgaatatttgacattattggtggaaatgtaaattattacagccattatggaaaacagtatgcaggtttctcaaaaaaactaaaaatagaactgcccaccagcaatcccattagtgggtatctgtccaagagaaaggatatcagaatatcaaagggatacctgcacccccatgtttattgcagcactattcacagtggccaagatatcaaatcaatctaaatatctatcaacaggtgaatggataaagtgtgatacacacacacacacacacacacacacacacaaaatggactactattcagccataaaaagaatgaaatcctgtcatttgcagcaacatggatggaactggaggtcattatgtgaaattaagccaggcacagaaagataaatatcacatgttctcatgtgggagctaaaaatgttgatctcatggaggtaaagagtagaatgatagttaccagagactgggaagggtgggagagggaaaagatgaagagaggatggttaatgagttcaaaaatagttagaaggaatacattctactgttcagtagcacagtagggtgactaccgttaacaacaatttattgtctatttcagaatggtttagaagatttgaaatgttcccaacacaaataaatgataaatgtttgaggtgatggatattctaaataccctgatttgaccattacacattgtatgcacgtaccaaatatcgcatgtaccctataaatacataccattatatatcaataataatatttttaactgtaagtattctttaagattggaaaagtggacagttttgtaagctgaaagtttttttccatatagatttcattcaggaagatcagtagtgcattgaatttcatcaaaaatggcattggtaacacttcaatttttataaaatgatgaggcactcatatctagaacgctatttgcagctctggtttctacacctcctgaaagatatattatgaacatggtaaaggcacctcaagggaataggagaaaaagaactttcatattgtgagcgtcagatcttattagtttggaaagtagatgagaagagaatatggtcacagagtgttgtttagcgcatggcacatggaaaatgctgtagtaatgtttgaaatctgttcatattcatgaatagactctaaggggaacattgggatatgtccatcaaggcctagatgtttaaaaagtagcaaaaacctgtatatatcaaactggagtgagcaaagtcagttagtaggaagtaccatcttatagagatgacagaaaatcctgacaaatgtttgtctgaaaatgtaaatagttttgaaacacactgatggatgatatttataatgattttttaaaaaacctggaatgtttggggatttaattgctactttttgaaggtgctatgagagaaagtaagcatgttccctttcacccatccattcatgcttcatttggaaaacttggctaagtgatcatttgatctcttgtttcatttgctactttagactcttggggcatgatgtttaggactaaaaagggacttagagaatccacttgctcaaaacaaataacttaaaacttaaagtttattgtactataacttgaaaaatttgaaaatcaaaaccattttgtcttaaacagaatttaggttatacttgtgtactaattcttggatatagtaatcttttccaacaaaattgcatgcaacatgcctctttgacttcatgtttgcttttgcaggactaaaaagaggattatttttgctaaaagtagttaagattgctcaattttcacaaagccttgactgttattctcttaaaatgcaaatcttcatctttaaagcagctatccagttttgtcttttttttttttaagttcactgatctaattcttgccaggtcatttgtcagttactttgtgaccttataactttgtttgttctatttcttctgatgtagtaaatttaaagggacaggattagtatcccattttcttaaaaaaattttttttgtatatattatcttttactttgagcatatgtctagtgagatgtttggaataatgtttgtttagtgtttaatgattgtttcagagtgatagggatttttttcttttttgtactactttttttgtttttttagaaactgtgtctcactctgtcacccaggctgaagtgcagtggtgcgatcatagctcactgtatcctcaaaacttgggggctccagggatcatcctgcctcagcctactgagtagctgggcctacatgtgtgcaccaccacacccagctaaaatcatttctttttttttttttttttttttttttttttgggacagagtcttgctctcccaccgaggctagagtgcaatggtacgatctcgtctcactgcaacctccacctcccaggttcaggtgattcttccacctcagcctcccgagtagctgggattacagcacccaccatcatacacggctaatttttgtatttttgtagagatggggtttcaccatgttggccaggctggtctcaaactcttgacctcaggtgatccacctgccttggcctcccaaagtgctgggattacaggcttcagccaccatgcccgaccccaaaaccatttctttaaacagttttttgaagactgggtctcactatgttgcctaggctagtctcagactcctggtggtggtctccagcagtcctcccacctcagcctccagagtagctgggattacaggtgtaaggtaccacacccggctctctctcttaattttaaaaaataacacatcatttttataagaacaactctattctaaaataagagtgagttagttttagagattataagaaaggatatagacttaaaaaaaagcaagagtaaagagtaggaggaattgcctgatttaatgggatatttcagtagaaaagggttgatttataaggaaggatagatgactcttaaaaagatgaggccaggcctggtggttcacacctgtaatcctagcacttttggaggcccaggcaggtgaatcacctgaggtcaggagttcaagaccagcctgagcaacatggcaaaaccccgcctctactaaaaatacaaaaattagccaggtgtggtggtgcgtgcctgtggttccagctgcttgggaggcagagacgtgagaatcgcatgaacctaggaagcggaggttgccaaagaacccaggaaggcaagatcgtaccactgcactccagcctgggtgacagggtgagactccctctggaaaaaaaggcaagatgaaagagtaggaggaatttcctgatttaatgggacatttcagtagaaaaggatgcaccctactcctaacatcacaatacatttcaactagactagagattcaaaggttaaaaaaaaaaaaaccataaaagtaagattttggggctgggcgcagtggctcatgcctgtaattccagcactttgggaggccaagctgggcagatcgcttaagctcagaagttcgaaaccagcctgggaaacatggtgaaactccatctctacaaaaaatgcaaaaattagctgggtgtagtggctccctcctgtggtcccagctactcaggaggctgaggtgggaagatcgcttgagtcctggaggtcaaggctggagtgagccaagatcgtaccaccgcactccagcctgggcgacagagcgagaccctgtctccaaacaagaaaaaaaaagttaaaaattaaaaaaaataaaaattttgatttttaataaggaaggcttttctaaccatgaccaaaaaacaccacaaaaattaaaaggttaaaaatgctgctgactttatagaatttctttgtggactttgacttcaaattttgattgtagaacttctgaatcttgaaagatataatacaaagataaattatatattaggatgaaaatttgtcacatatatgaaaaaggattaattttaatttccagtcctttcaacttaagaaacttcttatagaaactaagaaaaaggcccgtgttcaataggaaactgacttaacagtgtgagtattgtagtttgaagaagaagaaataaatgtgggccaataagcctatgaagaaatgctcagccacacttaaaaatgcaaattacattgacagcaaggatatttttaacaaatttgattgtcagagattaaataaataggaggaaacagaagctcctgtacagttagtaagggagaatacagtagtgcaactaatttgaaagacaactttatattcgtatcgtttgatccagcatatgctccagattcaccacagattattgaaggtatttgtacagggatgctcactgcagccttaattagtagaaaccaacaagggatataaaagattatcggtaagagatcggataaacacattatggtagagccatttaatgcaagataaagtagcaggcaaaatatattctgtgtatccattatgtgttattaaatgagtgaaagcaggttacatgtcaggaggcatagtatgactgtgtgtgaaaagaaaaccatgaggttaggcatgtctggaagaatatacacatagtctgctttcaatagtactcttttaaaattgataaataattatacatatttatatggtgcttgtggtattttgatacatgcataccatgtttaatgatcaaatcagggtaattgggatatccatcatctcaagcatttatcatttctttgtgttgagaatattccagattttctcttctagctattttgaaatatacaataaattgttgttacctatagtcacctactgtgctattgaacacttctaattgtatttttgtacccattaaccaacttgtcttcctcccctccttcactgtacccttctcagcctctgataaactaccattctactctccaactccatgggatcagctttttagcttccacatatgagtgacaacatgtgatatttgcctttctttgtctggcttatttctcataagatatccttcaggctcatccatgatgctgcagatgacaggacttcatgctgtgttatggctaaataatattctattgtctatatatgctacattttatttatctattcgtctgttgagggacacttaggctaattccctatcgtggcagtggtgaatagtggtgcgataaacatgggcatgtagatctctctttgatatactggtttgttttcttttgggtgtatacctcgcagtgagagtgctggattaaatggtggttgagaaatgaccatgctgttttccgtaatagctgtactaatttatattcccatcagcagtgtaccagagtgtccctttctttacatccgtagccagaatctgttatttatggtctttttgataatagccatattaagtggggtaagagaatatcttttttcttttttttttttttgagacagagtcttgctctgtcgcccaggctggggtgcagtggcgtgatctttgctcactgcaagctccacctcccaggtccaagcaattcttctgcctcagccacctgagtagctgggactacaagtgtgctctgccatgcccggctaattttttaaatatttttagtagacacagggtttcactatgctggctgagctggtcttgaagtcctgacctcgtgatctgcctgcctcggcctcccatgtgctgggattacaggcgtgagccaccgtgcccagcttattatggttttgatttccatttccctgagtattattagtaatgttgaacattttttcatataccaattaaccatttgtatgtcttctgagaaatgtctaatctgatcatttgtgcatttcaaaatcagatacttgcttttttgttgctccttatatattctggttattaatacttgtcagataaattgcagatattttctcccattctgtaagttgtttcatcactctgttggtcgtttcctttgctgtacaggatctttttagctcgatgttatctcatttacctatttttgcttttgttgcctgtgcttttgaagcattacctaaaaaatacttgccctgaccaacatcctgaagcatttccccaatgttttcgtatcgtatcgtgtcgtgtcgtgtcgtgtcgtattgtatcttttcaggtcttagatttaagtctttaatctattttgatttgttttttgttacgttttcatattgtgagtaatgggagtctagattcattctacatatggatatccagattttcccagcaccatttatcgaagagactgtccttttcccattgtgtgtttttggcttctttttcaaaaatgagttggcttaaatgtgtggatttatttctgtgttctctgttgtgttccgttggtctgtgtgtgtttttacatcagtaccatgctcacttggtgactgtagctttgtagtaggtcaggtaatgtgatgcctccagttttattatttctgctcaggattgttctgggtattcggagtgttttatgattgtatatgaattttaggcttgttttttctatttctatgaagaatgtcactggtattttattagggattgcattgaatctgtatattgctttggttagtatggacattttaacaatattagtttttccaatctatgaacatgggatatctttccattttttttgtgtcctcttcactttgtcttagcagtgttctagagttttcattgttgagatcttttactactttggttaaatttattcctaggtttgttttggttttttttttttttttggtagctattataaatgtgattgtattcctgatttcttttttggattgtttggtgttggtctatagaaatactactgatttttttatgttaatttttgcatacagctttttaaaagttgtgcctgttatttacaagtcccccctttcagcccttcagtgtttatcttattgggaggggagttttctgactgaatggtgttaagggatacttttccctttctctttgaccttgtggtttaatattttaaaataagccatctgctttaatttgagtggagttttaggaggcagtagagttaaaagtatatattcagccgggtgcggtggctcacgcctgtaatcccagcactttgggaggcagaggcgggcagatcacttgaggtcaggagttcgaaaccagcctggccaacatggtgaaaccccatctctgctaaaaatacaaaaattagccggttgttgtggcgggcacctgtaatcccagctacttgggaggctgaggcaggaggcctgggaagcagaggttgcagtgagccgagatcacatcactgtcttccagcctggctggcagagcaagacactgtctcaaaaaaaaataaaaataaaaataaagaaaaaaatatatatatatacacacacatacacacacacacacacacacacatatattcagtgtaccaggtttaatctgaagtcctctaaacattgacaaaaaatttactgaaatactgtataatattcttacataaagatacacaaataataaaggaataggttgattaattactgcattgtgaatataccaggtcaagaaaaagaacatggaatgactgctaacaggttctggaattagatagtgatggtagttgtacaagtctatgaaaatatcaaaaatcactgaattgtacactttaaaatttggtgaattttatagcatgtccattttatctcagtttaaaaaagaaaaataccagtaccccagaagtcttccttgtactctccctatttactacctatcccctcttcctcagaggaccatccaaatttccaacatcatagattagttttgcgttcttttaaattgcatataaagagacttacacagtgtatatacccccttgtgtgcttcttttttcttatatttgtgcatttcatctatgtaggtaaagttttttcatccttactgttgtatgatattccattgtatgatataccagaatatatttacacattctgccattgatggtcatgtggattgtttccagttttgattagtgttgcattgaacattcttttacattcaggtctgctgtaacaacagataactttcctaaaaatcaccacactatgaaaaatggcacaatgaaaaccacaggtgttatttcaaaaatgagggcagggaccaaacacttaaaactttgtgagtgacatattaaaagagattaaaacctaataaaaacaacagcacagttttatgcttttttttttcttttttttttccttagaggaggtcttgctttgttcttcaggctagtgtgaggtggtgtgatcatagctgactgcacccttgaactaacgggctcaagctatcctctgcctcagcctcccaagtagctgagtttataggcgtgagccactgtgcccagtttatgcatgttaagtggtgaataaatatgtgaatactacaatcaatttggcatcttaccttggaaaaaaactcagctttgcttataggagtgtgttgcaaagagttgcagcttgtgagttactgtgatgtgttagctgggggagctatctgaaattggatgagaacttatagtagcaccagttgtagaggagtgtggatcataaaactcccataaactaaagtcgctggtagatgtctgaggtgtgtgcattttgtgtattcttaggtggctcgtatcctctgggtacagttttttgccttcacctagtctttctcacagacaagattgtgcttgcttttcctgtatgtgtgtattttttggaactatttgaaaatcagtcgtagacatcatgcacttaaactattaaaacttcagcacgcatctcgtaagagtaagaatagttagatattcttctgtgttatcttagtaccattaccacatctgagaaaattagcaataattgttcagttttctctccaatctctattcaaaattgtccccagtctattttgtgggacttgaaaaaaatcagataaagcagataaatcaaatacataccatttatgcatttgattgttaggtgtcagtacacatgccatttatgcatttgattgttaggtgtctgtttttaactgggttttcctaaaagcagaacctgaggcagagggcttaggtgctattaatttatttagagagttcattcctagagagcagaagtgagggaaagtgtgaagatagtataggaaggggaaaaactaatacaaggatgcttcctgccactaagtgtgactgatttttgtatccttggtattgcatccctgagaagccatttgtactgcatgttaggactctgcaaggaaagagaaagaatttatctactggcttctagtgggcagcagttcccccatactttagggttgtggatttgtcagtgtaggtgatttatcaggaaagccccaagtgagggggtgagaggaggagatgtggactgggggccacaggcatgaagtgttcctggggctgctcaggatgaaaggtaggtgtgaagatctgggggtgactgttggaatgggttgggaatacacataccaaatctggtacagtgtctctagtcttttgtaatctgatagaatagtcttccttatcttcttttccccccctttaaatgacattacctttttgaagagaccatgccagttgttttatagactatcacacattctttatttgtctcatttgtttccttatgttatttaactcattccactaatccttgtatttctggtaagaggaagttaggtgtaaaggttgatgagactcgtttttggtaagcagacctcacagtgatacacagtgttgtatttcatattgcatcatcaggaggctcacaatatcaggttgttgctcttgtggtgctgagttggattgcgtaaaggtggggacctccagatcttccacgggaaaggtacgtttttcttgttgatattgtgaagtgtgtatggggttgtactttggcaccttgtagtgagtcagtttccccccattggtgatcattgccaaatcactacatttgaggtttcaaaatgttatttttctccctaatttaatcattctgtttgtagttattagttggcattcttctataacactctttttcttcatcaactagggatgaacttctgttccttctaaaaagacaggctaaagtttacattactttcttttaatgatcagttatttgagtagcttgtgtgataatcccctccagaggttgctaagttccccctttttcttgatctctctctttacaaagttatcactgtataccgagaaatttttatttactaaatgtttacatacatttaagtttgggtgctcatattacttcatatttgactagacgaatcacttgaaggagtatctgtgttttcttaggatatgctttactagtctttgagcatgtccttgccttccaacaattttcccaagtttattttgagttttcactgctcctgaactagaatccacgcataacgatggtttccatttttctattcctaggggttgctttttctttgaggtgttatttttgagaggtaagaaagtggacaggcaggtgacacattcttccaactttagccttttgccccagaactggtaaaataaaatttgagaaatatcgcgtgagaagaaagcacatattgtattcattttaaaatattaatgcaaaatattgtattaatagtttacaatattaatattttaaaatgaatacaatatgctttgtcttcctttcttaaactcacgtgttccacaggaacggattaaaataataaccttatttttcaaatagcatagttttaaaaggcacatcacatacattgtaataatttgggatgttagaggagcatgaattcattcttgctatagcctcctaacatacacgaggtgagccagattttggttcttaatacgtggagcttatactgtgtttactttagaattgatcaaactgtcattcagggatattggtactgcccaacgttgcagtattaacctatagaaaaactgattagaattcagaacttcaggcttcaagactgatgtttccatttttgtttagtaactttcttggcaattggacttgttacctagacaaaggaaaatactgcaataaagttaaaataaggagagaaagaactaattttaatagagatagaaatgtaacaggcaacgtttatttttttaaaaaagctatagaaatacagtaatatgtggtatgatgatgttttggccagccacagaccatgttaagtagggatcccttaaggttataatcaagctgagaaatttatatctcctagtgacatctttgctgtcataacattgtagcatgacgtatatcaagtgtttgtggtgatgctggtgtaaataaacctgttctgccagtcataaaagcatagcacgtataattaggtacagtacataatacttgataaatattaacaattatgttactagtttatctactgtacttttagtagttattttatagagtgcacttctacttattttagaaaaaagtaaagtgtaaaacggcctcaggcaggcccttcaggaggtattccagaagaagacattgttttcgtaggtggcgatagctccatgcatgctattgcctctgaagacctttcagtggtactgtccagtgatactgatgattctggccttgggtaggcttaagttaacgggtgtgtgtgtgtttgtttttaacagtatttaaaagtgtgtgtttgtatttaaacagtaaaaaaaaaaattaaaaaatagaaaaaagcttatagaatcagaatataaagaaagaaaaaattttgtacctctatacagtgtatttgtgttttaagctaaatgttaaggtgaaagagtcaaaaagttaaaaaatttaatttataaagtaaaaaggttacagtaagccaaggttaatttattactgaagaaagaaaaacatttttctataaatttagtatagatcagcctgggcagcatagggagaccccatccctacaaaaaaaaaaaattaggcgtggttggtgccttcatgcctgtagtcccagctacgtgggaggatgaggtgggagaattgcttgagcccaggaggtcaaggctgcagtgagctgtgatcagtccactgcattccagcctgggcgacggatcaagaccctgtctccaaaaaaagaaatgttataagagaagtggaacaactgtcatattatgccaaaaaaaaagctgttaatctaggagaaaactcagcaaaactttacacagttactgagaaaatgaaaggctatgtgaaagcttaagtatgtcacattggttagacttatgtgttcctagaagacacccccaattagttttgaattatgagttttgattatgtgacattttcagtaactcatcatttaaataatcttgattgctctatatctgtatctgtgcttattactatttttagtattagagcagtgatatctcatgtgctcctaaacctcctcacctctcctgttttttggatttccaaagtgatacatgtttattgcaaaatttcctaactttatatgttttcaattatgtgaaagtcatatcagagaataaatactaacagctctgttatgctcttaatccttttttcttttagaatcccactgtcctttttcattatggaatatctataacctctttctctgtcttgggcctctgttcccctctttattttatcctgtaaatatgttcaaagattccattagaaaaacagacaaacagaaaaaagtacttctcagtaggacccaaagtaataataaacatataggattagctgaacaaatacataccaaatggttaaaagaggttatctcgggaaaagaatataaaaaaagacttcagcattatgcatctgtctttgtaagtatgtttaaggtgtgcctgaattacctgtgtagttagataattttttttaaggtaaataaaggaaaaaagagaacagttactgtggagaaggagggtcagaatctgggttacagaatattgggaatgggaagaaaaaaaggcaaactacgttttcaagaagcttagctaagaagagaaggaatgctatagggtcctactaagaagtgctttctccccctgtctttctcctaatggcctctgtgaacatattatatttacaagataaagtgaagaagggaacagaggcccaagatggaaaaagagattatagacattgtatgaagggagagtgagattccaaaagagaaaaggatccaagggcaaaacagaagctgttcgcatatgttatctgattttttggtggcatttgctactctctactctgcttttgaaaattttttatcttcttggcaactatttgacctgttggttttccttcattttgtgttattttttaaaaaaatattttaatcatggagaaactgtagtgaatattataaatatccatgtatttactactaccttaagaagataacatagtgtaagtatagctgaagtctcttgtgttttccactgtaatcacgttctcctgccttgttccccagaattaacctctgtcttgaatttggtgcttgtcactcacatgtactgtttatagttacagttttctttacctttcttgtgcctgggattcattgagtttcttggatctgtgggtttatagtttttacctactttagacgtttttcaccaattatttctgcaaatattttttctcttccttcccctttgctttcagggattccagtacttgtatattggtttggttgactttgtctgcagttcactgatatgattaatcttttttcagtctttttcgttggtatgttaaattttagacaattgctgttgctatgtcttcaagttcattaatcttctcaagtatctagtatactattaatctcagtcagttttttatttcagacagtttacctctagaagcttgatttagtttctcttctcttctcctctccctctccttctttttggagacagggtcttgctgcgtcgcccaggctgcagtgcagtgatgtggtcatggcccactgcatcctcagcctcctggcttcaagcagtcctgctgcctcagcctccccaagtacctggggctacacatgtataccaccaggctgggcaatttttttttttaattttttggcagagatggggtcttgctggattgcccaggttggtctcgatagtttcgtttttatttttgtctaattaacacactctatccttctctgtcttcataaacataagggacagagttaaagtaacttttaaaatgtttttgtctactgattctattatgtgtcatttctgggtcagtttttattgattgattttttttctcttctctggatcgtgtttccttgcttctttacatgcttgataatttggatgaatttggcagacgttgtgaattttaccttttgggggcctagatatttttttattcttttaaatattcttgagctttgttttgggatgtagttaaatgacttggaaagagtttgatgccattcagactgcttttttgtttgtttttgagacggagtcttgccccgttgcccaggctggagtgccgtggcatgatctcggctcactgcaacctccgcttcctgggttcaagtgattctcctacctcagcctcctgagtagctgggattacaggcatgtgccaccacgcctggctaatttttgtatttttggtagagacggggtttcaccatgttggtcaggctggtcttgagttcctgacctcgtgatccactctccttggcctcccagagtgctgggattacaggtgtgagccaccgcgcctggctgcttttaagctttttcagtgggactgagcaacatttggttgtagaaggctatccccactgcccagtatattatgagttttcattattcttggccttgcgtgagctctgggttttgttccatttgctgctttctaagattttttcctcaccttgaagtttccttacatgcatgtactgatcaaaactaatctgaagactcgaggggaactctgcagatctctggagctttttctgtcccgctctctcctttctggtactcttacctgtgagttttagctctgtttattctcaacgctttctcctcaacttaaggctgctgggtttcgttgagtttcccccttctgctacagccaggaaactttttctgggcatttacaggactcacctcattagtttctcttctcacagggtccagtgtctgaaagtcagtctttttttttattccattatggttggcagcaattgcttgtttatggaaagccattggtattctaaaatactgttaattatcttatgtgcctattaggtgaagtgttgccatcccaaaaggcttatatttcaagtccttctaaagtagctcatattacagggtgatttctaaattacttttaacagcaaatgaccatctgaagagaacacataggcttgaaatgtaccttactcagtgccagttgggtacttacagatacttacagaagatgcagttagtgtagaatttaacacaaattgaataatcattccctgagtacagccttaaaacctgtaagtattagatctatgcaagcttttttgaaggattattaggtatattaaaaaataatatagtaaggggttagttacatcatgaaggttataaatacacgcctacagtacaggggaaagtggcttcctcttctgtgaatgagcactacaagttgagtgttccttatccaaaatacttgggaccagaagcgttttggattttggatttatttggattttgatatttgcattatacttgttggttgaatatccctgatctgaaaattcaaaatctggaacgtggctaggcacagtggctcacccttgtaatcccagcactttgggaggccgaggcaggtggatcgcctgaggtcaggagtttgagaccagcctggccaacatgtcaaaaccccgtctctactaaagatacaaaaattagctgggcgtggtggcaggcatctgtaatcccagctactcgggaggctgaggcaggagaatcatcgcttgaacctgggaggcaaaggttgcagtaagttgagattgtgccattggactccagcctgggtaacaagagtgaaactccatctcaaaaaacaaaagataacaaaatctgaaatgctccaacgagtattgtctttgagtgttatgctggcacttaaaagattttggattttggagcatttggattgtggatttttggattagggatacccaatctgtagtagtaattagggataaatggtcaagtgacgttgtagttcagaaagggccatatctcaaacaacttaaaccgtataaaactgatgtttgaggtcacagagattagatcattaaaaagtggttgtggttatgatgaccctagacatcggagatgaatgtgaggagtttaactaaaatttgttctttgaaatgtgactggaataatatattagacatactattttaatgtgttgttaagtaattatatgttaactgattaatttggatatttgactatttcatcttattcttacaggtttgtaattgagttggcaaacttctatttttactgggaaaatggaatgtctaattttcaggattgtttcaggctgttttcaattttgtaatcacctatagtttaaatattagaaaggccactcattaattcagcaaacattgtggtcaccctgctatcccccaagatgatggggataaagtggtaggtatttgagacatttcttttcttttttttctttttcttttgagatggagtcccactttgtcgcccagcctggagtgcagtggtgagatctcggctcactgcagtgtccacctcctgtgttcaagtgattctcccacctcagcctcccgagtagctgggattacaggcatgcgccaccacgcctggctaatttttgtatttgtagtagagatgggatttcaccatgttggccaggctggtctcgaactccggacctcaagtgattctcccaccttggcctcccaaagtgctgggattacaggtgtgagctaccatgcccagcctcatgagacattcttgagtcttgtcctgttggaccttagaatccaacggatttaaaaactgaaacataggcatggtataaattcaaggactcttaggagtcattgagtttttttattttacaaaagaggaagttgagaccctcctcccacccccccgaagaaaatgactgcttaagttacacaggctgaatgatatttctaacttgccgtagtgattttcagccttttctattatgaagtctgccaaacttagggatgcctgccctctctgggctagactactctagatgtgataaaaatttcacaagagaaacttcagaatactaagagagcaaccaggtaaagggttttacatacctccttatttttcttcgcaaaatgcaatgcctagtcagtacttagatatcacttccattgttttcagtattctgcttaaaaatgataaactttatttagggagttatgagccttgagccttatatgagctttactctttcatgttgggagcaaatgataattgcaggggtggggtggggaaaagggagtactcaacagagcatgtaatttccaggctatatcctgcatgggataagggatgtgttggcccatgatgacatttacatagctacatacatatgtatttaggtctgagaggagaaaaaccattttttccctctgctctcaacacagcacacttctgtgctgactagatgtgtgaggaggtttttggtgaagcttttccagtggacacctactgggtgtcctataattcaattctgacactatctgcttggaggtagtagtagtctctacgtaaatacagttctggcagtgtctacttggagatagtagtagtctctgaagtatagtgtcagatcccacaggttgggggctcagccccacaagactgcccccatttagatggaaatagtagattgtgacctatgcttctgactgactagttttaaattggggttcacacaaccccttccttgggtttggttaatttgctaggatggcttacagaactcagggaaatgcgtttactagtttattataaaagatgttataaaggatacagatgaacagccagaaaaagagatacatagggcaaggtctggaagggtcccaagtgcaggagcttctatcctggtagagttggagtcctcagccttcccagcttgcctttgccaacccaaaagcacatcacatgttgttaagagtttttatagagcttgatctccagcccccaacccctgcccctttcctggaggttggtgggtggagctgaaagttccagccctctaaccctctaatcctctaatcccgtggtctttctggtgatgagcctcatcctgaggctttctaggggtctcactttaagttacctcattagcattagctgtgatccaaagggcttgtcatgaacaaaagaagaccttcccattacttaggaatttccaagagttttaggcactctgacagaaacaaagaccgaatatatttcatattataccacaatagatctatagctgtagctggcatttactgagcactgttgcactatttattgccactattgacctaacaagtcagcattattctaagtgccctgtgtatattatttaatcctcacacaacagccccattagataaagtaaggtaaagtcccattgggcctgtctcaagtataccctgttaggctttaaataaaaggctgtaatttgatacatactaataatagtaataacaacattgataatgcttactatttgataggttctaccaaatggtatctatgtattaactccttttcataacgcttaacagtgaaatgtggtttagtctgaaagttgttagtgcagtccatgtgtatttgaaatgttaggaggaggaatggggtataagaggcaagtaggaacagttcagttgtttgaacttgaggtcattcataatatctgtaaactgtgaggaaactttgtggacaaaaattgcagataatactcttccttattatgcattaaaaatttgttagaaaatttcttggattttaaaggtttttacagacaggatctcaccctgttgcccaggctggagtgcagtgctgcaattacagctcactgcatcctcaaactcctgggctcaagccattgtccagtttcagcctcccaagtagctaggactacaggcgcaggccaccacatgtagctaacttcactatggcatttgtataggggagtgtggctggaagcttatgatactgaaagccagttgcatatccctctgccatgtcccctgtgtctgttagcctatctagctccagtcctaatgatcttggagacaggacatgaattcacaaagttagttgacttaaaaacaaagacttcttgaggagtttgaaaggttacatagttgtaactatctttttgtggtggttttttttggtgtgtgggggatcagtgaaatggatttagtaaggcagtaaagttaaaatttgcctttgttggtaaaatgttatttattcacttttttagcaaagaaaaaaaggcaagttttagagataatattttaaattattgtattttgtttttcctgctccccttctcaaaaaaccacatggaatattccattcattactgctcgagaaagtcattactttgcaggctgcagttgctgaaatggtttagtggaagaaatgtttgcttgcatatttttagtgattttttttttttttttttttttttttttttttttggtggttgtcatttgagtatccaaactgtagctaacgaggagaagcagatttaaatttatatcgggggaacctctttgtggagcatttcatcagatgacttcctgtcaacctcatatcttgaaaagagggattaatgaaacagcatctgaagaagcagtggactcttgtggaataaaccctgacatcttccacagtgttttgtgggataatttcaagttcttcagatacagattacataaagaagattgtagggcacgtgacagactctggtttcttgtattttagatagtagaaaaattgctacctctaagaatggatcctggagagatctagttacagttataacttcttcatttatggttttatctcacagctttatttatttttatttacatgttttgttcaactaggcaacttaaaatagttttgctttatgtataaaatattgtaatggtagagtaatggattgcctgtgcattgtaaccacaaaggtaagatataatatgcttttctgtatttcattgttagtgacagatgtgagagaccctttgttcagtgtcttttaaaaataaggtgtaaccattgttatagatttgaaaatagatgtgtgaatccatgtgatgcttagtttatatcctttagaaagggcggtattttgaaatgtgttttagatagccaaaagcgtgttgcacagatgttttttccctgagatttacaggaagcctttctcccagcagcaagggtctgtaaagtcctgattatatttaaatcttctcagtgtattctcagagctactcttctcccctttgtgtcccaacatgccatgctagttgaaagtataactcgttttgagagcattttctggactcttccatctattataattatagttaattttttgtttttttaggaagaggaaaatagtcaagtgctgattgtgttgcctttagaaagatgttgatgtggatttaaaatgattagacttgtacaagcactccttgaaagtacttgttttgaagtctgttttgctcattgtgttcaaagtgcagcatgcttcacttaatctctaagtttggcttcttttatttttgagcaccagtttgcagacattgtgtgatggtgttatagattcagcgtgcttacatttaaaattcatccattggtttttaaaatatggaataatttacctttttttatttctatgcacttacgatgtctcatagtgattgctagacaaacttgttgagattttaaaattacattcagtaataaaagagtaggtaaatttgtaaattctgaaagtagaggctattactctttctgtataatgaattatttttcataagaggaaaagcaggaaaattgatggaaattagttttcttttcttgttgctcagagttctagttcaaacagtagtttctgatcggatacagacatgcccattatctgtttccattccctgtttataaggagatgtcttctctgtacctctaggtaaactgtcttgttgaaatattcttactgaatgtttaaagggcacataatcctggaaaacagggtcgttgttgctttttccctctctaaatttttttcatggttgtctatgttggttctcccctgtgatttgccttttatcatttcattcattttggttttatttccagtattatagcaaggttatttgaaatgatctatctcctctctctgctccatcttccttgatagactttgaatttttttacattgactcttttagcaaaagagggtctattttgcttaaaaaattagatgtaatcattatcctaaagtatttataaatttttattatataactgttaaagcaaaaatagagaaggatgtaggttggaaattagaagcctaaaacattgtttgtagttgcttttgaaaaaactaaattaaaataatttgttctattattagaaataaaccctttgaacatatttaaccaatggctctagcaggaagagcaaaattcttgattttcttttgaactaaaggctgcggtgtgtaccccatcccttgttcttttctcccttttctggtcttagagagctttgtgattctatatgtgttttaaaagtctgacagtgtagttgatgtaattttatcatgttaatactaaaacacctttccaagtgaaatttttttcatcatccgcctcccctctctcccacttgtgtaggcacggtgaactaggtaggcacgttgcatcattgctaccatggatacccttaagtacaggcatgtgggttgagctaaagcaatgatgattagttttttggttgttcccccccgcccccccataactatatgttcttcacaatgaagaatctgactttaaaacgtttgcaaatgacaaggttgtgagatgtgatgactaaaccatcactgctactgaactgccaaatcttggtctccatttacagtagtattaatgccatttactaatttaaggctgtcataaatagctctgtattccttttctgattaatatgttttaaatccaagtgtaatgtttgttttgttttgccttttagtgaaaatgaaaatgtacttctcttcgagttaaaaaaaatactcttctggatttagatattttgtgggacaaaaagatgctagtgagcatttctagcatggcagcgtttctgattattgttcatacacttatatacatttttatgtactttaatcagcttggttacagtattttgtgcttttccacataatgtctaagagagatttatttttgtgtttgtaagttcttgtgttcttagctagctgctttgcaaacatgtccgttgaggtggagttaatattgttagaggccaggcagtgaagtgtcatttttgtcaggctcgtaatcactgtaggaaaattaactcagagcataaaaggcccaacaagagtgatttaggattattgttatatatggtatattttcttatgttagcaataaagcactctgcttaaaccgcagctgagggcatttcgtgttctttagcatggaggtttcccagctgtcaagtaacttctgagagtaactttagtaccagaatttcttgtaataggatcatgtctttctttaagttcaggtgtttcattaaggcaagctggagataggaataaaaggattatgaaagagaaggagcttgaaagatgcttttacccatacctgtttctgctttgtcagcctctttttgctgcctttattttagattttagagtgatgctttgccttgtcttctgaaacagttccctgaatctcctacttgccaaaagttcatgattcttttggtgattctttatatgggtaaagaaaatgtatgcccgtgtgtggggatgtttgtcattccagtgggtgcccagcaaatttgttttaacataactgatagaattttaggaattaagtcaccagagaactgttgaattgttttggtttatcagtttgggaattatgaatacaaaatttgactcctttgggtaaaacagctatcttttatttaaatattcatatttatattagggtactttcacttgtaggttgtattaaaattgtatgttagaagctttgaaaggggtattaaatatgttaaaagaaagtctcagtacaggtatttcagattttttagattttttttaaaagacttcaaattttttaagttaggttttaatagtgaatagaaatgctgccctctactgttggctgattgtttgactgccacgtaaaaatgttcagtaacctgtaatagaattttttagtgtagatcatattactgtgttgaagtataattatgttaaacgttttccttataatttagttaagttataatcaagtgtttcctaataatgctaactactattaaataagttcattaccattttggcttttagaaaaacttgagtcctggagaaagtttcgtttagtcttagctcctcattttatatggtgaggttttagtacttcctagattgatcccttatggttgtgtgactgaaagctcgtattgataacttataaccaaactataggtaaagatacatttttctaaactaattatttttagtttatgctatgtaaaatgtctgaacttctgaaacttatgttttacatgtaaaaaaatttggaatttaaatcactattaaatctttgcatgtttattaaaatgaggcactgctttaaaaagtagtactgttgagcaaatttaaacctctgattgatgtttttcaccgtgagtggagggattagaagagacggttttaaagattccttttagcttcgctgagtgcctactgtgtgtgaagtactgtagaaaataaacacggaaaacaaaggctattatagttcttcctttagatcaggagttggcagactatggccagtgggccaaattgggccacactcactcatttacttaccttgtatggctgctttagtgctacagtggcagaattgggtagttgcagcagtgagcatatggcctgcaaagctgaaaatacttactctctagacttttacagacaatgtttgctaacccctgccccagatgaacttctcatctagtgcagaagatatatctaaaaagaatcattttaaacagatttttataggacacatagaatgccaaataaagctagcatgtcattaaaatatgctttctttattagcgccattcttcctgttcagtagtatcttaacatcatctaataattcccaaagattcttgtttattggccatttgcagatatcgtacctcacagcctggttattttcatcatcatcattattttttctgtgtgaactgcacaaatctaagtacgcagcttgatgcctttttataactgcaatcactatccatagaaagacacaaaacatttccagtactccagaaagactcccattagctctttccaagacagcccaccctccccagagataatcttttttttttttttaactcatatcactatagattaggtttgaacgtcatataaatggaatcatgcagtatatatgattaattatggcttcttttactcagtatctgtgttactgtgcgtgctggtagcttgttcctttttattgctgtgtaatattccatggtgggaatttgaattgtttctactttttggttgttatgaagaaagctgtgtaaaacattttatacaagtccttttgtgtacatatccactaatttctctcaaatatatacctgggaggtaggatttttaattcacattgtagagcccttaccacaaagtttttgtttaataggacaaagcaggaggcaggaatcaatgacacactttcacttactttataagttcacctagtcccctgcttcattacaaagtggtgactttacattttttcataagcactgtgattaaggcaacctacgttttgactaaatcaaacaggttttatttccaatgccacctcttattggtgttggtgtctagaggtctttgctaagaattctgataacaagttgaaagtgctgtgattgtctagtagtctttgctgtgttgagggattagagatgtgtgggggaggcatgtgacagaagaatgggatcatttttatttaatatatttgaaaaattcttacatattgaatatagtgcatttaaaattacctcattgcttgaacaggtcatagatttttttttttgagacagaatctcgctcttgtcacccaggctggaatgcagtagcgtgatctcggctcactgcaacctccaccttccaggttcaagtgattctcctgcctcatcctcctgagtagctaggattacaagcacgtgccaccacgcccggctaatttttttttctttgtatttttagtaaacgtggggtttcaccacattggccaggctgtcttgaactcctgacctcaggaggtgatccaccaacctctcaaggtgctgggattacaggcatgagccaccacgctcagcctttgaataggtcatagatttcttaatttcatttattgtatttttaacttttagaatgtctgtttgctctttttagagtttctatttctcttaaatttgatattgcatctaatttgtacatcttttcctgtgtatttaaaaattgccattttaaagttcttttctgctataatagttctaacatctgtggttctgctgtgtgggttttcttttgattgttttcctcttatgttatcctacttctttacatgtcttaaattttttattgtgctctaaataacgtataaaagaaccattgaaagcgaagcagtgttctttccttttcaggaagctgcagtgaggctgataaaataggagttgaatttgtttagggttaggttgctgctttagttactttcacctggcttctgttttcagctgtcatgagggtgggagatgagttttgtgtctttcattggttctttccactagcatgactttagggtgtatgaactgtgagactgcagaaatgtttcatggctttatagccccattctcagcctgctacactgctgtaccctcagtaaatgccccatgaaggcgatctaatgtgtggggacaaataactctccattttaggatcctccagattctaactggtcatgccagcccacgtcattaaaggctccactccttataccatcaaagtcactcaatctgtatcaggtccattcctttgcccacctgagtctaggcttgtcagatacactgtttaggtaagtgtctgccttcttacaaaaggcttctttctttggggtttagattctttccttcgtgtgcagaaatttccatttcctttttttttttaattaaacctttaattttgggttaattgtagatacatgtatgtttgtaaaaaaataataataatgcagaaatcacatgtgcctttaacccagtttcctctagtagtaactctagcatagtatcactaaccaggatattgacgttaatagagtcaaactacagaacatttctgtcaccacaaagatcactcgaggcctttttgtagccacacctactttcctctcaccccatccccttcttaactcaaagcaaccactgatctgttctctatttccattattttgtcatttcagcaattctatatgaatggaataataaatatataaactttcaggattggcttttttcactgagcataattttcaagagattgccggggagtgaaattgatgggtcatatgatagttgcatgtttgcttgtttttttaaagaaactgctaaaccgctttccagagtagctgtatgattttacatttccaacagcaatgtgtgaatgatcgagtttttccacatccttgccagcatttggtgttgcctcattttattttagtcattgtcatcgatgtgtagccacatttccctgatggcaaatgattttggacatcttttcatgtgcttatttgccatctgtgtatcttttttggtgaaatgtctcttcatggtcttttgcccatattcgaattgggtggttctttttactactgagttttgagaattctttatgtaatctattatagtgtactagtccttagtcagatatatcatttccagatattttctcccagtatgtggcttgtcttttcatcctttctttaaggatctttcgtggaacaaaaccttttaattttgatgaagtccaatttatcaagttaggtgacaaatctcataactctttgcctaaccctaggttttgaaaattttctcctgtttctcctgttttttcagattaagttcataatccattttgggttagtattttttttattgtggtaaaatatacataacatacaatttattatggtaaccatttttatgagactgacatgctgcccactgcgcaaagaggacgattattctaaccattttaaagtgtatagtaaaatggtattaaatacattcatgagatgcagccactaccactattcatctatagactctgttctaatcttgtaaaactgaaacgaggacaattatcctaaccattttaagtttacagttaagtggtattaaatacatttgtgaaatgcagccgttaccactatccatctacagactcttttcatcttgcaaagctgaagttccatagtcatcagacataactcctcattccctcatcagacaataactcctcattccctcagccatcattctactttgtttctctgattttaactaccgtaagtaccacataaaagtatagtcagatggtatttgtcttcttgtgactggcttggttcactcagcatcatgtcctcaagtttcagccatgttatagtatatgtcaaaatttcctacccttttaaagctgaataatattctattatatgtctataccacatttttcgtatccattatttcgttaatggatactttgtttccatattttagctattgtgaataatattgctatgaaaacagtataatctctttgagacactgcttttaaaatccaaagtaaaagcagtaaaagaagaggtttataaagtagaaaaagaaatgggtagaagcatctttaaatctcctccctttcatattccttttattcctacctccagcttgtctcgatgatagacctgtacttaaaccatccaccacctctcataaggagagacaactagcacactagtcataaaaagcaaggaacaagaactataaaagagggaaaagagaaagaatgattcagaaaagactgttctgtacagccaggaacctacatattttactgtttcataaaaattatcaaaaagatcttctaacaattagtgaatcttaccatgtactgggcattgtttcccacactcgacaggtctattgagaaatgtctgttcagatcatttgcccattttaaatgtgcccattttaaaatatgattatttgtttttttgctattaagttgtttaagctcttaatatatcctggttattaatcccttgtcagacgggtagtttggaaatattttctcccattctgtgagttttctcttcactttgttgattgtgtttttttgctgtgcagaagctttttagcttgatgtaatctcatttgtcttttttagctttggttgcctgtggttttgaggtcttaacctcaaaaaatcattcattcattcattcttatgcatatggatatccagtgttcccagcatcatttattaaagagactgtcctttccccattatatgttcttggcatctttgttgaagatgagttggctataaatgcatgaatttatacctggattcttttttcttttctgtgtgtctgtttttattccagtaccgtgcttatttggttactgtagctttgtagtaaatttgaagtcaagtagcgtgatgcctccagctttgttctttgccttgaccatttggggtcttttgtggttccatataatttttagggttttttttctatttctttttctgtgaagaatgtcattggtaatttgataggcattgcctagagtctgtattttatttatttgtttttttgtttgtttttgtagagactgggtttcaccatgttgtccaggctgtagtcaagcagtccacccacctcggcctcccaaatgctggggttacaggcatgagccaccgtgcctgtccctgaatctgtagattactttgtttagtattgttatttttacagtattcctccacttcatgagcatggaatagctttccattttgggggtcctattcaatttccttttttttttttttttttttgatggagtcttgctctgttgcccaggctggagtgcagtggcatgatcttggctcactgcaacctttacctcccaggttctcttcacagcctcctgagtagttgggattacaggcacctgccactgcgcctggctaatgtttgtatttttggtagagacagggtttcactatgttgtccaggctggtcttgatctcctgacttcaagtgatctgccacctcagcctcccaaagtgctggaatgacacgtgtgagttcattttctttagttagtgttttatagttttcctgtatagatctttaacttctttggttcaattgattcccatacactttatattctttgtagctattataaatgtgattgctttttaaatttctttcttctctttttctttttctttttttttttttgagacggagtctcactctgtcgccagggctggagtgcagtggcatgatctcggctcactgcaacctctgtcttgcaggttcaactgattcccctgcctcagcctcctgagtagctgggattacaggtgcccaccatgacgcccagctaattttttgtatttttagtagacctggggtttcacaatgttggccaggctggtctcgaactcctgacctcgtgattcacctgcctcggcctcccaaagtgctgggattacaggcatgagccgccgtgcccggtgctttttaaatttcttttcagattgttcactgttggtatatataatgctattgatttttcatgttgattttggatcctgcagctttactaagcatatgtatcagttcttacagttttttttggtgaagtctttaggtttttctaggtatgagatcatgccatctgtaaacaaggctaatttgacttcttccttttcaattttggtgccctttatttctttgttttacttcactgcttttccagtactatatgaaataaaagcggtgaaagtaggcatttttgtcttggtccagaccttagaggaaagaccttcaatttttccccattcagtatgatgttagctgtgggtttattatatatggcccttttaattttgagctatgtttcatctgtaacagtttgttaccggtttttatcacaaaggtatattgaattttatcaagtgcttttttggcatctattgaaataatcatggtttttgttttcggttctgttaatgtgatgtatcatgtttattggtttgtgtatgtcacaccatccttgcattcctgaggtgaatcccacttgattatgatgcgtgatccttttaatatgtggttgaatctggtttgctaatattttgttgaagattttgcatctaatttcataatcagtggtattggcctgtagttttctttttttgttttatccgtgtctggttttggaatcacagtgatgctggccttgtagaatgaattccaaaacattcgattttttttttaaagagtttgagtagaactggtagaatttattaggaagccattaggtcctgggcttttctttggtgggagacttaattttttgttttatttttaaaaattttaatatttagtggaatgggagactttattatggcttcaatctcattacttgttatcagcttattgaggttttctttcttcatggttcaatcttgaaagtcatgtatccaagtatttatccatttcttctagtttttaaatttgttggcatatagttgttcataatagtctgtaatgatttttttgtatttctgtggtctcagttatgttttctttttcatttctgattttatttatttgagtcatcttttttttagcctagctaaaaggtagttgattttgttttgttgatcatctgtattttgttttattctcaattttatttattactgctatgatgtttattatttcttttcttctaccaattttagatttggtttgttcttgcttttctggttccttcaggtgcattatttctttgaagtctttctcatttttttattttttgagacatagtcttgctctgtagcctaggccagagtgcagtggagtgatcatacctcactcttgtcttgaactcctgtgcacaagtgttaggaacagtttctcttcaaacaaagggtttcaccctccttgtcttttgttctagtatataagtaatctttcttgcctttaacacacccaggcatgcctccgtccaccaagcttgtagccgacccacgctgccttactttaagttgttaggtacaaaaaataaacttcctggttctttgtcctattctaaatgctaaatctagtcagtcgggatcagtttagattgtgtggtcctaccccagataacaaggggaggacacagaaacaggaatggcgttaggaataaaaacccctgctttcctttgttcagtgtgctcttgtgattgtaactgatgcaggcagcacccttctgaaatttgccttgctgagaagtcttttgtttgagtgctcattttctttgtgactttgagctcttctaacaaatttgggggctcatctgggatcccattctcctctggggaaaggtctccaagcatctctcattaggagacgtgtcccactgcctcattgtggtggcctcaggggtaagagattgagacccacctggcatgacgaataaacccgggaagaaaagtcctacaagtagataccgcagcaaccaagtaactctgcacagaccaaggttagaaaagccgtgggggcagtgaagtatttccttggtggtcgagatcaaagtaagaaaagccagggggcggtgaagtatatcttggtcagaacataccaaggtaagaaaagccgcaggggtggtaaagtattcctagtggtcaggttatcttggaggttgaaagtgcatgaatgagattcaggcacattaagtgtagagtgagtaagtccaatctgcggttccgtggtcacctcatatggcttctgatggcggccctcctataaaggagtcaaagtcaaaggcttatactgaacctgccagtgctaagagggacctaaagtccctctggggaagtggccatagagggtgaagcgaaacaagaagagtgcaagggacctccagtaagtggggttaagcctctagggagagggaaggcaagaaacctctaatatgaaggattgagcctaacaccaaacctccaggatggggactatcccaagtaagacaagaaacagaaagtataaggctaataacattccccttaatagtcccttaggtctcatgttaaaataatactggaaagataatgagaggactaaacataagagaaagcaacagatgataaaatattgttgtttcatttggaccaaagaacccatccttgagccctcagttttctggccaaagtttaggtcaaatgaggattcaaatttgtcaacttttaataaagtatgtcaatgacaagagtcccgtttcccaggagaaaatagattatgccctgtgttggcagcagggacctgtcctcctttaccccctaaaggtatagggggcaagccagaaaccagctcctctgaaaggagtaaggtctctacccctgaacagcccactaacatctggacccactagaccacctgtatctgccaaatcccccgccccaagtgggtgcacaggaatctcctcactcagttcctcccccatgtaatcctgaatcaatgttctctggcctccctaaccacacgcctgagtctatgtctccccccaggaaggctccagcgtgagataaaacagtgcaacaaagatattcagaacttccctttcccctccacctctaagcaatcaactccaactctctttcccttaagggaagtgccccttggagaaggaagcatcggctttgttaatggtcccttaactagctcagaagtccaaagtttaaaagaggaactcagatcattattaaataacccctatgggactgcagatcaaattgatcaattcttagggccacagctgtatacttgggctgagtgaatgtccatcctgggcatcctcttttcaggggaagaaagaagcatgatccatagggccgctataatagtctgggaatgtgaacatccatccaaaacattcctgcagcagaccaaatatttccagcccaagaccctcaatgggatggtaacaatacagctcacccaagaaaagcctgaccctcttctgtggacttctgatgaaatccactaggttgagcagctaaaacacctacccatcgctattcctgtcttagcgctgccatccctagaaaaatcatttcaccttttcattaacgcaaacaagagggtgactttcagggtgcttactcaagaacatgggggtcaccaacaacctgtggccttcctatcaaaagtttaaacccagtaacctgtgggtggcccaaatttattcagtctattacagctactgccttaactgaagaaagcaggaagctaacctttgggggaaacttgatggtgagcacaccccttcaggttaggacaatcttaaatcaaaaggtaggaagatggcccaccaactcaagaattttaaagtgtgaagctcccttactaaagagagatgacttaacactaaccactgacagttcactcaacacaccaggtttcctgacagggaacccaaacctaaaagggcctaagtgtaagtgcttaaatttagttaattatcgcacagaggtcaggcctgatttaagggacccctttcaaaacaagacaacagctattcatagatggctcctcccaggtaattgaaggaaaaaaacataatgggtattcagtggtcgatggggaagctgtcgcagaagtcgagtcagaaagactgcccaataatcggtccgctcaaacatgtgaattgtttgcaataaatcaagccttagaacatttacaaaatcaagaaggaactatttatactaattccaagtatgccttcagggtagcccatacctttagaaaaatttggactaaacgaagtctcatcagtagcaagggccaagaccttgtccacagttaattaatcacccaggtactggataaccttcatttgccacctcccccccccccaaaaaaaaaaaagtattgtccatgtcccaggacatcaaaaaaaatctcttttaaaagacgagggaataacctcgcagaccaaagagccaaacaaactgctttttcctctgaaacatgcattttccaccaactcattgtctttctcccccaactgccattcccatcttcactcccgctgaaaaggagaaattaataaaaataggagccaaagaaaactcagaaggtaaatgggtgttaccagaccaaagagaaatgctaaccaaatctctcatgagggaggttttgtctcagctacatcaagaaacccactggggacctcaggctatgtgtgatgcagttcttaaagtctatggatgtataggaatttatactctagcaaaacaagttacagataattgtctaatatgtaagaaaactaataaaccctaagaaaaccaccccttggaggaagaaacccaagattaaggccactccgaagtatccaaattgattataccaaaatacccccaacaggccgcctaaagtatctactggtgatagtagatcaccttactcactgggtaaatgcaatttctttttcaagtgcaaccaccaacaatgtagttaagacactcatagaaaatgttatacccaagtttggattaatagaaaacattgattcagataatggaatccatttcactgcacatgacaatataaagctagcccagatattagaaataaagtgggaataccataccccctggcacccaccttcatcagaaagagtagaaagaatgaaccaaaccctaaaaagccatctaaccaaattagttttaaaaactcgattatcatggaccaagtgccttcctattgccttattaaaggtccgaactgtccctcagaaagaagttggcttatctccttgtgaaatgctgtataggctgccttactcacacttcactgttgacattcctacgtttgaaactaaaagtcagtttctcaagagctatgtacttggtctctcttccactttctcttccctcaaagctaaaggctttttagtacagatgccacccttggagttcccagcacatcagcatcagcctggggatgatgttctcatcagaagctggaaagaaggaaaactcaaaccagcttgggaaggaccctatctcgtgcttctaaccaccaagactgcagtccaaacaacaacaaaaaaatgcagacccatcataccccagtcaaaaaagcatcgccatcttcaaagtcatgcgctattgttccgagaccaattcctaccaagctaaagataaaaaaaaaaaagcttaaccctcttatagtgcctttttttctttcccctctctactgtcagacaattatcctttcctcacccagtaacaaaaccaaagtggccgtcgtagaggtaaaagatctaaaacaaacctaatcattgaaacagggtaccgagatgcaaatgcctggctgaaatggattaaatattctgtctgcactctaaacaaaaatgattgctatgcttgtgcgcacagcaggccaaaggcccagattgtcccctttccactcgaatggtcctccagtctaccaggcatgaactgtatggtagttcccttccaacacctcacatcctggggtaataagttatgccaagctccctctctgctattccctcaagtccagcaccctgcgggtcagcccccaagggccatcaagcttccatttccccatgccagttttacctcatgtctctcacaacacggggaaaacttggcatttcttggagacctaaagggatgcagtgagcttaagcccttccaggagcttactaatcagtctccccttattcatccccaagcaaatgtaggatggtattgtggtggactattactggatactctgccaagtaactggagcggcacttgcactctgatccaattggatatccctttcactctggcatttcatcaaccagaaaagataaaacatcgtaaaacaagagatgtccctcgtgggtcctttgactctcatgtttatatagacgccgttggagtcccacgaggggtacgaaatgaatttaaagcccgaaatcagataactgcagggtctgagtccatgttattctggtggtcaacaattaataaaaatgtagattggataaattatatctactataaccaacaacgatttgtcagttatactaggaatgccattaaaagaatagctcaacaattagggcctactagccaaatggtctgggaaaataggatggcgctaggtatgatattagcaaaaaaaaaagaggtggagtctgtgtcatgataggaacccagtgttgtaccttcatccctattagttgaaagacttattacaacagcccttactgaaactttcctgatttcttttccaccctagtttaacaaacttttacttctagacagtgaggaacagcaaagtcaggtcatgttaggtaagtttgaagaagaaagtgtgtaaattcaagaggggaaaattgttaggaacaaacagtttctcttcaaagggtttcaccccccttttcctttgttctattacataagtagtttttcctgcctttaacaggcccaggcatgcctccatccaccaaccttgtagctgacccatgccgccttactcgaagttgttaggttcaaacaatgaatttcctggttctttttccttttctaaatgctaaatctagtcagtcggaatcagtttagattgtgtggtcctaccctaattaactgggggaggacacagaaacaggaacggcattgggaataaaaacccctgctttcctttgtttggtgtgctcttgcgatcgtaactaacgcaggcagcacccttctgaaatttgccttgctgagaagtcttttgtttgagtgctcattttctttgcaactctgagctcttatttctaacacaaggcatcctcttgcctaattcttcaagcagctgggactacaggcatgtccagactgcaggatcttgaactcctggtctcaagcaatcctgctgtgacctcccaaagtgctgagattacaggcatgaatcatcatgcccagcctatttctacttttttgatgcaggtgtttattgccataaacctgcttaatactgcttttgctgtattccatagctttggtatgttgtgtttccattttcatttgtttcaagtttttaagtttccttctgaatttcttcattgttcaggagcatgttgtctaatttccatacgtttttgaagttcttgaggttctttttattgatatgtatttttattctttttgtggtcagaaaagatatttgatatgatttctatttttttttttatttgttcagactcatggcctatgataatggtccattctggagcatgttttatgtgctgataaaaagaatgtgtattctccagcagttgggtggaatgttctgtaaatgtcagttaggcctattaggtctagtttgtagtttaactccagtgtttctttgtttattttctgtctgggttatctgtccatttctgagagtagggtattaaagtctcctactattattgtattgcagtctatccccttggatgtattaatttttttatatatacttgggagctctgatgggtgaatatttataattgttatatcctcttgctgaattgactgactcctttatcatcatatagtgaccttctttgtcttttttttacagtctttgatttgtagtccactttatctgatagaagcatagttgctcctgagcttttttggtttccagttgcatgaaatatcttttccctcccttttaatgtatgtgtatcttaataggtgaagtgggtttcttgtagacagcatggaattgggtcttgtttctttctttgccttttaattggagaactgagtgcatttaccttcagtagtattattgataagtaaagactactgccattttgttgcttgttttctgattgtttcgtaactcttcctttcttgtggttaagagattttctctggtggtatgttttaatgtgttgctttttatttttagtgaatttgttataggtttttgcatcgtggttaccatgaggtttacaaaaaaataacaaattatcttaaagagttgacaacttatcttagatcacaaaagaatagaaacaaaggaaaatttgaaagaacttccacaatttaacttcatccctccctctaagaattcattagaggcttttaattgtctcagtttatctatttttatattatctgccacttaacaggttgttgtaactgttactgtttttgatagatttatcttttgggctttatataatactagagtcgtgagtggattgcataccacaattacaatagtaaagtattttgggttttttgtgtatacataattttaccagtgggttttacaccttcaaatgtttttttagtttgttttatttttcatggtagtgtttttttcttccagattgagtaattccttttagcattttttttgtaatatgagtcttgtggtggtgaattctcttagcttttgtttgtgtgggagtctttatctccccttcatatgtgaagggtaattttgctggacaaggatattcctggatggtagttttggtttttttctttgagcacattaaaaatgttcctgtcccttcctggcctgtatggtttccgttgagaagtctgttgtcatacaaggtagagcttctttatatgttatttgtttcttttctattgctgcttttaggatcctctctttgtctttgacttttcaaatttgattattatatgcctttgggtaatcttatttgggtcaaatgtgttttctgaccttcctgtactaggatatttacatttttctcaagttgtggaaagttttctattatttctttgaataagctttctacctcatgcttttgctcaactttctttgaacactaataattcttacattttttttttgaggtaattttctatatcttataggcaatctttgttgcttttcattcttttttctcctatgtgtgttttcatagcctgtctctgagcctaatgattgtttactctgcttgatcctctcttatgtcaagagcctctaatgaatcagttcagcaagtgtatttctcagttccaagatttctgtttgatttttttcttttcttttcttttggtgttatgacttggataattttaaaaaattactttaatctctttttaaaatttcctgataaatttctgaattgcatttctgtgttatcttggagatcactgagttttcttaaaaatactactttgaatattggtcagagagctcatagatcactatctcattagtgtcagttattggttccttgctttgtccatttggggagatcatgggtacctgttttctgttgtttgttgtggctgttttattcagccttctctgtctggcttgttttggtttttactggatgtatttgcttagaagttctttactgttaggttgctgcctcctttttagctctctctagttaccttaagcccaggttcacctaggttctagtaaagaaccagagcactgttcttcccgaatgagggagattccaaaggggatgtcccagtagtgtgggaatgctggctaggagttcctgcccaggggacctgtacaataaaccttctacagatggtgttgatgaacatctaatgaacatctactctgattcagtgtcttgcttggctgagttacagtagaatttccagagctggagatggtagtcttgcctcccttttttgtttctgcctatccgcagggatatttttcccttctggcatttgagatgcatcctgtgggctaagataagggacagtctcctgccagagaacattagatgatggggaagcatgagttatatctcagtctcactttttccagtgtagaaacagtgagttgtgggaaaattttttgcccattaggtgctggccagaatgaggggagggacatcatggatgtggaagtccaattctttcaccatctgctagaattcttttttttttttttaacttttctgtggcccctgaactgtcgcatcttcatatgagttctgggatattcctggtaataacatcggctctgtatatttgtttttggttttctgtgagaggagtgaagccagcttgcttctgtgctgacattttggaactggaaatcctcttgattaatttttgtatgttgatttattctatattccaggaataaatcccaatcccactgggtcatggtgtgtaatccttttaatatgctgtcaatctgatttgctagtattttattgaggatttttgtatcactgttcatgaaggatattggtctgtagttttcttttctagtactatctttggccttggtatttggtagcgctggcttaatgaaatgagtttaggagtgagtagtccctcctccttaattttttggaaaagtttgagaaggattggcattaatttttctttaaatggttggcagaattcaccagtgaagccttcaggtccaggacttttctttgttgaaagatttttgattacttattcagtgtctctgctaattatagatctatttagattttctctttcttcatggtttagtcttgataggttttgtgtttctaggagttttccatttcatttaggttatctagtttgttggcatttacttgctctatataggactctgttatcctatttatttctctagaattgattgaaatgttctcactttcatttctgattttagtaatttgagtcttctttctctcttaattccatatagttaaaggtttgtgtttttgtttatttaaagaaacaacttttggtttcattaagttttttcttctgtttctctgttctctattttgtgtatctctgccctcatctttattatttttttcctcctgctaaccttgtgtttcgtttgttcttgttttactagttccttaagttttagactaggttcttgatttgagatctttcttgttttgtaatgtaagcatttagagctatacatttactccttagcactgctttcactttataccataaattttgttatgttgtgtttttgtgttcattcatatgtaaatatcttctaatttcctttttgatttcttctttgattcattgcttgtgtaagagtgtgtttaatttccacaaattggtgaattttccagttttccttctattactgatttctgacttcatccagttgtagctggagatgatagttcatgtgctatatctatcttttcaaatggattgacattctgtatggtgtctcacagatcccttaggctgtattcacttttcacttaaatctttttcctctgttgttcacattgagtctttagtgttattgtattttcagttctgtcatttccatatagttctttgtgtcttgtatttctttgcttagactttctatttctttgctgtgagtttttattatttcatttgtttcatgtatatttgtaattgttcattaattttttatatgacgcctactttaaactctgttaggtaagtctaacatctgtggtgtcttgatgttggcatctcctgattgtctttttatattcagtttgagatattcctggttctcagtgattttcaagggaaacttcgacattttttgtattatgagacgctagatcttatttaaaccctgtgttttggctcattttctctgacgctgctctgacagtgaaaggtggggcactgcttccttactgcttagtggaggtaaaagtcaggtttctcacactgcttccttccacacctaagagagaatactcctcactcctgttgggatagggtgttagttatagttccccatgtggtcttcactaacactgcatggggtagaagcttttgttaccagtggatttggatgcaagtctaggcttcccacgtgtctgcttttggaatcaagacagtactaaaacttcataaaatcagttgagaactgctgggtgccagtgggagttccagctccccgttagttctccattaatactggctagaagttggaatgcctcattactgctcctcatgtgacagtatgtagaagtagggttgtgcaccttgttactgctggatagtggggaaaatcccgtctcctgactatacctcttctaacattccctctacccccggccagtggagagggctgtctctttattgctggatgggaacaaatgtcccagctccttaattggccttctctgacccagccccagttggggaagatggttgggacaccttgttacagcctcatgagagtggaattctaggctacctgctggtctttgctggtgtgtatatggttggtgacagagtttttttctgtggtgtttagctggaatagagcagttgtcatctaaaagttgtatcttgctaggctgcccctttctgttcctgtggcaacaaaagcctaaaagagcttctattggtgtctctcttttttggcacaaggtaggtctgtaccattggcgtttctgggttgctcatttcttcagctgaaatcctgggatagtctgaggtaaaaaagaaaactcagggactgactgccgtgtcttccttagggttctacattcctagctagtctgccaccctcttttcacctttcagtcttatttttgttttatatataatggccaaagattttagttgtatgtagcatgtggcataggaaagtgtctacgctctctttcaattggaagccctcattgtctttaaaagatatgtttatcttttttttctagttgttatggtacaagccattgtctgtgtgaccttccacattctgatctgagcaggagctcccagacgctagttattgtgggttgtttttgttttttgcactcttaaattttagtcaattaaatgactgcctgtttgttctccagtatgtaaattaaataacctttcctaattcatagtttggtagtaacagaattcattatggacagcaaatgatgtttgaataaaataatatatttattttgaaagatgaatattcttgaataaaacagcaaatgttaacagctaaagtatacttagcatttgttgatctgcttcctggtaagatttcttcccccatctgattatagattgtctaccacctccgttacttggtaaaactgtgaaaatcgacttttcttgactttggttctgcagctgtagctttcccctgtccccctttagggacaacccacctttgaaactaggtctagtgctagtggagagaggtaatgtgattgggcgttgagtcccataaacactgagctgagtagtttggactttatcccataggcaatgtagggccagccaaatgatcattttgaacagtagttcaaataaagttgttaatattcacacagtgtttgatggtctttattttatcttgtaggtcacctgatgtattttttttcagcgtgaagaacttctttaacatttcttgaaatgcatttcttctggtgatgaattctctcagctgttgtttacttgaaagaagtatttttattttgtcttttttttaatttttgagacaggatctcactctgttgcccaggatggagtgcagtggtgccatctcagctcactggaaccttttcctcccaggcttaagtgatcctcctgcttcagcctcccaagtagctggaactacaggcatgccccaccacacccagctgattttttactttttgtagagacgggatttcgccatgttgctcatgccactcttgaactcctggtctcaagcagtctgcctaccttgggctcccagagtactgggattacaggcatgagccaccatgactagcctgcctttatttttgaatgatagttttgatgaaaaaaattctgggttgacaggttttttttcccagcacgtttaaaacctcattccatttggtatgtttttattggttccatttctgtcatgatattcatgttttcctttaagtccttgagcatacttaagttttatgagtgtttttgagtttttatctgctaattctgtcattttgcatttctaagtctattatgaactggctttcctcctctgatggctcacagttttctgcttctttgcatatctggttatttttcattggatcccagacattgtgaatgtaattgagtgttcctaagtactgttttctctggaaaatactgttgtttgttttggaaggcaattaagtcatttgcagataaggttgatcagttcaagactttttaaagctttttaaaagttggatctcaagtagccttttctttaaggccagcttagccttaatgctaaggcttgactgtctaggagtgtccactgattactacaagtgtttattgaggcccctctgctctgtataagtttgaacactcctcagcttactgtgagctctgaagcttgtttataagtcccttacagttttatttgcctggccttgttgaattttatgctgttcacgtgttgattagtattcagactgaagtctcaagggtactcactatttgatttctggagctctttttctgcttagccttcttctttccagtattctgccttgcacattccagtgcttccgtctccttgaacaccagtcttgatttttgtcaacccagtaagatggctgtattggcttgggtttctccatcatgtgtcaagttccaaaaaatggcctccaggcaggaagccaggaagatcgtagagctcactttgttttccttctctcaggtattgtagtcctgtactgcttgttgtccagtgctgaaaactgttgtggcatgtattttttttctagttttctagttgttttaaggcagaaggtcaagttctgtaccagttaacttcttcatggcctgacgtagaagttttttcatattttgtttatttagatcctgtttaatttcacaatagatttaagctggttactctggaatagaaactactacttcagtagtttccttaaaaaacataacttttgacgtgactttttgggatgagggagatacaatgtatgttcattgtagagtttagaaatacacaaaaatgaacctaagtctcatgtaaactcagactccatatcttacctctattaacatttttctgtgttctagtcatttttctgtgattatatatataaccccttttatacataattacggggcataaacagacatacagccctctttctttgttcccccagtttgtattgtgtttttgtttgtttgttttgctaaaaggcaaaattttagtccaaggttagtttttcatgttattacatgttctttaaaactatgcttgtctgtccatattataatggcagtttaagatttcacaacaggaatatatcatcatttatttagagaatgtgggattgattagacatttttattcttttcaaaagtaagatctccagtcagttaaaactctactcctaaattcatccattatactttttggaaatgttttgtccttgttttatccatttcctcctccctgagaaaagcattctgcattgaaattttacactcaatttggtttgagaactgtgctttgcttttcttaattggatcatctggggttgtaagcctgtctgtgtattagaactggacagggagctcgttaaaaataaagatcgttaggcttaaattagactaaatacctgggaatcttctttggatatctcaccatttgggaaccactgttcaaaaccttatctctggtattctaggtttccttaaagactgtgtgttgattggcttagtaggacataagatgagactcattggcgctcagccacagcctctttgtgttcatctatttcgttttttggggacttccacctaagatgctgtttcaaagaagttttatgctagaagcaaatgtgtttaccatggatattgtttatcagagctccgcttccagtgtataatggatggatttctttagtttccttgaacatggagaagcctgaagcaaactgtatgagataggagtcatggcttgtagaagcttacataaaacctttaaggctgggcacggtggcttacgcctgtaatcccagcactttgggaagctgaggtgggcagatcacttgaggtcaggagttcaagaccagcctggccaatatggtgaaaccccgtctctactaaaaatacaaaaattagccaggcatggtggctcacacctgtaatcccagcactttgggaggccaaggtgggcagatcacccaaggtcaggggtttgagtccaacctggccaacatggtgaaaccccgtctctaccaaaaatacaaaaaagccgggcatcgtggtgcgcacctgtaatcccagctacttgggagactgaggcaggagaattgcttgaacctgcgacgtggaggttgcagtgagctgagatcccaccactgcacaccagcctgggcgatggagctagactctgtctcaaaaaaagaatttaagtttttaaaaaaccttccaatagaagtagttgaaaaatgatagttgctacttttacttggcagttcttctaatccatgaatatggaccatctatttatttaaatcatctttaatttctattaataatgcgtttataactttcagtgtatgagtattgcacttttattacatttattactaaattttttatgcttttaaatgtttttgtgcatggaattattttcttaattttgttttcagattattcattatatgtaatcataatttttttattttactcttgtatcctgcagttttaagttttctgacgattccttccttaggattttctacatattttgtaattacttcttcctttccagtcagttatgctttttatttttcttgcctgattacactggttagaatgtccagtacagttttgaataggaataatgagagtgtaaatccttctttgtttctggtcttaaggagaaagcatcgtctttcaccattaattatggtgttaaatgtaggttttttgtaggtgccccttatcatgaatagttgttggattttgtcacgtgctttttctgtggagatacttagtagttctcaaatttggcacaaggaagcttttcatagttttttttttttttctgccagatagatggtaattttaggatcaactgtgcgttgcatatcatgtagccttaaatgagaaccacggcagataatttaataccatttgttgaacaaatattcatgaagtgcctgcaggatgcatttctaacaagttcatttgcttctgatgaatgttcaagatttggatctagtaggttagaggtcagagtttcagacccatgataacaaagttttgtttcctccatgaatttattttttaaatggttttaaatatttaagcatagagctataaacctaatactgagcccagttccagctttttctaaaataatagttttctttttgttaccatgagcagtatcattagcatggctcttcttgcacctttttttttttttttttttaagagacaaggtctctgtcatccatgctggagtacagtggcgtgatcatagctcactgcagccagaactcctgtgctcagttgtcttcccccctcagcctcccaaagtgctgggattacaggagtgagccaccatgcctggtcttctttcacatttttatcacccattactatgacagaacagtgccactcagagtagagtggcaatccaaatagctgttttttgtgctcaaatttaggtgattgagattataccaggtttccttttagaacagatttataaatagtaatacacaaagcaaattatttgcatgaatttgttggtgttcctctgattcttatgctctccattgtgaccatgtacattgcggtttcatggtatgatttgtatcttacaggtttgccccattattgaaattgtatgtagtcacagtttaatttgttcatttcttctaattggctgtcttcaactgtgaaagcagctgaaattctgtggttaattgaaatcagtcaaggtagtgcagtttgatcaagagtgaatgttactgcatttgatttgacattaattttaattttcattcaacattttatttggcagagtagcattttagtggtttttgttttttggtttttgttgttttgttttttgttgtttttttttttttaacagggtctggttctcttccccaggctggaatacagtggtgcaatcttgactcactgcaaccttcacctcccagactcaagccaactcccacctcagccccccgagtagctgggactacaggcgcctgccaccatgcctggctaatttttgtattttttgtagagacagggtttcgctctgttgcccaagctggtcttgaattcctgagcttaagcgacccgcccgctcggcctcccaaagtgttgggattataggtgtaagaccacacctggctgtatgttagtattcttacaacaaaatgtaatcagttgtatggtatttttgctaaatcaactttgtaagcctacttataacagaaatgtccacattattgtgggctattctttgccagacaaattgatggcaaattcataggtatctaatgtcactgcttaattcctgccgtttcaaaaagacagcaaataagcaaaccacagcattaattcttcacgtaatttaagaaaaatagtgtttctctaactccattaatcatttaaatcccatatggttctcttacagcagtgtgatctagctgcatttcttcactgttaagaactgttaggcgcttctgttggagatagtttctaatgttgaaattatcagtgaatgttcattaattcttcatgttgaagctgtcaccatggaaacttaggtgttatagcaactagttatatgctataacttacttagcattaagatgattaaataacatactatatgtaaagcagttggaagaatcatggaaagcaatgtcatttcttagcagatactactatcattttattcttgttttttggcaagtgtgaaaattaaattcaaatattctttaagatgtatacttctggtcttgagatgtaacatcactttgtgatcttacctaagtcctctgctctgtaggaattacaattgtttacataaagatgctattactatctttggtatgaaactcaaatatttatcaatagatttaccatgatgttttgaaaatcagtgggattggggacagtgacatgtcaaaatcatctaggaattaaaaaagaaaagcacaacactgcttatttaaacactgctggtctacaagtttagcttcttttggacttaaaaaatttgttagcttacccttgttttatgatagtaacaataactcagcatttgtttgataatgagttaatatataatgaaaaaatttcatgactaaatagttggatgtttttactatattgtttgatctccagttaatgtgacaggtgaaggagtttggttgggtgttgctcttgtattttaacccttttataagatttcagttgacagtgaaattttaaacatggaactgtaatatgtaatataggtagtatttattaccatatatttacttaataaattcatatttacatttgtttattatataaatctaaacaggcagttttgagtagtgcaaacattttgataacattaatctcagcatctttttttccctctattttgttatacagtactgagaaaaatccaatttaaacagattagtaattgaaaactgttttaaagcttgcctgatagccttaaattgtcattctagcaggtagaaagaatagtaaggactttggacttgactcgccaaatatctaaccttggcttgcatttattaattgttgaaaatgagctttgtagtcagacatgattcccatttctgctagctgtgacaccatggataaattatgtgactcctccaagccttgagtttctctcatttatcaaatggacgttataatactttttacctcgtaagaggtagatcatatttggattaagtaaggtaattacatgtgttaaagtatatccaaataatcatatttggattaagtaaggcgattacgcttgttaaggtatgattttcaaaaaagcaaagttcttaggcaaatgtagaatgaacatgtgtcacagattgtattccactcacttgttaatgagagaaatagtaagatgttaaacttgaccagagtgcatttgttatctaagtatttataggcaatgttaatagaagattgctgagttagataagaaactgattaatatccaacgaggccaggaatttaatctttgtggttatctgggcaaaaattatttgcttctctattgaataaaaagctacaggttaacatatataacttcactgtctaggactttttttttttttttttttttaagagacaggctgtcactctgtcacccaggctggagtgcagtggctcaatcatagctcaagcagtggctcaagggctcaagtgatctttccacctcagcctcccaagtatttatttatattttttttagagatggactcttgctgtgttgactaggctggtctcgaacttctggcctcaagtaatcctcccactttgacctcctaaagtgctgggatgggacttctagtaaatagtgtgttaaagtgtgcattcccctaaattagaatttctcaatttaggcatccttgatttttgggctagatcattctttgttgtggaaagctgtccagtgtgttgttataaaatgtttagtagcatccctggcttctacccactagatgcccgtagactcttttcctcgattgggcagcagacattgccaggtgtccctgggggcgcaaagttgttccatgttgaaaaccattgccctggataatcttgaacaacctttgtctctatacagcattgaacgtactaccaatttttttgcctctttttccaagcttttgataatttttctgacacatgaaagcactttgcagaatgcctgactagtagtaattattaaatgacaattgctactgttaataattatttattattattacttaaatattgtttcttaggtagtttgataggtactatttggctgaatgtatctgggatattgatttgttagataacatcattaaaaagcagaacagcctaagacactttagtgcaaatctatcagatccactcagagtttcaaaatagtcaaaattagtcatttttcctggtaggtcccaaaatcaaatgcatgttttttatactgtcttctgcagttttaggtatggtaaattttgacccaaaatgtatacgttgaactcattcattcagtttactaaaaaaacagacaagaaacactggttaattcctagtaatcattaaaatgatcatagcacaatattatcatagttgaatatattacatgtttattgtgtaaccaactgaataaggcagactgtattaagagcacaggctaagtggacatgcttgaactttgcctgacattttgttctattagacatgtgccaaataatgtgcttgcttatatagttttaggggagcagacatgtctgcacagaactgaattttattaagactcagcgtgtacaacctacatgatcaatgagacaaatcctccatgtgcacaaaaattggagaagttgtattttgagattgacacaaaatgagtttacttggtagtatggataaataaattgttatagataaacaccagtattaaaacttgttacacatttgtgcttccaggtttttaaaattaaaatttgtaaatttgaaaatgaaagttttaaaatgaaagaacattggtgacacctctgaggcactgcagtgaaaaaggctgagaaccacagcttaacaactatggctctgacttagtaaatgtatttttaaatataaaggcttctaaggagcacagtttactttttcttgccctagttacagttgacatttgacttttcatttaagttccacaagtcatgtgatttgcagttatttacctgtcagggtaattagattggagaaccagctatttcctttactgttttagaaatgtaacctagttttttctctctctcaccccttatacaattacataagtaggaatggaacagaatagagaattgtgtaggaaattggaattaaaagtgttcttgagcaggtttggaattagagttatggttggtggtaagggaatttttgtcttttggcacgctgtttctggtgtatagcaaaatatagtatacttttccacaaacagctttgcttactaagcatacagagaccaggctgttgagtacaaatatatgaattgataattttagttttgtaaaattgttcttgtttttgttttttgtttttttggtttttttttgagatggagtctcactctgtcgcccaggctggagtgcagtggcgcaatctcggttcactgcaacttccatctcccagtttcaagctattctcctgccccagtcccccaagtagctgggactacaggtgcgtaccaccacgcctggctaatttttttgtgtttttactagagacagggtttcaccatgttggccaggctggtctcgaactcctgaccctcagatgatccacccacctcggccacctgaagtgctgggattacaggcagttttgtaaaagttgacagtcttcattagcaattatatttcttaactgcaatatagatgtagtacttagaacaacccaaataatagtggaagaaagaaaagataattacatagatgaagcagtaaatattcctttgtgtgttatttagtattttactggcatttgttaattcagcttttgagtttcaataaatactgtccatttaaattatagcgaaggtactgcataagatgtaacatctgtgtgcaagattttaaatataaaatactgtaagaatgacattttcacagtattttatttgttgctttgaatgtaattagttaatgatagcttttctgccaaagggttgattaaaaagccaaagcacagaaaataatatttgaaagagtggataaatcagtgatatgtcggtgagttaaactgcttgactttctgcttttaaactttccatatggtatagatatacatcaaaattggttcagtaatgtttttccagattttaagtgattttgatgtattagaaaatactgaactttttttactgtccaagtttaatttgtaattattctacttaactttgccagatgattgatttttgttgttgttgcttgaattgtttatagagaggaatcaaactacaaaatgtgataattgaggtactctttttaccattaaaactatattttaaatcagactacagtgtttagtggtgtagtaagaaagcatcacatatgacaagctctgggctcatctcttattgaaccgtgtaatgaatcccttgctgcaacatctttgcccctcccccaaagcagccagcatatatttgagcatagtggctctgctcgagttgtatcttattctcatggaggagatagcagagcttgtactgcagcaagtggagctctgtggtgaatccgatgctggattacattttaaggatattagcaaggccctgacaaagtggtgctaaatgagcactttcattctggtaatttgactataattttagtgaagcagttttattatgcaggaaaaagaaacagcattttaattccaatcatagtataccgacctgatctctgctgtgggggtggaaacaatgaagaatgcaacattttaatacaattttttttaaaaagaatgctttggatctagattaaatgttcaagacagtcagcaaacaacatgcacaaaggcatttttctggaatttcagtcttggatcgatttaaatgctcagggtctgaaaaaatgtctcctagcatcaaaaacttggattgcttttctccgatgttatgccactgtaaagtagcatgctccaacagcacaatatccttaatgtttggatgtaaggtgggtttgaataatacttccttaaaaagcttggttttaaaatccaatagtatttcagcaaagaaatgtaatttaggttagatggtttgattgactttaattcatgtaatagattcctgtcctttgtgtgtctgacatgagtaaagaattggtctgtgcacagttaagatatagtagaaaaggatctgatttttatgaaagctgcatgtaaaatgtcattttccattaatgaggattaattattgacttggtttttatgtgttgctactgtggagaattaagtgtacaggaaacaccattgatacgcaggactggagatggtttctgacatcactttgatggaagaaactgcttgtggcagttttaatatttaaactaatgccatagactttgattttgatactaaattgtgttgctatttagattgtatagaggaaagaaagcttttgaacaaaataaacaccaaaagaaccatgactttactactcatttcctataaatgaaactggttaatttagtaatgtgttctatataaataaaatgaatgtagtttgccttaaagatggttattcttatataaaatattagatggaacaaagagcgggtgcatttttacctgatttctgcaatcaaaaacaacatatgctgaggcaggtagatcatgaggtcaggagatcgagaccgtcctggttaacacggtgaaaccccgtctctactaaaaagtacaaaaaaattagctgggtgcggtggcgggtgcctgtagtcccagctacttggggggctgaggcaggagaatggcgtgaacccaggaggcggagcttgcagtgagccaagatcgcgccactgcactccggcctgggccacagagcgagactccatctcaacaacagcaacaataaaaacaacatgtggtttaaagctatttgtaggaagagagccctctaacgtagtatttgggggaataattacttattttgaggtattgttttgaatcgaacttttttttctttttagtttttgtatgactgaaacttttcaattgctgatgtgaagaggtctcaaattgctagctgattaaattaggctgaaaggttgttaaagaatatattgcttttctggtcacccaagcatttttccctctttacattaagttctttgttttgtcagagaattcttattttcctactgagatttcagaaattttctgaaataggaaatggaaatgattgcacaagaaaaagtatgctgctgatagaaacagatttttaacaaatttaacattcgtattggttgttaaactatgagccagtaaaaaattcatatgcattgtttaaatagctaaggctacatttttttcccctaggtgttaagcctgttttttcatgtggtatgtacaacagagtgttttaggaaaaggattttaaattttttaaggaatatttttataaagctaatcactgtaaaaaatgttcctccttatatgtaggtaaattaaacatcttatgtatataagatgtttcaaaatactattattataaaaggttttaagaagtaacatggcattgctcatgactagtctgatagtcttggtggactttaaagtcctcccctatcctccactcctttaaaccactttggatgctgttaaattcattgcacagcaccacttgaggttcttggttgccctctggtgggaaaatgaagaaaatattgtattgaaaatgtcacataacttggtaattaaagatagttaaaagggcatctaagttatatgtttacaatttaggaaatcattagatactttaatttaggaaataaaaagaagtgggttattttggggcttaaccatttgtggatagagtttttaaaaattgttttccaaaatgtttgaattttatggcaggtagtactgacaagagacgtgtagaaatatagtttctaagactacagcatcctagtcacatttttcattagtgtattttgatagatgcaaaatttattaaggctttgtggtgaaactgacaagtaaattaattaaaaattttaatatgtgattaaagaagaatacacattgggaattataccagaattatcccacaacttctagttaaaacatttcagaaatggcttgagacaataagggtaaacacatctttctttccagtgtataaactaataccagtattgcctgtgcaaaaagtttattttctaacagtacttctaatgtcaattaataactgtttacttccttaatttgtatgtaaacaacaagtaatcttactatgtaaattccaaatcacatttaaaactaagctgaatattttcatttatggcaatgagcttttgaaaaggaataaaaacaccaccttgtttgttggaaattaagtatctttaaaaagtcagttttctatgggactagagtttacctcttaaccattctgttctttatgagacatttatccaagaaggttacagtaatagattatcatgaagaagcaatatgtttactatagaatcttggaagtccccatgtgtgtcagagtgagagtgtgcatgcgtgtgtataattggagcagtatcagcaaaacatgagttaatttctggtgtcagtctctgtggaaagaagcctgtttaatctctcatgtctcgcgttagaactcagagaaaggacctttgggaatgtgaggagaatgcagaggacattcaagttcttaatgtagagactatgaagctgtttaggaggcagttctttaggggtggatgtgaacagaaattagcaaaatcatagtgcctctgaaggtatgccaactctgtagtgtagaattagctatttcaaaatagtaggcacagtgaggccggagcctaaggtccctaggaggaaatgaggtatgtgacgatcagaaacttatattttgtgaagctagttaaagttgtttgtttttttgtagtatcaagctcttgaaagttcttgcctttactaactgccctaagagaagccgtcagaatgctttttgtaataaagcattaaagtatgtttggtgacagcagtaattgaagtgagagaatcccagagggaaggcagaacacccagtataaagtcaggagtgtttttttgggtgtcttctctctgcagggaaatagtgtaaggtgttaaagccttggcgattctattttattggaaaaggtactgttcccacttagctgtgtttcttggccagggatacaagtagcttcagggacttgttcgtatctccttgctatgttgcttcatattcttaatgatttgttttttgctgttaagagataattgggtggaaaacgagaagacctatcttacaattacatcattttccccactacccaccccacttctccctgggtgaaatatgcttaagatatttgcaaataataaatactaaactaacaatgactttaaacaaatggacccctattttttcctcattatagtcagcttggaaatatgcagctgctacagctgtggacatcttttttcttgggctttgcttcattgaaagatgtctgttgcagctctagtcataaagacggggaaagggtggaaaggggaaaggagtgtggtttatgaagctagtagatgtctgcgtatatttcattgattaaaactgtgtcacacggactctcctagtagtaagggagagttggaaacctaactgcagtcagctgttcgtatccatggttctgcatctgtggattcaaccgactgtggatcagaattcgggggaaaaattgtgtttgtactgaacgtatacagacattttttcttgtcatttttccctgagcaatacattataacaactatttacatagcattaacattgtactaggcaatgtaagtactctagagatgatttaaagtatatgggaggatgtacataggttatgtgcaaatactacatacaccactttatatcaggggacttgagtatcttcagattttggtctctttgggaggtcctggaacgtgtcccccacagataccaaaggatgactgtacagtatttagcttttatagcctctatattaaacaaaagcagggaaaacagattgtagtgttgggcaaagcaatctacagtgtctgacctaatgcatacaggcagtatttttactgaagtcggattaattttagaacttgtcaagtaatgtgtctgtttagctgagataaagcagaaaagtgcaactgaggctctctcttcacacatctagttggtaaaatgtctacataaaggttgaaacatagctttattgagtgtttgcttcctgttatgtttcttttttttttttccttttctttttgagatggagtctcactctgtcacccaggctggagtgcagtggtgcagcctcggctcggttcactgcaacctccacctcccggattcaagtgattttcccacgtcagcctcccgagtagctgggattacaggcgcccgccaccacactcggctcattttttgtatgtttagtagagatggggtttcaatcaagttggccaggctggtctcgaactcctgacctcaggtgatccacccgccttgttctctcaaagtgctgggattacaggcgtgagccaccacgcccggtccctgttatgtttctttatccttctcacttctttgttccagccttcagaagcaaaagtaaatattgcaaaagagctaccattacactcaagtaaaaggagtatgcccctttgcttttagggtatggtatgtggtatgtaaggtttccttgaaacagttcactgagcactaataggtaacttaagatattcttatttaagaatactgtttcaaaaagatttcaaattgaaaaatactgtgtaataaataatgatcaatagcagtttgcttgttagaattggattagaataatttttaacagtaattaaggttaaatgccttttgatattaaaagcacagccctcctctagtatcttccttcttctaagatgaaatgtactttctcatttctgtgctaccaaacctttacattgagccagtatctttagggtactgttctattttaaagtccctttttattgacttcatggtttctccaaaggaaaaacagtattcttcagtgactatgggactctagctagttcctcagtctttcaggatggtgtattaaactcctttctttttctgctggataggtggggtacaaagaaaaaagtccaaaaactcctttcttaaactgaatgaattaaataattttttcatatattgggaaatagtttctattagcatttgctgatagcagtggccccataatatgtctgcagctagaaatagttgattattgttctcctatatccatttagaactacactgtgatatatattattagccttttctttgaaaatctagtacattacattttggaatgtaatttttcttcctttaagaatgtacttatttttgaaattttctttttcacactttatatacttataaaattttctttttataaatggaaagtcgtacgttttaaaagaacattttattttaaaacaaataccacttggtttaaatatataacattgaagcagtgaaatcatttcaggaagttaaaatagggtatgtgtctttctaatttttatgaagaaaattattgattaatttattcattgattcattctctcagtaattaagcacctgtgcactaggtatatagcagtaaacaaaggaaatctgcccgtaaggcatttatgtactaatcatgttacctagtgtaacttttctcttattaatttagaaattctgtcagtggagacgatggaataaaactttttagagtattaaattctacagtgtacatagtaatgttttttaaagctctgtattagttggctagggctgccataacaaaaactgcagatttattggttggcttagacagcaaatttaatttctcagtgttctggaggctgaaagtccaagctcaaagtgccggcgagatttcccaaggcctttcctctgtgcatggtgagatttcccctgaggcctttcccctcagcttgcagatggccaccttcttactgcctcttcacgtggcctttcctccgtgcatgcatatccccgctgtgtctctcagtgtgtccaaatttccttcttttgtaaggaaaccagtcagattggactaccacaccctaatggccacatcttaatcacctttttgaagtccttgtcttcgaataaagatacattctgaggtactagaagttaggacttcagtatgtgaattttggtggggagggcgggggacataattcagccagggcttattagtaaagggagagccagggctttaagttgacaagcatgtgaaagaggttttgaatctaggctttgatgatatatcacatttttgtaaaacattttatttataaagttcactgagcattcgtaaattaggtttgaacaaatcctatcatcaagggagattgccaagtgaataagtaaaggtgatgtggtttaagaatattcaatgtttaaattacttgaattttcagattaagaaagtcattgtagcctctgcttctcaatttggccaccctatgcctatttgctactaccaaagaagaaacatcttgagcatgtgtttgagaatagaggataggtaagaggacagtgaacgttttggtaatctgagttttaatttcttttttttttcttctttttttttgagtccaagtgtcactcttgtcgcccaggctggagtgcagtggcgcatctcggcccaccgcaacctctgcctcctgggttcaagcgattctcctgcctcagccttccggagtagctgggattacagtcatgcaccaccatgcctggctaattttgtatttttactagagacgggtttctccatgttggtcaggctggacttgaattcccgacctcaggtgatccgcccgcctcggcttcccaaagtgctgggcttacaggcgtgagccatcgcacccggccgagttttaatttcaaaatgcatctgtgtgtgtttgatgactacctgtgtttgaattaatataggtctaaggtatgttgtgttaagtgggctttttatgggttggctttaggaacctagtcataatttacattgttattttaaattgttccaaacaagcaaaaattactgattttttgaatatagcctatccatcaatagggaacggtctctgtaaaaacatctcagacagcaggagaagttatagttcctgattgcttattagtcttgcagaagtagaaaataataacttgtttgatagtacgttttaaggaatgaagcagttgactgtgttttcctggacttacggtccaagagtgggtttgttctgacagtatagctgtgttttttaagaaaatgagtctattttaagctgtctttggcacttgctggagataaagtacataaaaaagaaaccttcccttgaagttcatagccattaagagatgtgataagcaaaccactgggaactcctggcagaagcctttttttaggcttcctcattggttttagagaaaagagcaatccatatttgacatatttcacaaatttgaaatgtaaattatgatgattataaatttcatcatgctcttttcatcgtttttgtaagtgttggatatttgctatacagactgcctcgaacacttctcttagctgacagttacttaacccacagtatctagaagattgttcatcattctttgtcactttttatcttacattgctgttctttttatttttaaataattgaagttgtttgtaaataacagaagaataaaggagtaatgaaaaatctttgttagaaattttaattagaatctaaacatagcaaacccaatttttaaaatcagcattactgggatataattcacatataataaactacacatattaaaaaagtacagcgtctttaagtgttgacatctgtgtacacctgtgaaaccatcactataatcaagatggtaaatgtatccatcacttgaaaaaattttccaaagctgcttttcagtccctccctcctgtccttccctgttctcttctctcccagacaactactggtttgatttttgtcattatagattagtttgcatttctagagttttatataaatggagccataaaatatgttctatttttaagtctggctcctttcaaattattttgagattcatctgtgtccttgcctgtatcagtatttccttccttttaattgttgagtattattccattgtatgtttataacacatttgtttgtgaagatgtttgtacccaaaatgtgtggtattctttgaatgtaaataaccactcatcagctgccctacatgaacatgaaatatatatccattttgtacatactgattccaaattttaataggttttgttttttcacttgaaatcaaaacatagtttacaaacttcgatggttcataatcttgaagtagggaggacattcattgttcttgatccataattggaaagcatttcattttctgattaatcaacaccaattagaatgatcagtccatttaattctttatttttgtatcatctgtttcctttcatccacctttgtgtacttatctaccttcaacagttgtcagcttacggacaaattatggtgtatcactataaaaaacgagagcatactctcacatatactcttaggatactgggatggtccaagttcttgtcacaaaaaattgcatgattaagtcctgtttaatgactaagtggatgaaaatgctacatttcctttaaacctaagttgttcactcatctattcttgaatttgagaaaattcatttagaatattgtcatgtgaagacttgtctccgatgttacttctacaattaaattcgccattgtcattaatctacagtgttgctatctttattttcattcatattttgatcagctagtagttgtaaaatatctctctgtcagttttcttctctttgccattaatggtggtgttcacaaaaaagttaacataacctaaactgctctctttgaaaaggccagcttgtaaggttggctgttgactagtgtctggaaacttagatttcagaaggattcctaccactagctgatcaagtcgcttactgtgcctaaactgtttatacaaaatactatttctgccgaatacctccttctgggagtctgaaattttgtcatgtgctaggtgcctatgtgaccagcccacagtgaaaaccctgggtcctgagtctctaacagtctttcatggtagacagcatttcacatgtattgtcacaacttgttggtgggtgaattcaggaaatcttatgtgactccattgggagaggattctggaaagtagctcccagtttcccccagactgccccatgtgccttttttctttgctgatttttgctttgtagcctttcgtcgtaataaatcatatctgtgaatatgactcactctcataagtcctgccagcaaatcattgaatctgggaataatcttgggaatctttcaacgcaggccaaaagttaaaatttttgaattcttaactgtgttcagcaaaagcttaagtaaaaaaaaggagagacttaccaagttggtgtctgaaggatgatggaatagtgatgatttatttccagatagaatgaattttattcatatgtaaaaaagtaaattttctctttgttatatgaaatatcttaagaaagagtaacaatattggaaaagcaatctttaaaatatttagaattgcttttaattaccaccctctgccccataaaaactagaattgggttcagtgaaccctagtggtatacaaaagtttgacagagtatggtttcttggtcatttgcatggcatttaaaatttgcctttattcaatattgagtagatacaaactaataggtataaaatatatgtaggtataaagaattgctacataatattaaaaataataaaagagtaatacctgtttccttagaagtcccctgtttgctctcctcagattctttgtcattccttcccaactcagtaataattctgaattctatatttggtattccttgcttttttaaaaaacaattcctgaacaataaattgttgattttgtatatttttgaaccactgggtaatgttgaatatagttgttagagattttatggcttgtggctttttggttcagcacattaggatatgttcattttttatttttcttttctttttttctttcgtaactctgttaactgaccgttatgttatcttctgatgaatagaatcagttggtaattttaatgtcaaattaccagtgttttctgtttaggtttacacatttcttgtcttgttttgactatccttacatactagaagtcataatctcctatgtagtattgtcttctaaaagttttatattaaatcttttcacattgagatctcaaatctgcctgaaatttttgttttggtatgatacaggagtcacatttcattttttctaatggatactcaattatcccagtcacatttattgacaaattcttcccattttccccatgatatataatgtccttcattcccacatgtgagtctgtttctgaactattacttatgttccagtcatcagcctgtctaaccctgtgccattacgcattatcttaattactaaagctttagaataataccagttttaattgtatttgtatacaaatagtaatatcatttgtaaataacaagtttcgctgctatcacacaaaaataaaattcctgagtcaaaggttatatgtatttaatattttgatagtgttaaattgctggcaaaaagttactttcatttatgtttttacctgtattagagtttctgttttcccacaccttcatcaaaactaggtattattgggcatttgtggttttgtgggtatgcccagataaaagtgatagatcattgttttaatgtgcatttcttcttgagtgggaggatgaacatcttttcattgtttattgagtatttgtaattctttatacaatgaactgccagtctgtgtgtcttgctcatttttctttttcgttttttaaaaattgatttgtaagactttattataaatttcaaaactggcccttttgtaatgtacttgagctctccctcctcctacccctccccccaaactagttggcattttctttttaagttggtgacacaaaagttttaaattttatgtattcaaatttattagtcttttttgtttccgagtatcatttctttttttttgagacagagtctcgctctgtcgcccaggctagagtgcagtggcgctgtctcggctcactacaagctccgcctcctgggttcacgccattctcctgcctcagcctcccgagtagctgggactacaggcgcccaccaccacgcccggctactttttgtgtttttagtagagacggggtttcaccgtgttagcgaggctggtctcaatctcctgacctcatgatcctcccacctcggcctcccaaagccaccgcgcctggccctgaatatcatttcttacttagacttcaccattccaacggtaggaacaagtttattcatattttgtttaagtgtttgggtcagttctttatatttaggtctgtgatctaataggtatttttttttaagttatgccataagaatccttatatttttccccaaatggccatttaccaaatactgtttattcaataatccatcattcccctactgatttaaaatattattcttatcacagctattacatttgcatattcatttggttgtattgtagactcagtggtctgttcaacactttgtttctctttgtttgtgctgctatcaaacttttaattattgagaccttctactgcttctctgtgagagaactggatagagccagttgcctctcatgacttttaattcagaattttcttctcatatgccagttttttcagattataattactagtaccctgccacatactctgactcacccaaataaaactgtattgatattttgattgcaaaaacattattatagattattttcttggaaaattcaaacttaaaataatgagcctttatccaagaataactaagtagtgttgctttattcacttcagtagcattttgaagttttcttcatagagattggccctttacatttaattcaagttctcatttttgttgttgttgatgcttttggaaatgggatgttttctaacagatttacaaatatgtactattttgtttaatcatttttacggaagtataatttacattcattgagctgtgtctgtgtaaagcgtacagtttgattagttttgacagctgcagacccctgtgaaaccatttccatagttgagatacagagtattttcctcactccaaaaagattgtgctccttggtattcattcagccctccactccccaccaggtaccactaatctgcctttctcacgataaattattttacattttcaaacattttatataaatggattcatacagtaagactctttagtgtctttttaaaaaaaagctcctaataatgcttttgagattcattgaggttgtttgtgtcagcagttttcttcttattgaagaggtgtattctggtgtctggatataaaacactttgtttattcctatctgttgatggacatttagattgttaacagcttttggctattttgaatgaaggtgttagggatcttcatgtacaagtttttgtgtggacatatatttttatttctctttgataactgtcttgaggttgttttcatatcctaggtataagaatggttattttcacatttgggcagttgatgagagtcccagtcgctccacattttcaccaatgcttgtctttgtctcttctttctccccaaatttggccattttagcggatatgcagtgatttagtgggtattgtggctttatttgcatttctttgataacttgtgatgttgagtatcatttcatgctttacatgagtaaatcttcttttgttaagtgttttgggttgaattctgtctctcacaaaaaaagatatgttggagtcctagcccctaatatctcagaatatgaccttatttggagataaggtctttacagagatagtcaaattaaaatgagattattgggatgggctattccagtataactggtgtgcttataaaaaggaagaatttggtcaaagagacatgacacggcaagaatgccatgtgaagatgaaggcagagatcagagtgatgcatctgtaagccaaggagtgcggaagactgccagcaagccgctggaagtcaggaagagaggcacggaacagattcttcctcacagcccttagaagaaactaactctgcctgtagtcttgtaaattccttagggttttcagtgcgaacagtcatgtcatttgcaaatagagacagttttacttaatctttactggctgttacacttttactttcttttgcctgccttccagccacaattagggcctccagcataatgttgaaaacaagtgaggcaagtaagcatcctttcctccatcttaatgttgaacatatcaccattgtgtgcattagcggtagggttttttgtttgttttttaaaacttttaggttcaggggtacacgtgaagctttgttacataggtgaacagattattacatcacccaagtattaagcccagtacccagtagttaccttttctgctcctctccctcctcccactctccaccctcaagtagatcccagtgtctgttgttctcttgtgttcatcagttctcatcgtttagttcccacttataagtgagaacattcagtatttggttttctgttcctgtgttagtttgctaaggataatagcctctagcaacatccatcttccctcaaaagacatgatcgtgttctttttcagggctgcatggtatcccatggtgtatatgtaccacattttttttagccagtctgtcattgatgtccatgtctttgctattgtgagtagtgctgcagtgaacgtttgtgcacatgtgtctttgtggtagaatgatttatattcctctaggtatataaccagtaatgggattgctgggtcaaatggtagttctgcttttagctcttcgaggaatcaccatactactttctacaatggttgaacccatttgtactcccaacaacagtgtataagtattcccttttctccataacctcaccagcatctgtttttttgactttttaataataaccactctgacaggtgggagatggtatctcattgtgtgtttgatttgcatttatttagttctgtttatgtgatgaatcacatttattgattggcgtgtattgaaccagccttgcatcccgggatgaagcctacttgattgtggcggtttagctttttaatgtgctacaggattcagtttttaagtattttgttgaggatttttgcatcaatgttcatcaagatatgggcctgaagttttctttttttgttgtgtctctgccaggttttggtatcaggatgatgctggcctcatagaatgagttggagaggagttcagcctctttaatttttttggaatagtttcggtagaaatggtaccagctcttctttgtgcatctgttagctgtagggttttcataaatgccctttatcagatttagatcgttcctctggatttttagtttgctgagagttttatgaattggtattcaattggatcacatattttatatgtctgttgaaataattatataatttttctccttcattctgttaaatatagagaattacattaatttattttttagatgttaaactaaccttgccttgttgaaataaatcatatttggtcatgatgtattatcctttacagcatccttttcatattcaatttgctgtattttaaaaaggattcttgcatttgtgttcatgaaggatatttgtgtcattttcttttttcgtaatgtctttgtcaggttttggtattaaggttatgctgatctcatagttgggagatgttcactctatttattgaaagaattatgtaaaattgatattgtttctttcttaaatgcttggtagaatttagtgtatttgggcctggagttttctcagtgggaagaattttggtaacagattgaattctttaatatatattaaagaaaatatatttcttataaagacttatatatatatatataaatttgagaggccactcacatttactgttttatattgtgtcagaatatggtgtgtggtaagatgtgttttttggggaatttcttgatttcatctaacctattggattagtttgcctaaagttttttataattatcttttattatctttataagatctataggttttttcagtgataacctctcttgcattttttattattggtaattatattctctctttccttgatctgtctagaatagggtttatctgtttttatgattatttggctttgttaatatactcaattctttgttttctgtttcattgatttctgccttttattatttccttccttctcttcccctcaggtttactttacttagtctttttttttttttatagcttctcaaggtggatccttaggtcagtgattttaaactttcatttttaatgtaagcagttaaagctacagatttccttttaagtacttgtaaagtttgttaatagttcagaaccctcaggttcagtaatttactggaaggactcacagaactcactgaaagctattatactcacagttatggtttattacttgaaaggatacagattaaaatcagccatgggagagataaaagtccagaaaatttccaaatgaggagtttccatttgtcttctctggagtcatggatgatgttaacccttctggtaacaatgtgtgacaataagcactgagtattccaaccagggaaattcaatcaggacattccaagggtttggagggagctaaaagcaaggttaaattctttactacatagtcctatttagcttcattattactccattctgaattgtttctgatttccttcttgagttctttgaaccatgagatttttagaagtgtgttgtttaatgttcaaatattaggaattttactagataccttgtttctcagttaattccattgtggttagagaatggattggttgtgatttcaatccttttaaatttgtgacttgttttgtggcctagcatatggtctgtattggcaaatgtaccatattcacagaaggtgatgtattttcttcagttgttaagtgttgtttatcataaatgttaattaggtcaagacagttgatactttgttcaatttgtcttatatttgtatagttctatcagttgctaatcaaggagtttaaatctcttactaaaattgtagaattgtctgtttctccctttagtttctgttggttttgcttatgtattttaaggccctgttattaagtacacacatttatggttcttataacttcctggtgaattaaatttttagcattttgaaatctctttttctttagataaatactctgtcttgaagtctgttttatcatatgttaatataggcactttagctttcttatgcttacagtttatataccttttcttttcattcatatgctttcactctgcctttttttacgaagtatatctctcgctttgcatgaagtaagattcatgctcagattctcaacatcatttagtggtggcccaagtcatatttgttttaatttgccttttaaatatgagaaatctgatttttactaattattaattaaaatcagttaacatactaaattacttctagtaatttttttagtggatttgcttggattttctagctgtgtaccagtatctcctgtaatgattgttttatcaactcattaaaatttttttcattctaaaggtaattttgtgaatgaataatacattcacatggcttgaaatttaaaagctgtatgaagatgaaaaggtctccctcttgcctctttcccccaggggtaaatctcctctcgtcaagcaactaaagttatctgtttcctatgcatcctggtttctccgtatataagcaaatatgtgtattttctcttcctcttactatccccccaactacccccaccccgccacacacacaggagtgtagtctatactattctggacttgttttcaccacttaacattatattctggagttttttctatttccatacctgaagacctttctcatcattttatgacttgtgatattctcttatttgaataagaatgatttatttgacaagttcattgttactggatatagtgatggatgtttttaattatttgttttacaaacaatactacaataaataactgcctacacacttcgattgtaaacatggcaatatttctataggataaattcctaaaagtagaattatcaggtcagaggttctatgtattcataattttgatagaagttgtgaaattgtccttttatagaggtagtaccagtgtacactccacagattcgtatgaaagtgcctgtttttcctatgtcctcatcagtatatagtatgttatcaaacttggatatttgacaatctgataatgtgagaagtagtatatcagcgtagctttaatttacatttatcctcttgggagtagtagataaacatatttttgtatatgtaagaattacttgatttttttttttctctaaattgtttgcttgttcttgttccatgcattagagagagggctggagggttttgtatctttttcttagggactaagaagtttttaaatgtgtttgtgaaattagtcctttggatttaagttacaattttttttcgtattttttaacgttttgacttctagtcaaatttatcagtctttttttaatggcttctcagtattatgttacagctatataggtctttgttatagttataaaagaatttctctagaagaatcttgtgttatagtctcatttaaaaaaatcttcaggatatttttgttgtagctacccattttcccccttgctatttattgaataatcttttaaccaatgatattggttgaagatataaactttattaaaaatagtaccaaatttctatttatatgccgattttcatctttgtttcactaatctttctgttcttgtaccagtaataccatatattaatcaaggttttataatagattttaaaatttgttgaagattgtgcacacttactccttatctatagactttctttttttcttgctggttttttacaagaatttcagttacctcttctaattcctgcataaatatttgaataaatgaataaattttctgttggcctttttattgggattatgttaaagataaaagtatagataaacttaggaaggagatgatatctttgacttgattctttctgccaagaacgtggtctgtcttcttttcatttggtaaagccggacatttggatactttggttttattcctgggcattttatcttttttgtttctatttcagatatggccttctatttccttgtaccatctaattgcttattattagtttaaatcagagatttaactttgcgtaaagtttgtgtaactttgcgtaaagagcagactttgcgtgaaggacaaactttgcgtaaagagcaaagagcaaactttgcgtaaaggaccagatagtgaatattttagcctctgtgggccgtctgcttcccagctccgccaccgcatcacagaggcagctagaaagcagccatacatcatacatggaaatgagaatgagtgtggctgtgttccactacaacttcattacaaaaacaggtggcaggtcctacttgaaagcagtccaacagaatttccagcatacttagttaaatgaaagcaatcgatatctatatattcattttctacctggatacctaactgaaatcttttattgtttattgttggtatatcgttctttatttttatttatttatttattaattttttacatttctcttggattttctggatttaccatcaggtgatctgtaaattgtggtaattttatccttgtccttctaatttttttatctcatagttttttttcttgtatctcctgaaaagtgttagcagtagttataatgatatgcttatttctgactttaatgcaaatgatgtgtttccccattaatcagattaatggttgactttttggtgaatagaaagatactataaatcaaggctcatgcctgtaatcctaacactttgggaggctgaggcaggtgtatcgctttgagctcaggagttccagaccagcctgcgcaatgtggtgaaaccctgtctccacaaaaaatacaaaaattagctgggcatggtggcttgtgcctgtggtcccagctacttgggaggctgaggctggaggatttcttgagcctgggaaggggaggttgcagtgagccgagatcacgccactgcactccagccttggtaacagagtgagatcctgtctcaaaagaaaaagaaaatatcttacataattaagagttatttttaaaatcaagagtatatactgatttttttaaatgccatcttagaagaatccgtagaaatcatttgaccctttacgtcatggatttctttgtttacttttcaggagcatactgtaatagtcagaataatgccctccctgcctacccttctgcccccctcaaagatgtctgtgccctatagatagccccttgaacctgtgaatacatggcaaaaggaaattaacgtcacaaatggaaataaggtttttaataaactgattttaagatagggagattatcctaaattatttgggtggacccaaagtttccttggaagaaggaattggaaaacagaatccgagagatgacagcatgagaaggacttggcctgacattggtggctttgaagatggaggaagtgggccccctgccaagcaatgtatatagacagtccccagaaactggaaaaggcaagaaaagagattcttctgtagagcctcctcagacacattttggacttctcaactacagaactacaaaaatgtgggttgttttaagccactatgtttggtaacttactatagctgccatagaaaagttttgttctcagttttagtgagtatatttcaccattaattgtaatgtcggttttagtttggtttatagtaggaagctgtccagttgtactgttttactccaagaggtgatagtggttgtttttcatcataatggatgtgtttgttgagtatttggtattcattaattttttttccttctgacttgttaatgaggtcagttacatgaaatgcttttttgatatttacctattctgacatttttggaatgtattctacttgggttgtaatattttgatgttctgagctcttttgctaatgttttgttttggaactttgtatttacattcataagtgagattggtttctagtttttttgtcatttctgaggaatttttttttagaatgttgtcctttctcatgattattgtttcagggctttatctcattcagtcatggccagttttggaaatttatatcttcctataaaatcataacaacacaattttgttcgtattgtattttgcttcccccttcctcccacgccctttccctaatccaggctttacttctgggggaaggagtaagtcccagtattggtaaggtataccatttttcacatgtatagctttatcatatgaaggttgaacacatttttattttttattttttggtatgttcaagatggtttggtatgtggaaatcctatcttggtatatgacatttccttccttaaaaagcttgaattagtaattctgttcttcttggcccttaaccttttggcgattgctgtcagtggtttcggggatttttaatgctttttttattccaagcaagtgaatgaatagtcatcttcctgtatccacaggggattgggttcaggataccaaaatcagtggatgctgatgcccaagtcatagaagacatagtatttgcatataacccgtgcacatcctcctgtattttaaatcatctctgaattacttataatacctaattctatgtaaatgctacgtaaatagttgttacactgcattgttctttatttgtattatttttgttgtatttttttccccaaatgttttccatctgcaggtgtttgaatctgtagatatggaactcacagatatggagagctgactagttgggagaaattgtttaaccacaggcaatagtttaattgtacctaaaatcttcattccagctcccagttaatgtatataatagctaattttattaacacactgatggatgagggaaaatcattctgtagttcctatcacaaagtagcaggtgttttacaaagagcatagttaaccccatttgaaaacagtttgtctggatgtggctctaagttggtcctgtagcagcttttgtcgtgttcaggaaaacaagcaatctaatatcaattgttataggattcttctgtttctattcctgcagcttcatattaaaccgttgtcaagaacaaaaagaatagtgtttcgtatgcatttctgtattgtggttagctcatttgaaatgtacaagtagaaaaatgaagtcagtgtaatgtggaaatcacactgattcacataatttttcctatacatgggagcagactgagcagtgggaataagattataatctttagctggagaacagaaaagctcttggctcttgagctacctgttgtgagcaaggtgttctttgtactctatttaagtaagttaaagacaagcacctacaccggggccttctgccacagagagattcattcctaacccagtatgactctttgcataggatagatttcattgtcttccttaccctaaaagtatctgtgttgtttgggcccccaccagccctattttaattatagtgttgtcagtttgtgcacttttactgcttgctgtggctcttgcctgcccgagcaatacaatttaatgactgctctttttccctgacagaggccatttattttaaccttgaaaccaagaatatagttttgctcttgaaaggataattttttagtggttaaagattgcaaaagtgaaagtgaggattttggagaagaaatgtagtaaatgtctgtggctttaaattaatgtattttattgatcttaaaatgtactttcctctacttttaacctgtctcaaatttggaattatttgcaattgatgtacttcacaatttatttggcagtggtttttttttcttttttgggggtaaatataattactggggcatcttataattgatgatgtgtactggattcatgagatacaatatttgctattagataaattttagaatttaaaatatcctacttttgactttcagaaaacctagttttcgaatggagatactgtaatattttgattttggaactgtttttgaaagttcatgacacagactatgacacagttttctaagtattttacgagatggagattttacaaattttacttactttattttgagacagggtctcactctgttgcctaggctggagggcagtggtgtgatcatggctcactgcagcctcaacctcccgggctcaagcagttctcctaccctcggcctccccagtagctgaaactgtaggcacacatcaccacatccagctaatttttaaaattttttgtagaggcagagtctcaaaaatggtcctgaactcctgggctcacctgatcttctttcctcagccttccaaagtgctggggattacaggcatgagctcctgtcccaggcctaaaattaacatttctgtacacaaaatacacattttcccttccacttcactgtcactgttaagacaaatctaacagtggttagactgcatcgttctctgacacggacagcattcctccttaccctgcagacttatttaaagtaattttcccagatccctttgagaaaatggttaaagttgtgaacacttcttcagaaataatgctcacatctccttacaattcttttacagttttctggtttgcacttttaggcaattacacttcttgtttttgttttgttttgtttttagcatattggttagaaacgctagagaagtgttgagtaagatgatactgccttgattgccactttaagaatgcctgtttcaccattaaatatgattgctggtagatgctttaaaagtttatttgtatttctgtattgctaagagtttttcttctcctaaaatcaggaatgggtttaaaattttgagattcttaggtggttcttagagcgttcattgagatgatcatggtaaaatacatgaagacatgaatgtcttaaaattgagccatccttattgttgggatacatttcacatcatagtgttggattcagtttgctttttttccttccaaaacatttgaattcatattcaaaatgagcgtcgtttcttgtgttttcaggttctataatctggttgagaaatttggaagttttttgtcttcctcaggaatgcagcaatcagtgtttccttgatagacttgaaatgcagatataatacagttacatttattgttatcactcgttttgtaattcttctcatcttacatttgttatggttttcatgcatttgttttatttgtatataatcgtggggtacaagtgcaggtttgctacattaataaactgtattgtggtgaaatgagggcttccagggcatccatcactaaagcaatgcacgtggtacccaccagacagcctcctatcatccacccctcccacccctccacccctgcaagtctgcattgtccatcattccacactctgcctccatgtgtacacattatttagctcctgcttgcaagtgagagcatgcagtatttgtctttctgtgtctgagttatttcactgaagtgctttggctaagctatttgggctcttttttggttccatatgaactttaggatttttttttctgcttctgtgaaaaatgatattagtattttattgtagtattacattgaacttccagattgctttgggcaacgtggtcattttaactatattcattcttctgatccatgagcatgggtgtttttccatttgtttgtgtcatctacaatgtatttcatcactgttttgtagttttccttgtagagatcttttacctccttggttgaatatattcgtaggtattttattattttattttattttgtagttattgtaaatgggattgccttcttgattgggtgtttggccagatcattattggtggataggaacactactgatttctgtacattgatttcgtatcctgaaactttactgaattcatttaccaaatctgagagtttttttggtggagtctttagagtttgttttttgtttgtttgttttttgagacggagtctcactctgtcgcccaggctggagcgcagtggcgcgatcttggctcactgcaagctccgcctcccgggttcacaccattctcctgcctcagcctcccgagtagctgggactacagacgcctgccaccatgcccagctaaattttttgtatttttagtagagacgggttttcactgtgttagcctggatggtctcgatctcctgacctcgtgatcctcccgcctcggcctcccaaagtgctgggattagaggcgtgagccactgcgcccggccggtggagtctttagagttttttagataaaagatgatgtcatcagcaaacaggaataatttcacttcttcctcttttctaatttggatgccttttgttttttcctcttgcctaattgctgtgacaagtcttctggtatcgcgttgaataagagtggtgaaagtgggtattccggtattgttccagttcttagagggaatgcttttaacttttccccattaactataatgttgactgtgggtgtgttatatatggtcttttttttgttgagatatgtttctcaaagcctagtttgtcatggacattttattatgaagggatgctgaattttattgaatgttttttctgagtctgttgaggtgagtctgttgaaataaggcctttgaccttatttctgtttatgtgatgtatcacatttattgatttgtgtatgttgaactatccttgcctcctcaggataaatcccactggatcatggggtattatatttttgatggtgctgtcgggttcgatttgctagtattttctttaggtttttacatctatgttcattagtggtattggcctatagttttattattttgctgtgtcctttctggttttgataacagggtaatactggcctccattcctcaacacatgttaatcctcatctgtttcaagaattcatattaagcctcactgctccttttatgttaatgtgttgctgtttttcttaaaatgaagtatattggcttgcatggaacaatatgtggtaccaaatatttcttttaaatttactactgaaataataagtatttgaggggtagatagggagatatttgcacactaataatatttgttcaactgtctggtattgatttaagaaccttgtactaaatattttattaaatacttagtttttggccttaattttagttattttggattttctaatagattcaggaatctgcatcatttccataatcagaaaattgtttctaaagaaagatatctggaaattatctaacaggaatgaagtagtaatttagtcacattcctatatgtaagtcatagtagtgagtaaaataatattgctgatattgttaaccaagattaagggcagtgtaaagttttatgtcaaaggtagtggcctgaaaaacataaaaaaggatgaggaaatgtgtttagaatgttcttactataatcatttaaaaatatgtttcctccttcatccctaaccctcatcacactttgtaattctttttagtataagtgttaggtaagttagacttggaccatccttagggaggccttagttttctacattctactttattggcaaactggttttatatgaagttttcagtgttacaaaaaattggaaataggctgagataaacctttagataacaagaaatacagatgaatattgctgtgtaatgtaatgatggccctgaaagctacttggaagtactttctcaaataataattgtaatgaacccaaggtttctcttttttgaataattacaggttgagcatcctttatccaaagcacttgggaccagaagcgtttcggattttggaatttttcagatttggggatatttgcatatacataatgagatatgttgggatgggatgaaatttgtttcatatacacattatacacatagcctgaaggactttatatacactatttttaataattttgtgcatgaaacagagttttgactgcaacccatcacataaggtcagatgtggaatttttcacttgtgatatattggtgctcaaaaagttttgaaaattgaagcattttggattttggattttcagattagggatgctcaacctataatagagaatagactttagttttggtaactgtatttttataaaaggttttcttaaaggtacaagtataagggaactcagaaactttaagagattcccattggctagagatatgtcaatttcagcttcagaaaagattttttcaatagattttatcaccagctatgtataatccatcaatttatcatgataatttttataataatttgaaggtactcatatagtgtaaaatttactcttttaaagtatatggttatgtgcgcagagttgtgcacctaccaccactaactaatttcagaaggttttcatcatcccagaaagaaattccatatccattagcatcatttctccctcttgagtgaaattgctgggtcttaagatacttcatgtaaccttttgaggaaccttcaaactgttttccagagggaatgtaccattttcattcccatcagtaatgtatgagagttcccatttttccacattcttgaccgcacctatcagtcttttttttattatggtcctcatgttggatgtgaagtagtatctcattatgggtttgatttgcatttatgtaatgattaatgatattaaacatctttccatgtgcttattggctgtttgtatatcttctttgggaaaatgtttaaatcttttgcccatttttaaattgactcatcttcttgttgagctataagatgtattctggacagtagacccttatgaaatatattatttgtaatattttcctcctcattgtttggtttgtctttttttttttttttggagactgagtctcgctgtgtcacccaggctggagtacagtggcctggtctcgactcactgcaacctccacttcccggcttcaaacgattctctgcctcagcctcccaagtagttgggactacaggtgcccaccaccacacccggctaatttttgtattttgagtagagacggggtttgactatattagtaaggctagtctcgaactcctgacctcgtgatctgcccaccttggcctcccgaaaggctgggattacaggcgtgagccaccgcacctggcccctttgggtcatcttttcggtttcttgatagtggcttttgatgaacaaaagtatttttttgtttgttttgttttgttttgttttgatgagtccaatttatgttttttctttggttgctgatgcttttaatgtcatatccaagatacgatttcctaatcctaaggtcacaaagatttacacttatgttttctaactgtaactcatatttaagttttggttaattttgtgttaatttttgcacctagtgtaaggaaaggatctaatttcattgttttgcatgcagttgtcccaatatcatttgttaaaaaaaactattctttctcccttggcacacacatgtccaaaatcaattgactgtaaatgtcaggatctatttctggactctttattcaattccattgatctatatatctatatttattccagtaccatagtcttgattaatgtagctttgtagtaagtttcaaaatcaggaggtgtgagccctgtactttgttgttcattttcaagattatttctggctattctgtgttcctcgcaattccgtgtggatattaggatcagcttgtcagtttctgtgggggaaaagtgcctgatggaattttgatagagattgcattgaatgctgtatagaaacctaactgatcaccttaggagatggcagggagccaatttttcaaatctgtcttgaaaactagtaaataagggcatttttcctgtttcacctgtgtgaaccataccaacagataaccaaatagtaggtgaagtatctctttatacatgtattccattgcattaatgaaaaataaatatagaattagtttgtcacaatttttgcaaatcccagtgaatgaattagtttaggcattgaatatcaagagctgctaactttacaaaaagagagacaggtattatatgctttctgataaaataacacaccaccacctgtagtcttaccaaaaggactgaacgtgagattaattaagttgttgcgtccagctaccaatttacaggaaatacggaagcaaaaggtctgcattgaagggccccatgattttgcagtcattctactggaacctctttaggtcaaatgccttgagtttttccataattatagggaataaaaaaggatcaagagggaacttataaattaaaagatacttaaaagacatagttttaaaattatttctttcaagaatgaggcttttttaaattttaattcctttcacttccctccaaattacatacgtacattcataagcatggatacacacatacacatatataatgatacatacatacagtgttgcttaaaaatgtttaaacagtgcatttatataaaattttaaatatatttatgtacatacatagttttatgtagaaaatacatgtcatgtgtatataaatatctgtagctttgaaacatcctttcctcattcaattatctatgtttttactttgtcctattagaagatgtagatttttggtcagtttaacttctgtgtagaatttcctacgatgggtgtgccatatttctttagacattttgttagttgattgataggcagtttattgtcagttttttaaaattccaaactgtagtgaatatccttatccatgtatctcttctaaagtatatcctaagttgttgagtacctgtagagtttcaaaagatggcaccacatttccttccttatatctactcctgagagtacttagattgtgtttccactcaactgagtatgtaaactgtgttaggttttctatgtttatgttaacgtcagccttgattacaggataaagttagagaacctttttttattggttttgaaactaattgcagtcatctgtgaaaacattattcttatatcctatcgaataagctaatgttgatgtaagccagattgatgttttccgtgtgattgtaccatttcacaaaaggatgttgtttaaaaagtgctactggaggttgtatagtaactttcagcagtcaagcccatagttaccattctttttttttttttttttttttttttggtgtgcatttacaaacgtacatttttcctcctatctatacaagagataactgatattcctccttaatactgtctctcattcctagaagtgggattactggatcaaggagtgaaaacattttcaaggcttttgaaacatactgccaaactgccctccagaaaaaggcctctactgtgaatgtgatgatggatgcccatttctctgaatgctgatgctgtattttttttttctctcactaaagaagctgagcgttttttcctctaagtttactgacccatttttttctacttttattttaagttcagggggtacatatgtaggtttgttacatgggtaaattggtgtcactgaggcttggcgtaggaatgatcctgtcaccaaggtagtaagcatagtaccaataggtagccatccaccccacacccccttctacctccccagtcaagcagtccccagtgtttattgttcccatctgtgtgctcatgtgtgttcagtgtttagctcccacttacaagtgggaacataatagtattttgttttctgttcctgtgttagttcagttagaataatggcctccagttgtatccatgttgccacagaggacatgatttaattcttttttatggctgcatagtattctgtggtgtatatgtaccacattttctttatccattccaccattggtgggtatcttggttgattccatttctttgctattgtgaatcgctctgcagtgaacatgcatgtgtcttcttggaataattactgatcaatcaattgattgactggtttttttcccagtagtgggattgctgggtactgacccatttgtatgcctttttaaaaaaatatcactttatgttcgcttttttttttttaaatcattgataagagcaacttaataaaccttggtttcttgttgaaattctttttttattgtgccttgttttgtgtcttttctttatgagtaggtttattcgagggtgatgggaaagaatattttatctcagtgtgtctttatttatgccataggccttctcagcttggtgtgaggaagctttttttaaaattatggtaattttttagaaatagattgcatagaggtgtgtgtgtgtgagagagagagagagagattatagttaaaataaaaaatgtgattgtctgctgaactaattttcaggtagaaattaaaatggctgacttttaaaaaatttgtgtacaagttaacggagtaagaaaaccagactaaggtgcctaactttggcttttccattgactttatttaaataattttatcttagagatacatgattcagttaacattgggtaagaaatgagcaatcaatattcagtcttctcttgtcacctagctttgaattatttctaatgtttaaattaaataattttattattggcattatttttaaagtaaaatcctatttctctgagatctgatgtattaaaccataaatatactttttatattgctaaatattgagtatttggctagttatgaaaaccatgatttgaattaaactcatgttgcttatcagggcttcttcatgtttattttctttacagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaaggtaggatagtatctatttattattgttatgaattacatattacttttgttatacatatagctcatgctcggagagaagtattctttcatgtaggttcgccctaccccacccccccattttagtttcatagttatggagaatttcaaggtgcttattagtactccagaaaacatttttaaatatgtattttataaatgaatgttagtcagtgatgctatctttaagtctaaaaattcccacgatggaaataactattaaatttcaaataccacacactgaaatattttcagacacttgtttttaaatattagttggtatagaaacagtgcatttccagcactttggaaggctgaggtgggtggatcacttgaggtcaagagttcaagacaggcctggccaacatggtgaaatcccatctctactgaaaatacaaaaaaattaaccaggcatgatgacacatgcctgcagtcccagctactcaggaggctgagacaggagaatcacttgagcctgggaggcggaagttgcagtgagcctagattacgccactgcactccagcctgggcgacagcaataactccatttcaaaaaaaaaaaaaagagcattaacatcatctttaaattccaaatatgtgacttttcttgatcctatcatctctcccctcagaagtaactataatcctgagtatatttaccctttcttattaaagttctaccatatatttcgattgctaatcaattgttttgcatattttggactttatataaatggactcatactgtatatttaacttgcactctttactcagtattacattcctcacattgataaatttcactgctttagagttttctattttatgaatatactacaatttattttacttttgatggatatggatttattttcaggttattactagtgtaaaaagtgcttgtaaaaacacaggttatatatacatctttgtggataaagccagcttgtttctcagtagctgtgtcatttccagtttcagcaggaacatctaacagtttttaattgatccatgttctcttcaatcggtattcttatttttggcattgttttggtttcaaaatggtatctgagtgtgattttaatgggaattttactagggaggtatgatatatttattggtcctttaggtttccttatctgttacgtgcccatttaagatttttgctcatttttgtattgggtcgttctttttattgatttgtatttcttttatattctgaatattaatcctttgttggttgtgtgtattttcattaaggatcatttcttactagtaaaatttacctggattttgtaattctctttgaggagtgatatcatactactggttaaaatttttaatggttatagtacgattcagattttctatcagttaattttgctaggctatttttttctagtaatttttaacatttcagatatattttcaaattattatttatgatatcctgctaataccttttaatatctatagcatatgtaggcatggtcccttttttattcataatatcacttatttcagactctttgttttccgtcaccattcttgccaaaagtgtcaatttcaaagatggtcttttcaaagaaccgtcttaaaaaaacaattatcttgagtccctgccctgtttgccaccacccttacccctctgttcttatacacacatacacatacataaagacatgtttatgtatgtacattcatatgtgtatatgtaaatataagttacatgtaggatagctgaatatcaattaaagatagtgttcagtataagtaatctgatcctcccttggggaactaaaagagagttaaggagagtaaacagccaaaaaatctgattttttggctgtttaccagttagtggcagaaacagttcttctatcttttcttcctttctctttttatcattattatttttttcttttttggtttctttgagtttattctgttttcttgtttttctagtttctcaagtcacttgcttattgcactaattaccagccttcttttctagtagtattcttttataaatgtttcttgaaacagcatttttaaatgtatcccacaagtttgaatatgtaatgttttcttattgtatttttttaatgtctgatgtgatttgttttttgttagcctcgtgagttacttagaagcgtgtttaattcttaaacattagagactattccttccattttgtcttttttgtttttgtttttctgagacagggtcttgctctgttgcccaggctggagtgcattggcagtcatagcttactgcagccccaaactcctaggctcaagtgatcctcccagctctgcctcccaagtagctgggtctacaggcacatgccatcatgcttggctattttttttgtttggtagagacagggtcttgctctgttgcccaggcttgttttgaactcctggcctcaagtaatcctcttcccttgacctcccaaagtgctgagattacaggtgtgagccactgcacctggctcatatcttcttttggattgtattttctcatctcactttcccttattactagcttggaagttaaaaattgtttctcttcctttagtggttattgtagaaattttaatatatgtttaacttttaaaagtctaaagtaaataaatgccattcactcttactccagacaacataagaacctcagcacgggtaaagccctaacactgcttgttgaatgtgctgttcttgtcagcctgcttttatcttgattgagttaatctaatttatttattatttttgtccaaaaacactcccaggatatgtataatttttttatttctgatgttttgaatttccggtcatccttattgttacaaaccaaccaaagccaatttgcacatggccaactctggtcttttggtaggtattttagtagttattttggtgtgtttgcagattatgacacaagcagacatttaaacagtgagccagcatgcatattttatgtagcctattctttaaatctcatgaaacctcagctttccgttgttgcctaaaatgctcattctaagcagataaaacaatgttccagacacaagattttgtttacccagagtctccagatgtcttagggattaaacctaaggtgttatccctaagggtttaggcctctccagagtcttccgtttcccttatgcaagggtgtattatgtctctaaattaattcaaaaaattcacataactgggatgctatggatttcaccagtgaaatcccattttgctgattaataagccactaccttcatcagtgaaaacctacttcattataattgggaagactttttgtgtaaatcaaagattaatatgacaaaacccccctttctgttgttgttttgttttgttttgtttgagttgaagtctcgctctgtcgcccaggctggagtgcagtggcgcgatctcggctcactgcaagctccgcctcccgggttcacgccattctcctgccccagcctcccgagtagctgggactacaggcgcccgccaccacgcctggctaatattttgtatttttagtagagacggggtttcaccgtgttagccaggatggtctcgatctcctgacctcgtgatccgcccgcctcggcctcccacagtgctgggattacaggcgggagccaccgcgcccggccgacaaaacccttttagcagccatctccgtatatgattcttgtaattaaatgcaaggtgatcaatcttgggatgtgaattggaacgcagactggcctttgggaggtttacaagttctccaggtgtttctaatgtgcgggcacagttgcgaagcattgtgccaccactattacggctactatagttgacccttgaacaacacgagttggaactgcactgctccacttatatgcggatgaaacaaatgcagatttcaaacaaatgcaatcaaacataaaagtatttgtaggatgcaaaacccaagtatacagagggctgacttcctgtaagtgcatagctgacttcaggacttcagtatgtgaggatttgggtacagtatgcgaggattcacgggggactagtcctggaactagtcccccgtgaatgcaaagcttgaggtattttcctgcactactgtgctatctgtgttgagctattaatatttacaagtaaacttctgacatcatttgtcgaatcctccttctagagtgagagacttaaattgatagtattgagagagaaagcattcatactttaagattttcactgctttcttaatctgattcatttcttccttaattttctgaccataagagatgagaagtcagttttttggtatctgctttaaattgctttttctttacatatacttgctttttgtttattctgacaatgataaaggattatgtccctcacagctttttaaagaaatattttatagaggcttaaaggagtatgttattaattaaagtgtcctttatcatcagttctaagacttaccttttccacatttaccatttctgaaattggtggaaatcttgcagttgctggcattttgtcatggccttatctgagtggcgatctttgtgtagtcatatgtaaacctttcctgacacgttttgttaagatcaagaaagtaccagcatgctttcctgagtcttaggatattatgataatcattcagctggttctatgagaagcgtctgaaaacctggccatctttgtgggccattctcttgctctgccttgttcatcttgttctcttttgttaggtattaacaggatcagtctctgaaacaattataaaccatcctctggggttcttaagtgaaaccactagtcccctttccctcactagtcccctttccctcactttggtttgctggctgtctgattcatatttgcaaactgagtagataaggattttcaatcccagcagaaaaaaattgtgtgtattctctatcatttgtttctaaatcacactttaatatgttaatgttttttcctattgtaaacttgttaaacatattttcttgtatatttcctgtgtaatatgatgtatcaagtttttaaaaatttaaactttaaaaactttaaacttgatacataatattgcctgatatatttgcaccataatttgatgaccatgtcagctctcagatatctgttatctctatttttattaggttttgtaaagaaacctgcaatgagtaatctttggacatgaaaagtatttagtttctttcctttggatggattaccagaagtcagattactgagtcagaagaatatgaacgtttctcaagttcttgaaactttctgacagattgtattctgatagaattgtaatttaagaatgattaagactgtttcgtttggggaatttctacctgcttcccctctttcattcctaggttactgtggcagatgccacgtaaaataattatttgaggggtgtaatagatttggagcaggtgagcattatagcagagtaggtagggttcctttaactttttgttagaaaaccggaattgaaggaaaacaacccttattttgacataagaaggcaagctttaatgctttttcatcttaatttttaaaaaaccagaatgttataagaagctcaacaatttatttaaaatacagtgtcaagtattagactagtagtctcttttttaaaataaaagctaatatagagagcttttcctcttttatagtattgtggtttggagtgaacagctgttacgctgcatgtagaagtcagtatatgaattattattttataatttgaaaaagtatcttagaattaacagtggtttgctgagtagattgtaaattaggcacagctttagtcttcacaattctaataaaagctaatggtaaaaataaaatttaatagatgctttaaaaatcaactgctaggatattagttgtgtcaagcaatacatgcatttagcaaacagttattaaacatctgtgctagtaactgtgttagacatcagtgattagtatttttttacggaaagatagttaacacagtatgatgtgacatgaaagagggagaaattaaattcttggagttttctgaaaaaagcaagttgacatttgcataaagtgttgaaggatgtgtaagatgccaagtcagaggaggaggccgttactggggtaaataaatacagtggaagggtgacaatcacaagaaactgtagaaatgcaggaaggtttatgttattattgctgatacttagggtgcatgttaggaaatgagggcaaaatctaaaagacctgtatgatgaatgttcttatgaaaggtttgccaccatgaaacatgccgtgaattaatctattagattattgtggtggtggtggtggtggtagtggatggtggtggctctccttactggaataatgagtaaagtaagatagtgattgggttactttattcagggcttggcataaagataattatgattttataatttaagactctgaaagggatactttcttgccagtgttgggaagaatatcaagaaagaaataggggatataatagttttttaaaaatcttaatgtcgaagagaaggacacagtgggtaaattttggggttatgtaagagtagtgtcaaggttctaaaactgaaaatgagctgagaattaggaaaaattgttagaacagtaaatcgaacaaataaaaacctcagccttttcccaaaaagtttgaaatgtacatgaagcaacagggaggacagtaggagtattattgagtgtatgggaggatgcagtgatcattgaagaaacaagtaatttatatttggtttttgtcttcaatggcaaggaaaattatgctcaaactattgtatacaaagtaaacattactaagagggacttgaaatcaaacagaaaaaacagggtcaatgagcagataattgtgctaaataagtatatttcctagcattttatttcatccagtagtattgagaatataatgaaatcactagcagctcttagtagtttttaaaaaattgtaagaaatgggagtggcagaaaaatggacacaagcaaatataagccttttgaaccaaatgctagaggaatagaagttttcctgtttctagtatataatgagcagtttttgaaatcaactttatctttacatctctggaacatatagaaacatgattgaattttatcatggacctggtatactaaggtgagcatatagtttgcatgcactgaccactagatggtgctcatacagaagggattttgtatgtgtgacattgagggttttctagataaatagcaaatctgtgttcttgtcactcttctcagtcttgtcttatctcaatacagttgtatgttttgaaatttaatagcccacattagaaaagagtaataaaaatgcctgttatattgcatttacgttacattagctttgtagttactttgggtttttggtgggttttttttgtactttagagtttcagtattgcttttcctcttgtcctttacctttttacatttttcactaagattatttagtaaactgggcatggtggtaacctcagctacgtgggtggctgaggcaggagcatggattgagccaaggagttcaagaccagcctgggcaacgtagtgagactccgtctcaaaaacaaacaaataaaagattatttagtatttgcctttgtttctgtacctaaagactgctgggtttgtgactttagaaacgtacacaaataattgagagcctatccagtataaatttttaactttttattaccatttaatattgtaaatattcctcatagtcataaatttttcataatcatgttttgaattacatagtaatccactgaactaatcgtatttagtttactaacttaagctttctctattgtttaggctagaattctatagattatattatcactctgaaaaagaaaacacattacggaaaaaagaatattctttgtatatcatattaagatgttaatagtgattccttttggtggtttagattgcataccatcttttcatccattattttaaataggttttccaggtttttctttaatgaacttaaatttggttttaatggagtttttatctttcatctctgctgtgtaatgagagaggatattctaaagcaaagaacagttggttgccttccgccttccacctcccagtctaatctcatgtgaaacccctcttgtgatttaggtatagattttttgtgtgcatatactgactactggccaatggatgaggtgttcctagatttttgtaggtcatgtaacaggacattttcataaagaagtctttcccaaaacttgaagttgttttcttgatgtgaatggatttggataggaaatttgcatcaagaagtatttcttccctgtacattggggaaatatgggaggcagtgatctgtcaactttagattgtaccctaagttctttggctctgtagggtaaatagatgcacactaagagcctaccattgacccctaagttctctggctctgtaggataaatagatgctcactaagagcctactattgtatgtcttttggtactgtttacagtttgaggtaggagatttgcattcaacagttgtattcagtatcttcatccatactaattcagaataacagaacccatatcagttttctcctccccttgaagttttcatcagacatggatcaaggcacatattttagggccagaccaattaccgtagcatttatataaaccacactaatcaggtctttactaggtacctggtccataacaaaacttgaatttttttctgggaggtttcattttttccttcacaagaggattcttagttacctgtccgcccttagtattttcttacattctctactccgaattagataggatcactctggggccataaattgtcagctactgccggcacagtccttgggaagaagcaccaaactttctggtataatctctgtcacaaaatatcttgccctcaagagtcccacatggctctcacccttactgagcacatgttcacttctcagcagacgcatcatagagacagcattagcatgttttcttgcggagtcaagatttgcagtggacctcaacattgtagtttgacaaaaggctgcatccagttggtgctggtaagcacgtagacaaggaagattctgtcagtccacatccgaaaaaatatccatggctgaggttgggacttacgatatgctcttatcagcttaaaaattagattattcaaccaatagtaaattatcaagtagcgtttttgttcacatattgttttaaaatgaccattgttgtaattactaatatagcacagtgttaagagggcttgcttgggagtttgtggttctcaaacttgaaggtacttaagagtcacttgggaagcattttaaacataaaaattcccaggttccccctgcccgtaaacattttgatggggagaggatacaccaatctgcatatataactagcgccccaggcaattctcaggcgaactattatgttaacctaaatattagatgttagaatatgttcctttagcaatcaggtgatagtatttggtgaaccagagtggtatttatgtagagttggataaaacacatttcactgattataaaacgaaaaatttaccagcgttaattctttctcatttttagaaatttatgaccttgtaatatgaatgtttataaaatactagagagatgatgctgataatttcttgaaagttcttttttatcataaaggttccagaagcaaaatacttgttttagtaattaatctaccttgagacccagttgttaatcattaaaaaccaatacattacataaaatgataaaggaaaatccatttgtaatgaagcgctatcgttagatagtcagagtttaatgtaggcagcacctttgaacaacttagagccagtgccagataatgtgtaagatctgcctggtgtagaaatttggatatgaatgacaaagattcttttagtgaaatcattttaacagtcagaactatttgcagagagaatcctcttatatgttttaattcagttcatatttataatttatataagcagtgaaggtgccattggattttactacagactgtggttgaaacttggtaatccagggtttttccacgcagtgcattaaatcaggcagccccacagggtcttggtagtccagtgtttatagcatccttctttacctgctaatcgacctcacttcctggatttcaatccatctagttatcagctaacaaaagaacagcttttggttcctgcagacgctggtgaaaaaataatcatgagaaagaaatccaccttatgtcgtcttttttgtctgcaaaaataaactcagccatcatacagctaacaggtacagagggaagatacgagctctttcataggaagaaatcactgagaaaatgagcatcatttctcaaggtttttattttcactgatctacaagtgatgctgctgtaattgtagctgcagtttttaccgatcattcaccactcagcagctggtagagaagtaagcctgcttggcaaccacctgcagggctgcagagatgaattacattttcggaaacaacacacttctatactctcgcggcagtcgaggaggcaatactagctctagccatggctcagcaggcccaaagcagaaacactgggcaaaaaagggctcgtcagatgaactgcaagctgagccagaaccttcacgctggcagcagatagttgcatttttcactcgaagacacagctttattgactgcatctcggtagccaccagctccacccaggtaacataccacttgttgaaattattttcaatctatttctgtttacgtttgctctgtaaaaatgtcttaatatagattttttatttaaagaatagccttgaaaccttggatgtgtagaaatgtatgttttctgtccatccgtgtaggtctttagcacaaaagggggaacaagaaatatttttccttatgctcttatgtaataccaaacaaaatagcctcagattcaattgaatgacttttctaaaaatataagcccattgatacataaaatatgaattaataatgctcatctcctttttagactgtgctaaatgctgtagagtatgatgtctgaccaaagaaaatgctgatttgtttagtttttgtatgttattagataaccttagggagactgttacagtaaagaaacagaagatactttgaaatattttcatttttcagtgttttgaaaatagattcaatttaatataattggctagtattatatatactgacatcttagctatattatggcttattcaagggatttaatgaatcgttttttgtaaatattatttatctagcttaatttgaaattaagtgaacttgtgcaattacacagtcatggaatattttttcacatagtcaaatcacaatttaaagagatgagcaaatactaaaagtctctcaaaattaaaaaaaatcacataacaccactttttgaggaaatgagctattgtctatgggaggaaaaataaagaaaaattaataattgtttgaaatacctattgtttgctacaagggtggtttgaggaaatattcatatttctaaatatttttaagcagtcagttcaactttagtaaaaataaaaggacgagaaatggtctaaaaacaagttgagaatgcatttgtcctctgacatcagtgatatttaaattaggaaaatacatacatacacattccttaggaccttttaaaataaattcccttaaagctgtcttttaaagaaaataatagaagcagctcaataaatataaactataactgtcaacagttctatatttctttatatgttttttataaatttctttactgtttttggttactagaattgtcttttaatggtgttgatttaaaataacatcagctttcttaagtaagaaattctacttacttttctcaaatatttgggagaaatggaattacctaggaagggggagtcattatgtaggcattgaggttaagttacaatcaaaacttattgaatgggcaacgattgatttaactcttaaattgaatactgccccaagaattttactaaccttattttgactgcaattacatatatcacgaaaggatgcaaagactaaaggttgacaatgttattcattgtagattaatactagatgatattttccattgtcaacaagacagatatctttagaactttttatatatatatatggtttatgtaaatgcacacccttctatatatgtatgcacagataacactagcattgatatatctgtcactcggtttattaaaagcaggcaaatgaaaagacaggaaaagtagttcatgtataaagtgttgaaaccacagagttacgttatagccgcttgggagtaggagcagaacgttgctgtgattgcgccagaagagagtcatgacccctgttcgcagtcagctctgcaaagccattttacatgacagcccccacccagtttggttcagagcattcctgtatgctagtatatgagttattaatagtttttatttctttcagacctctttcctgattctcatcttgtctttttcattacctttctattttatttctagaaataggagtattagggtagaggttttagcttctgtttttcttgcactggagtaccaacattttgtttttcattttatacatttttgtaactgatacattggatagtttatatatcttaatttttttataacttactggagttgatttgacaagttaaaatataatgggactgaaaaataacttgagatataattggatcttacttgatactagaatacttttttaaattgcacttactgactcatggctggcagctttcttttgcagcactaagggatttattgttagaaacaacgtagattgaaatttcatacttagagcatataatatatacctatgaatataataaggtcatagtgttttgtactgcgattggtaaataacagaggtctcttatttcactgatgtcaaaaatactctaagatttgacagaaagattaactttgaatctaattccatatgactaagccacatgatactttttgcagattggagagttgttataaatcaagttctattagtatgaaaactatctggtttagtatcccccccaaatacagtatgaaaagtatctgatttaatatccccccaaatatacacaatacataaaaagaacctgtacttattttacagattcatttaaattgcttgtctgctggaggtattcatgttcataactaagattatgtgccattttctactatgatactggaactcaggaggaagtcattaatgttttttgaatgataaggaaactgagtggttataaacttttgcaagacacctagcttctcagttagggtttggcatgtagttggtgttaataaatgcttatagaattaattaatttttattccattcacctcaaatgttatctcctggccttccaaaatatgacacctaatctaatacctcttcagtacctgtattgattggatcttctctcttccctcacaagtgtctttggtttttcacagcagcccatctccttttccactgccttttcttcccctccattcttcatactatcctccagtcacactgccccgattcccctgatttcctcacccctttcagtccccactcagtagtgataaccaaatagcttacacactgtctctcagttttatcatttcattgtatctcattttacattgtgggttttttgagaggttgttttattttttaatgttaaataaaaatgagtttcttatgaattacattggtgaaactttttcagtttgaggcttcatagtgtttttgtccttaatttcaaacgattagtatagaaaaagttctctatgcattgcgaagccctccttggttccgcaccctcagcgtccctcctattcttgtgttgagggtcactcaataatcggccccgtcctacttagcatacacagtcctgttccaatctgggaccagtttttatattcagcagggttttatagaactccagcacagtgctgctagactttacttgattaacgcctaggtgaaaagttttatttacttagtgatatcgacgtttattaatgtcagtagtaatcatatgaactttaaataactgtgaagtgttcagtcattttgaatgtgtgtatagcagctattcatacattttggactacttgaaaatctcaacatatagagcactataaatactcaaaaagcccccccccccccaaaaaaaaaacacaacatgccaaattaagctgagagcagcaaagctgtattcttaggaatatggaacagacatgaaaacttgtcagaattgaaatagaataataaagttttcttaaagagtaaatattagctgagttgaataatctgcttagaggaaaaaccctgtcctaagtcaaaaatataggaaaacattgttcaagtgcctgtgtggaaaaatatttaggctaatttgtacactttaaaaaatattgtttgtctgaaacagatgccttctgagttatagaggatttaatttttagagctatgcattggatatattgtccaatagagagaataacagtatcagtgtcattgagtcacttctaccaaataatttaatgtatatattaataaagtacttaggacagcatctgacacagagtaagtgctacattagagttaggtgcccctgttagcttatttttatatcatttaactctaatagtatatgaacaaattcagatatagattattaggaattattgcacctaggatagcgcagtacattcaaacattcagtaaatattgttgactgattaagttaatttgtaagtacaagccatccactttttttaagaaccagagatctcaacacctttaattacaggatttaagggaggtgccccaaagagcctttgaaattcttgatgagactaccagttttttgacctttcctcccctcctagcactcccttctacaaattggtgaaaaccagtcacgtgtagatgactaaatttaagtgattatccacttggtaccaagctcccctaagcatcccccaaacatatcatgaggactatttttagatcctaaatcccttttagcctgtcaccacagaaagtccagaccatccggattgcagctctgccttctctataccaactcgcagactgcacgttaaacttccaatacctgattcctggtcttattctcaaataaataatcttgctttgtgttccagcctgctaaaataaatgaactgtgtgcctaaagcttacccatattcacttctgtactagatcgtagtccctttggttgttcaagaacttctgaaatccctttctctcttcactgcatcatctgtcttgcctctgtactgcccctagacttgcctctataagtcctatcaggatgtacacctgctataatatctttcattaaaacaaccatccaaaaaaccctcgttgtgtgagtgtagattatcaaatccagtggccagttctcagtgttcattttacttgaccctacaacaactgttaacacaattgattactccctcctctaaattcttttttctcctttgactcgtggatagtactgctcttttaatattctaccagcctcattttcctttatagtatcctcctttttcctactgctaaatgttcaaatgtctcagggctcagtctttgaactctctttttatactcacatttcaggtgatcgcatctagtcctatgcccttaaataccatcagtatttctctttattccagagttaatccctgtacattagacttttatatctaactttctactcagtatctccacttcggttaagcatctgaaaggtaacatattaaaaagagaatttctagttttattggtctcaatcttctttattcagtatgccattcactaagatgctgaagacaaaaacccttaaaattatcttttattccttttttctttgctccgtatccagtctgatgccaaatcctgttggctttttattcaagatatatttatgatttggccacttttcaacacttctgcaactactgattcaataatatgttgcctgaactacagcagtagacatctaacttctctcgttaatattttttgcttcctctaaggtagcaccccttcactccagacattactctgtcttcttacctgattctttattatacattttttactgtctttttacttgactgtcagctccatgtgggtgggatttttctgttatgtttattgttgtatcctcagtttctgtgacagtggctggcacactgtagataaccagaaaatatttgttgaatgagtgaagagacagggacatacgaacttgtgctaaggagggcccaagcaggtgtgtttgtctgtcttttcccttagactttctgtgaagcgcgcatcacactttatttagcattgtaatagttctctaactgatgattcttacttgccctctgagaagaaatacacacaaggaaatgaggtagggagagaagagaattcaatttcctcaaaactgggataactatataactcagaccaaactaggatactttaatgaaaagagggaatcattaataattaaagtgagacaacaggcataaatacagacttcccaagtaaatagaggcatatggggtcactctgttataaccatttattttctgactattcccaccaggcaacaggtctgaaattcacaccaagacatctccatcttggaccatcctagattgattgacctaaccgtgttatcggtacataccacattcattttgtctcatgtgtaatgataattgtgttttgataaaatattttttcttcatctccaaggaatggaattgttcatattcattagtgtagtgcttttgtactaaaaagtagactacgtatagggtaggtagacaatcttcttaaactgctttgaaaatactgactctaattgataggttattttccagagaaattggtggaaatagtctcctttggtattgactccccaaacattcacagtttggatggaaacgctgttgtactggctgtgagatgctgacccttggcagacacatttgtttcttaattttctactcaaaaggctactaactttgcgaaattaatatgatgactcagacttggaaatcaattgttccccctttgacacaaaaaatattgtaggatctattttatgtttctgtttttctggaaacttttacagtgcacctacatgtactgactcaaaaattggttcttaaacactgtttcaacacatttttatcatttgtacaataaataaaaataaataaaaaataatataaaaaataaaaataaaatttatatcatttgttcaataggacactctagaaaagcatagagatgaagattaaaccaaaagtagttggttacaatggttatataagcttttttaaattacaaaattgaccatacgatccagcagttgtactccttggtatttgcccaaatgaattgaaagcttacatccacccaaaaacctgtacagagatgtttataacagctgtgttcataattgccaaaacctagaagcaaccaacatattcctcagtgtgtgcatggataaagtgtggtgcattcagacaatggaatatcacccagcactaaaagaaatgagctatcaagccatgaaaagacatggaggaaccttaaatgaatattaccaggtgaaagaagccaacctgaaaaggatacacacccttgtttccaactagatgacgttctggaaaaggcaaaactatggaaacaataaaaagatcagtggttgccaggggttaggtgagagggataaataatagagcacagaggatttttaggacagtaaagccattctgtatgatactataatggcggaaacgtcattaaacacatgtcaaaacccatggaatatccagcccccacagtcaactctcatgtaaattatggactttgtgatgtggcagtgtgggctcattgattgtaacaaatgtacattagaaatgcaggggtgttgattatggatagtttatgtgtgtgagcagggggcatatgggaactaaaactgctctaaaaaaatatataaagtctattaaaaactataaaattggtgtcttaatgtagattagattggcttagcttgaagacatttgaaatttatgatataaggtctttatagttaggaaatgtgttttattcttctttgtagcttctgtatagtgtcttgattgtttagatggcgtttctgtcaaggatagataggcaaaaagaagtttcacaggctataatttatatattctaaatatattcagagaagttttaaagttaacctttaaaataatgtgttaataacagtgctgaaaagtgactgaaccatgcttatgggatcagggcaagtcagcctgagcaacatttttctcctgtattttcaagtaatgtttgtttgcatgagaattgtacttcatacctcttatcacgactctaattcagtagtcatttggataatgattttgtttaatgtcagccactaaactgtaagtttcacaagagctgatgctacagggtgtgtggttttttcccttggtatccccagagcctcgcatggagaatgcacttgataaatatttgttgaatgaataaacagatgttatacaggtgttaatttttatttaatctgctgttgacgaagtggaagtttggaacttctaaatattgttggatcactgtaaatttcccaagccatttttatgtaacactatggcttaaaaactagcaagtctatgttaccagattttgtaaagttgtgaatttcagaagtaattcagatccttctgtgaaaaaattgtgaagcatttatactcttacatatctgaagaacttaaatttttatcatgaaaattttacttagtatcagtctctttaaataaattttcttaaattattccttgtacttcctggcactattatttagataacatttccagccctccatttttatagcaaagtttagaattttgataaaggtaaaaatagttgttcagactatgtagagaacagtagcctacagttaccaccttttaaagaaaactttaaaccaactgatgtggtaattttaacaggcgtatgcaaatacaaaccaactggcagtgccacctgggagcagtggaattttatagaagcctatacacgcaacttgcccctccaggcatttatttaaaagattttccctcctcacttcgtaacaggagcacttcctattcattctttttcctttaagccccaatttggtagcatttctgaacagtattttcagtatctgtgaaatcaaaactctgacttcttgactggagcagctttgaaatgtgaagaagttacagctgtgacagagtggaaccaaatgattgctttacaatttgtgttgttttgttgttctgagaaaaagaattggggattataacctggtgtttaattatttgttaatttttttttaacagccacgttcaagagcaataaactggcatttaaattaaaacagatcccaccctcatttatctgtatataaatctgactaatcttggtaggatgatctgatgtatcaaagggttataaatttggaaagaaatcagttggaaagtattttgtaagatagaaagaaaacaaacaagatgcatatcaatattaagaattaattgctttagccaaactaagtaccatagcaggattttgaagggagaacaaagaaaagagaataaaaatcatatcattttaatcactttttttccaaactggaaggctatattcagtatagaggcaaaattttttcagttgtaagagcacagctttattatatagactttttaattaaagatattttaaagaactgtaggtgaaacttgaaatttccatatgtatatcttgtttccttgttttttaaattgtcgcttccatggtttttggggagagagaattggcttatttttattgtagactaagaattgcaacagaattaaaccatttatagttagtaaaagttaacttaggtgtcttaaagccattttctattttcttcattgacttatttagccttttctttctccttttttaaaagcagctaaagcaggagtcagcaagctacaatctgtaggccaaatgtagcctgccacctgtttttgtaaataaatgttttgttttgtttttgagacagagtctcactgtgtcgcccaggctggagtgcagtggcgcgatctcagcccactgcaatttccacctcccgggttcaagtgattcttatgccccagcctcctaagtagctgggattacagatgtgcaccaccatacctgactgactgggtttcgccatgttggccaggctggtcttgaactactgccctcatgtgatctgcctgcctcggcctcccaaagtgttgggattattacaggcatgagccaccatgcctggcttgtaaataaagttttattggaacacagccatgcctatttgtgtattgtgtatgactacttttgaactacaatagcagtgttggatagttgcaacaattactgcatggtccataacgcttctttttttgtcatttccaaaaatgtttgctaacccctgatctaaggattgatgcagtatgtatttctttttacaggtaatatatattgtctttgcagtaaaatgtagtggtaacaataaagacaaaatctctttttgaactattttaaagagataagtaaagagtactgggtaagtgtaccatctttagaggatgatgacctggatttaaatttatattctgccatatcgcctgtgccaccttgggcaaattacctccatgcggagtctgtctcctcatctgtagaaaatggggatgaaagtgttatctttttcaaaatttaatgagaattaaatgagacaatatgtgcaaagcacttattataatacattaattacatcagtgaggtcatcatcatctttatcaactacccttttatccaccactaccaccgccaccaccatcattttcatttcaacaaaatattctgacctttaaatgaggaatctagagatacggagaagcaaccatgttttagctagagggttggtaactttaatagggtgcagccagggaaacagaaaccacagcaactaacaataaaaatacactacatgggattggttagatgagtattggagaactggaaaggcaaaatgagaatgccaaggtaaaatcgagactaacttacagaagtagctacctgtaggggaacaaaggacccaagctgaaattagtggaacctcagaggaagggcaccatggattttaaatatgagccctcagtaagaagttgtacttcctaatgcagtttgaatagaaaagcgatgaaaatattttaagcaaatatgcttgaccaagacatgtttattttcaaatgggacattattaggcaattcattattgctagatagagaacaacatgaaactggcaattttttacattttgaaacttctgttctaaggttatcaaactgtaaaacatcttgaacaccttctgattggtggtggctgcccagaaacacagaaataaccttttagcaatgtctactatgtatattgcatgaaagtgggtaggggaaggaagactgtacctacccaatctattgcccaagtcattttagagtgctgattaagttgatttcttttgacagtcgcatggttttattcattcaacaaatatatattaaatacttcctgtgtgcacttttctaggcactgggcatataggagtgaacagaacagaaatctgctctaagtagaagaagacagataataaatataattatccaaaatgcagtcacatgtcagttaatgggaatacggtgtatatttatttttgtatataattatacagaagataaaaagtatagtataataaatatacaaaccagtaaaatagttgttaattatcattctgaagtattatataccgtacataattatatgtattatacttctgtacaactggcagtgaggtatatttgtttacgccagcgtcaccacaaatgtaatacattatactgcagcattacaatggctatgacatcactaggcagtagaaatttttcagctccattataattttatacatgtggaccatcattaaccaaaatgttgatatgtgacgtatgagtgtatatggtattctggaggaaaaataaaggaaagaaacaatagaaaatgtgtgtatttgtgtgggggaaatagaagaaggcaacttgagagagtgataacagggacctgaatccttacagacttgtagagggtgaataatacaaggcaaatctgattactgggaagcattaagggcccattttaggttattagtcatgaagtctgtggttttgcttatttctctagccacattctgataaaaatcaggtaaaaaagcacattattgcatttggtaattttatccccatttgtcaattatgtaaccatatattgaagttttagtgtctgtttactttgaaatgtttcgtgtttggctcatcctttactaggacaagattgtcatctgaatgctgatagaatactgtcttttcataatggagggatgagaaaccttaactgaatattgtgagtctcacaggtagagatagattcatgaactagatgatctgtctgtgtgaactaacacacttgtactcatgtttctgtaatggaattaattgctagatctgttttcctatttaccttgttttgttttaaatttaatgattttaatacccttagtgatttgtttaaaaatgtgtttagttttataattgtttgcttgtgagatagttatgacatggaagtcatatgaagctggttcaaataacatattgttggttttttactataccggcttatgtgaaagatacctgtttgcagtgacaggaccaaaggacatttgaataaaaaaacagatttaaaccataaaaatcagctttttctgaaggtactgggcccccgttgagtacagtgattcctaagcagagtttttataaatctactgtgctatattttatccttctataaacattcaaaaggcttgcagttttttttagtttctctcttacttttaaatagcttctttgacatttaatcagagaaacatgccacattacagcataatacatctttaaacaaagaaccaaagaacttagattaggaatattaattatgccatacaaaaccaaaataagatccttactaacccacagtgacacgacagttgatacttttccttgccatctaagatattggtaccaaaagatttgctaattcatatatctcattttctctaaaaatatggaagtgtgcatacaaaaattaactcaagatagattaaagacttaaatgtgaaacccaaagctataagacaacctaagaagacaacctaggcagtaccattctggatataggaacaggcaaagggttcatcatgaagacaccatgcaattgcaacaaaagcaaacattgacaagtgggatctaattaaagagcttctgcacagcaaaggaagctgtcaacagagtgaacagataacctacagaatggaagaaaatttttgcaaactgtgcatctgaaaaaggtctaatatccggcgtctataaggaacttcaagaaatttacaagagaaaaacagtcctattaaaagagagtaaaggacgtaaacagacactgttcaaaagtggccaacagtcatgaaaaagagcttagcgtcactgatcattagagaaatgcaaatcaaagccacgagataccatctcacaccattcagaatggctactttaaaaaaaatcaaaacaagagatgctggcaagtttgtggagaaaaaggaacacttatacactgttgatgagagtgtaaattagttcaaccattatggaagacaatgtggtggttcctcagagacctaaaaacagaaatacaattcaacccagcaatcctattactgggtgtatactcaaaggaatataaattgttctgttataaagacatgaacgcttaggttcattgcagcactattcacagtagcaaagacatgcagtcaacctaaatgcccatcaatggtagactggataaagaaaatgtggcacatacacaccacggaatactatgcaacaataaaaatgaatgagatcttgtcctttgcagaaacatgggtggagctggagggcgtcatcgttagcaaactaatgcaggaacaaaaaatcaaataccgcatgttctcgcttataagtgggagctaagtgatgagaacaggtggacgcatagagcggaacaacacactggggccggtgtgaggggtggagagtacgaggagggagaagatccggaaaaataactaaatgggtactattcttaatatgtgggtgatgaaataatctgtacaacaaatcccagtgacacaagtttacctgtgtaacaagcttgcacatgtacccctgaacttaaaataaaagttgaattaaaaagatacagtagtgaatctttgtgtatattcttaggtcagtttacccccttcatataacgtgttaatgtaaaatataagcattattagctatcagatagtatgttcatttatcgtctttggagttgcatcttatgctatgaaagtcattttaataaattagtgagaaaatgtttttaaatatatttagatagccttgcaactcttttatacctgagtcgaactcttgtataaaagatcatttttagtggctattgtgagtgttaataggccttcctcactccagacttctcatcagtcaccaagatataccaactctacattcaaaatgtgtcttgatttgactgctcatatgtccattaccaccattcagtttaagccaccaataacctttcagctggattattacagtaaactcctaattgtcccttctgtctcttcctgtattaatcagggttcatatgcacataatgaaaaccacttgagtgctttaagcagaaaaggctttaataaaagtagtaggctcattcaatatacatttatttttcaatgaatcaaagtgagggagggcggtacatggtcataaatgtggatgtgcagaacagatgcaaatggctgtatgtagtgagtgttcagaccactttatgaaaatctgttttaagtgctgcttttataattttaagatcttaaattagatttaaaatataaagctatagagaaaattaatctctaaaaacaaatcactttaaacatttgttcagatagccatccatttgatactggtttttaaaaggtactttaaaatatgtacaatatatccaattttgtagaaatttacaatttccttgtgacggtgttaatatcatagcctctgttgccatggaaacaagtctctgaaggcagcctcagaggctaatgattccatgatgttgctgtggatagaaacaactgagaccgttgctagtcacatggtcaagattttttttaaaacaacaacagaaaaactttagatctcatcttattgagtgatacaaatggagcaaaacaaggatgatggcataacagtcactgtctaatgaaatagttatataagatttttcaagtttaaaatgccatactgaattctgtaataaccaaaatataatggttactgtatattgctgcttcattatttatgttagaatcttaagtttgacattttctaatttagaatcttatacagctccccggagttttaccctgctctaaaacctttgcccaaagcatcctgtgatcagatctgatatctttgctgttcctcatcagtcagccttcatttgattattatttgtttagagctgcatttttgtttcaagtgaactaaatgaattactttgttgttctgtaattgtttgttaccagaattggttatcagttgtgattagggaattgtgtgtgttgatgcgtcgttgactttctcagcggtgttggccttaaggaagaggcaggggcctatgttcttcaaggaacttggtcagtgccctgtagagagggggatgggttaagatgctgtaaactgggaatttttttaaatggtattcacatcctcgtctaaagaaggtgattctagaagaggctcagagacagagggttacaagtgggattaaaatgtaacattaaaggattcatggtttatcataaagggttttggagagcacctgcccagtggagaaaatttttgtgctttgctttgaaatttgacataagcatgtacttttgtcttattttggctatcaaagtagattattaatcagctattatcctattgttagggctggagactgttaataagaaaacatattacatttgtgacattttcaaacacttaaaaaataaactttagtgtccttaaaagaaccaaaccaaaacaaaaaacaacagaggcacaaggaagcttttagaggtgatagatacgtttgttactttgattatggcagtggcttcatagatgtatgcctatgtgcaaactcatcaaattctataccttaaatatgtgcagttttttatatcacttctacctcagtaaagttgtttttaaactagaataaaattgaattaaaaataacgttagactttcatgactttgacacttttgatgactgcagctagttactttgtaatgtatcactcaatttgggtttgtctgatgtttaatgattagattcaagttatatacctttggtagaaatatcctggaagtattgtactctcattacattttatcacatgatatatgattttgatttttcccgttactggtggtgttaactttgatcacttgattcagatattgtctgcagatttctccactgtcattaatgctttgaaaggagacacttttgtatgagtatatcccattcatccactggaatggacgtttcacttggcaacaggaagttttaatattcattaatatttcttgaatgaattactctattactatgatggctgccaaatgatgattttataattccatcattacatttttagttagcattttgttgtaagaaaatgctcttatcttcatttatttattgatgtatttatttatatcagtatgggctcccagattcctattttattcagtggatgttatgccattgttatcattgagttacagattgttcccagtctggccagtggcagcccttcaagccaacttctgtgtcctttgtcatcctctttgagtacttcccttatcttctggtacagcaagatgtctacacacatcttgtgcttgctgagctctagcactggagtcagccatttcttcaaagacccatggtttggttttgtttggttttgtgttgtggtttttttccccccgagacggagtttcgctcttattgcccaggccggagtggaatggcgtgatcttggctcactgcaacctctgcctcctgggttcaaagcgattctcttggctcagcctcccaagtagctgagattacaggtgcccgccaccatgtccagctaattttttgtatttttagtagagacagaatttcatcatgttggccaggctggtctcaaactcctgacctcagatgatccgcccacctccgcctcccaaagtgttgggattacaggcatgagcctccgtgcccggccatgttgtgttgttttaaattgcagaatgagtatttagaaatcaagatttggatgccaggtgtattcgtgctgttgagctgttagctgcatccaggtcctcatagttagcagacctatgcacatatatacacacacatttatgtctatatttatttttgtatttatctatatatattgaaaactgtttataccaatacctccaattttagtgtaacaccataggtctcatgctaattttctatcttttcatatttataactgccttttctgacgcaaggaaacctgctgtcagtatccttcatgtatttatttattggaccagaatgccctgtatataagcaatctcctgtcatcattgctgccctagttggacgcccttctcacgctgctcaggctccagaagatcccatttagtccactgacagcacaaaaccttatgccagactgcagctactgcctcatagatgctatctgtctcacttgggttccaaccacacacaggctgccgccacggctttgtccatgtagacaccctcgtcaccatgctgaggctccagcaccctttgccaggctattgcctcccttccactccctgcctacagatgctttcctcaccctgcgtgagcttcagcaacatgcactttcctattcaggaggtcatctgcaccaaggttgtgatgatactctaccatatcatcctctagaagccttatattgtttacttctctcaattatgtcagcaaaccagctgaaattaatcttatgtatagtttaagggtaggaatcagtatttgtttgatttttccatgtgtatatccacttgatccaagcacagttcttacaaaaccaccacgcttttcttatgcattcataaatcagaagtcagaacctatgggttttcaaacattcttagaaggccatgtaaatattgcagtgagtatcagttacgattgttattaattttgagctcataatgtggaattcagaattttttttctccaggaacaatatataaatggtgattggagtcccgagctaaacccacggaggctttattcgtagtatacttttttattgtgttaaagtttacatcaagtttaccattttagccatttgttaatgtacaattcagtggcattaagtacattcacagtgttgtgcaagtatcatcactctcaatcttcagaacttttcatcatcccagactgggaacattgaaaagaaagagaaaacacaaaatccaatgctttaaaaatctctttctacaggaaataataaatccaggtaacaggagtccagagtgtgaaatacattttcagtttgttttctagagaatgacacttaaagatcataataattgtttttctgttaatattcacaatggatctcccatccttccccttgcatttatattaataacgccactgtgtattccttgtcaacaactggaaaagtataattcagaataaagaagcagcgatagagaaaggcactcatgatcccaccccagagattaatttttcagacatttctttccattttttatgtgtttcatcttcccttttttacttaatgttttgtcataagcaatgtcccatataatttataaactgttcgtactgataattttaaatttctgtatgataatctcatataattttcttttctttctttctttctttttttgagatagtcttgctctgttgcccaggctggagtacagtggcgtgatctcactgctcactgcaacttccacctgctgggttcaagcagttctcctgactcaccctcccgagtagctgggactacaggcatgcaccaccgcacctagctaatctttgtattttttttcttttttttttttttttagtagagacggggttttgccatgttgaccaggctggtctcgaactcctaaactcaggtgatctgcctgccgcgtcctccgaaagtgctaggattacaggcatgagccaccatgcccagcctcaatctcatagagttttcattttttacttaacaattctgacacctttgggtatttcaaatattccacgatttaccaaatagaagcagtgttcaaaagactatcttaaaaccttagaacaccttatgggagtaccttaaaacataggcttttaaaattatttccttagggtagatttctagaattactaagtcaaagagtttagacttttttttgaggagggggagacagagtctcactctgttgcccaggctggagtgcaatggcgcaatctaggctcaccgcaacctccaccttccaggctctagcaattctcctgtctcagcctcccaagtagctgggattacacgcatgggccaccacacccggctaatttttgtattttttttttttagtagagatggagtttcaccatgttggccaggctggtcttgaactcttgacctcgcgatccacccgcatcggcctcccaaagtgctgagattacaggtgtgaaccactgtgcctggccaagtttagacatttttaaagctctagatatttactgccaaattactttccctaaagtttgtgtgaatttgtatatccaacagcagtgtgagaggaccagttttcatgcatttttaaaagcttttttggaatattttttattggtaaaatatgtataacttactagtcttttaagtggaatcatgcaatatttatccttttgtgtctggctaatttcacttaatgttttaaaggctcatccatcttctagcatgattaagaattttattcctagggctgggtgcagtggctcacacctgtaatctcaacactttggaaggccaaggtgggtggatcacaaggtcaggagttcaagaccagcctggccaagatggtaaaaccctgtctctactaaaaatacaaaaaaaaaaaaaaaaaaaaaaatagctgagcatggtggcaggtgcctgtcatcccagctacttgggaggctgaggcagagaattgcttgaacccgggaggcggacgttacagtgagctgagattgcaccactgcactccagcctgggcaacagagcgagactccatctcaaaaaaaaaaaaaaaatcatacccattgtgtgtatattatcacgttttgtgtatccgttcatctcctgatagacacgtggtttctttccgccttttgactgttgtgtgtgatgctgcattgaacattggcatacaagtgtccaagtccttgctctcacttttgggaatatgcctacccagtgcatatttacctacccaattgctagatcagatgctgattctatggttggtttttaagaaaccactaaaagtttcctcagaagctgtaccattttacatttcccaccagcattgtaccagagttccagtttctccacatccttgccaccacttgttactttgttttttgttttgttttaattagacacttcccttgtagtggtgaagtaatctctcattatagcttttatttgtattaccctaaggactaatgatgtcgagcatcttttcgtgtgctaattggccacttgtataccttctttgcagaaattattcaagctcttcacacattcattaattgggttgtttctctttgtgttgttgcgttgtaagagtctttaaatgttctggatattaaacccttatcaggtgtatgatttgcaaataccttctcccattgtgtaggctgtcttttcacttgcttggtaatgccctttggtgcacaaaaggttttaattctgttagagtctaattgatttttttctttcatcatttatgatttctaaggttccattaccaaatccacggtcacaaagattaaccctatgttctcttgtaagagttttatgttttcaaatctcatatttaggttgttaatcaattttgagttaatttttatatataatgtgagatgggggtctatagaccttcatcttttgcatgtggatatccagttgtctcagcaccattgttgaagagactccatacattgttaataaatcttaatttgactaatttggtaggcagaaaagatcattgccattttattttgcatttatgaatgaagataagccctttttttagtctggcaatttgttcttcctgttttaaggcctgttaaggcaggctgtcctcatctgcttgattttagtgtttttcttacatatataagatattttatttatatagcaaatgggtcttattactaaacaactttcctgtgttccagtttcatccttttaaaaataacaagccagataaaacagtgaactttttagtttaatttataccaggttctctctacgttgttttttcatttttgccagatatgtctggcatgtaatagacaatcaatgttagttgaattaattacaggcatgttgaggcaagttattactgttcttgataacagaagttagtatcacggatttgtaaactctctttgtctgcctgattgggctaataaaattacttttagttttctgaatgcatagaggaaagtagtgagatgtattctgagtgctagaaaaaatattttgcagtctgtctatgaagcaagtgtcttatctcccagagaaggaaggaatattgtaaatgataatcttttattattatgatttaagcatctaaagagtaggcattcattttattacagaatcattaaaattattatgggggtataactttctaaaacaatttctagagaatattttctcatttatattagtgtaatgtattaatgtttttcctgttgcatagttatttctgaaaactataatttatctttatggcacagctttttgttatgtgtttcccttttattttggtgtttttcctgattttttgtcattgatgatttttagccaacagaagctgttcttccctctcctcccactgtccctgtgatccctgtcctgccagtccctgctgagaatactgtcatcctacccaccataccacaggtttttattagtttcttttttctttataaaaatttcatttgcttttaatgtttcatttgtgttcttttttaaaactgtttgagctgttttttgtaatttggtaatttactttgggcttcagttagtagttttagggacttaaacatttgggatttaatataagtggagtcaggatttgccattttattaggttgtctgtgaaatgggacacaatgaacttcataatattgaaccttagatttgttttcatgcctttgtacttagaaatctgcttaaaacagtttttaaacatttttactttagaacactttattcttctaaagttagtaaaaatcattgtactcctgatcttgtaccaatgtatcattttatttaacactttgtttcctgttatatatttatcttctttggaaatattcattcttatgttatttgattagataacacacttcacatttattaggtaaaaataatagccaacatatctgggagtatatgggaatgctctgtgctatcttcacaacttttctgtaaatctgttgtaaaattttacttttaaaaaattatgtgtaacagtttaaaaataatagccaaatgtgagagagtctaatcatttttagtttttcaaagctttactacttccaaggggtggcttgagacattaactgcccttccaacagttatccaaagtcaaaataatggtagtggtattaaagataataataaagatctttggtgtgaaagatcacgatctcatttaaagtgtaaataaatgaacccatagatttttttttgccattattgatctgtagcctaaaatctgggtaaacatatgtttgctgtgtaaacagtttcaaaataagctccattggggaaaaaatgatatatcagctgtgattattcacatctcagtgcccttcccctctcctaaaaagtgaagtcagtgggaacatccatacaaccaaggattctaggggaaattacagtgttacaatgacttcagccttactgtaataagactgaattgtaatcattataataatactgctactatataatttttgattatgaaaataattaaaaattaagtcataaaaccaacaatgaatagatgaatccaaatggatattctctctatattgcaggaaaaaaattgaatttataaataaaatataattctgagcaaacagtttaagggttattatggcatcataataatgtaacatctttccaaatatatagagtttattagtacagttttttttttttttaatagaattgaaagtttattttactcttctcacttcagtcaattttttggtgttaaaatagttttctggaatcctttgagaatttgtaccagtctctttatattcatttgggagcctgtcttttcctattcagaattctctcatttatttactccaagcaaccctaacttagcatcccactgcatttgaaaattgttgagatcttgcatagtcttataaaaatacacgttttaaagtcagaatgacctggggttggaattccagtcctaccacttaacctgtgtaactgcacacttcacttaaccacagcgcacttccatttactcatctgtaacactgaagatagacaggagtactaacttgaggcgctttacagtgatggagaggatgcttaatgcacgtcaggtactggcacataatcttagccgcccatatttttagtgttatctcatatttctctgagacagcaaactaaggaacaagttttgttttgtttttttaaatgaggatatttattgaggatacacacaaaaaagacctatttattctgcatagcttcactttaggttttaaatacactacggaagttcatgaaagatagttttaccatttttgttgtgttatgtgagaagccaatgagtgcacctcattttccagaataagtgtgttcctaattagtgaagtacaatgtgtacattataaaattaaaataatggactaaaatatccgtccccaagtaaaatttaaaatacatactaacatataacccaatttcaacatattaagtgaatatgtattcttaaaagatccactactttacatttagatgcgttaggatgtattagaaataaaaacagaagaaaagatttagaatctagtctgtctttgccactcaagctagttaccctctctgagttttatacccccttcatctattaaaatggggggtaacgccaacctgactcctttaaaatgagtttgagagtcaggcaaattagaaagatacatagatgaaaactttttaaaaagtatatagtctttcatgatttgtagaacacttttatacttttcagagtactttcacattgatcatattgtttgtactttatgaaagtcttctacaaatcagaattatgcttattatacagagtggcacagataaaggtaatatttaatggctgcttaatattgcagaaagaacgtggagtttatagtcctacccgactccaccacttcctagcttcacctgtttctacgtgtgatggtgtggaaattactcaacttctgagagcctcagtttctccacatagaaactgagtacagagtaggtgacagttactagttcttcttactgggagtgtaaacacataatctctgtgatactagcctattaaatccagaggcttatttgcaccctagagtaaatactctgctttaaaactagatgttttaaacctttatttctatcagttctgaaaagctatcatgtaattaaagtattgttgaaaatgctttaagagctaattttttgtgcatggtcttttttgatatttgaatatgtgctttgaagatgaatagaacatcgtctctgtcctctaggggcctactaggtgtttgtgcaagagacaagtttaacaaatagctcccgcataatgtgagagtaattaccttagaggtatgtccagagcagagcatcatactgcctctgggctttttttttttttttttttttttgaaatggagttttgctcttgttacccaggctggagtgcaatggcacaatctcggctcaccacagcctccacctcccgggttcaggtgattctcctgcctcagcctcccgagtagctgggattacaggcatgtgccaccacgcccggctaatttttttttttttttttttttttaagtagagacgaggtttctccatgttggtcagactggcctcaaactcccgacttcaggtagtccgcctgcctcggcctcccaaagtgctgggattacaggcatgagccactgcatccagccagttgtagaattttatatttccaccaaagtgcacaaggattccaatttctccacatcctcaccaacactttttattttctgttttcttcatagtagccaggctagtgggtgtgaggtgacatctcattgtagttttgacttgcatttgtgacacatctgttcatgtgcttattgtccatgtgtgtgtcttctttgggaaaatgtctgtatgagttccttgaccattttttaattagggtgtttggttttatcgtcgagttttaggagttcctctgtgtattctgggtctcatgtcttgtcagagattacagacaagacatgtctgtacctttgtgtcatatccaagaaatcattgacaattccagtgtctcgcttttagcctgtgttttcttctaacagttttaagttttaggttttacatttagatcatgatccattgtaggttgataattgtatatggcatttatttctggattctgttttattcccttctgtatgtctgtctgcatgccagtaccagactgtttctgttactgtaactttgtagtaagttttggaatcaggaagtgttagcccgccacctttgtttttctttttcattaccattttggctttcagggtaccgtgaaattctatgtgacttttaggatgggttattctatttctttgaaaaccctactgggattttgataggaattgcattaagtctatagattgctttgggtaatattgacatttttgcaatagtaagtcttccaatctatgaccacagatcccttcccatttatttatgtcttcttaatttctttcatacatgttttatagttttcattgcccaagttttttactttcttgatgaagttaattcttcatttaggaggctcagtgttctgaaaatttgttcttttcgatgctataataaacagaattgttttcttaatttccattttagattgttcagtgttagaagaaatacaactgatttttgtgtattgactttgtatcctgctactttgcttaattggtttaataattctaacagtttttgtgtagaatctttagggtgttttacatataagatcatatcatttgtgaacaagtaattttgcttcttcctttctaatttggatgtcttttatttctttttcttgcctaattgctttgacaacaacttcaactattcagctagtggtcatgttgagtacaagtggtgaaagcagacatacttgccttcttccttatcttagaggaaaagctttcagtctttcaccactgagtatgatgttcactgtgtgtgttttgtatatggtttttcttaggttgacatagtttccttctattcccatgtgcacttgagaagaatgtgtgttctgttattgttagagttctgtgtctctttggtatattgtgtttgttcatctcctctatttccttacttatcatatgtctggttgttctgcccattatggagaatgtggtattgaagtctccagctattattgtagaaccatttctttcttcaattctgtctcatttttgctacttaacattttgatggtctgctattaggtgcgttaatttttgtaattgttacattcctatattgaaccttttattaatgtataatacctttgttgtctcataaccttttttttatttaaagtctattttgtctgttatgagtacagccactcctgctctcctttggttactgttgcatgaaatacccctttctgtccttcagtttcagcatatttgtgtctctggatctacagtgagtctcttgtgtacagcttgtggttggaacattttaaaatttttattctgccaatttctgtcttttgattgaagagtttatttacatttaaagtaattattggtaaggaaagacttacttttgtcattttgctatttgttttctttatatatatgccttgtagcttttttgttcctcatttcctgcattactgtcttctttggtctttgattaattttttgtagtgaaacatttaactttcttgtttcctttgtgtctattctttagttatattttgtgtggttaccatggggattacatttaacatcctagacacttctaatctcaatttgtacaagcttaactgcaataatatacaaaacctctgcccctttaactgctctgtcccaacccctttcagttgttgatgtcacagaattacatcttcatatattgtatgcccaaaaacagaaactagtaatttttaatgcgttcgtttcttaaattatgtaggagacaaaatatgaagttacaaatcaaagttataatgttagcttttaaactaataattgattttcgttatttaccaatattgactttgtttattaatattaggcttatttatttatttatttataggcagggtctcattctgtagcccaggctggagtgcagtggtgccatcacagctcactgcagcctcaacctcttgggcccaatcgattctcccgcctcagtctcctgaatagccatgactacaggcatgtgcctaccacacctggttaatttttgttgttgttgctgttttgttttgtttgtagagatggggtttcaccatgttccacaggctggtcttgaactcctgggctcaagccatctctgcctgcctcggccacctgaagtgctgggattacaggtgtgagccaccatgcctggctaggctaagttttttttttttttaaatttgaaaatgtaatggtctcttcaatcatgtggaaaaccaaaagcagatttacataaccattgttacaatattactaactagtgtttattattacctatgtatttacctttactgagatctttatttcttcatatgactttgagttgctgtctagttttctttcatttcaacctgaactgctacctttagcacatctttcagggcagttctagtgataacaaactccctcagcttttgttcatcagagaacatcttaatttcccccttaattttgagggactgtcttgctggatataggattcttagttgacaggtttgggtttttttcgtcttattttagcagtgagtatttccacccactgccatatgacctccagagtgtctgatgtgaagtctgctgataatctcattgaggatttgttgtatgtgacaagtcacttctcttgttgctttcaaaaatctccctttgtttttggcctttgacagttctagtataatgtgtctcagtgtgagtctgttggatttcattattgtttattgagcttcttggatgtttatattcatgtgtttcatgaaatctgagaagttttggctattattcaaatattttttctactcttttatctgtcatttctcatgcaactcccacaatgcattagttggtctgcttgatgatgtctcacgggtcccttaggttctgttcacttttcttgaatctcttttatttctgttcttcagactcagtactttcccttgtcctatctcatgttcactactttttttacctgctcagatatgcttttgaatctctccagtgaattttctgttattgtacttctcatttcctgaattttataatttttatttctcttcattgatatttccgtttcgttcatacagcactttcttgcttttgttcacatcttttaattcttttttttttcttgagacagagtctggctctgtcacccaggctggagtgcagtggtgccatctcggctgactgcaagctccgcctcccgggttcacgccattctcctgcctcagcctcccgagtagctgggactacaggcacctgccgccacgcccggctaattttttgtagttttagtagagacggggtttcactgtgttagccaggatggtctcgatctcctgacctagtgatccacccacctcagtctcccaaagtgctgggattacaggtgtgagccactgtgcccggccatcttttaattctttaataaagtctttgtctagtagatttgctatcaggtttttgtgggtttttttggttttttggttttgttttgttttttttgacagagtcttgctctgttgcccaggctagagtacagtggtgtcatctcggctcattgcaacctccacctcctaggttcaagtgattcttctgcctcagccttccaagtagctgggattataggcacctgccaccacacccagctaattttttgtatttttagtagagacagggtttcagtatgttggccaggctggtctcaaactcctgaccttgtgatctgcccgcctcagcctcccaaagtgctaggattacaggcgtaagccaccacacccagccttatttttttttaaggaacagtttatattgatttatattttttttaataagccacttattcttgtttatttaaacagcacacttgaatttaataatttggtaactctgaaaatcagattctccttcttctccagggttttctttttttgttgttattgtttttctgattgttgtaggctatcaaagatcagcctcaggtgtaaacgtagggtcttcttagatattttctgagcctatgccttcccctgggcatgcacagtgactttctaatttcctccatacatgtggttggtttttaatgtcctagtcttcaatgtctggctcccaaaaggggaaaaagaaaattgaattggtgtgtaggaaggggaggcctccagctctttcaatctcctggaagtcagttcagcctgggaggttggggtggggtttccaacaatgaggaggaggtggaacagcagtatccagggcctgtttgcacctttgtgatgagaagcagcattcagagcacagatctccagtatttggagaatgtaattttctctgcccaccgtggcttgtgcaggcggtacacagttgactgagggatagagtgtggggagctgctgctgtgctaagcctgcaggtcactgaaattaactacagttcacctggaagttgccagccttcagtagactccaagttccaaaacatctacatcagacacatgctgccactaaaattgtgttcaaggtggagaaacagatttgtggtgcttcctactctaccttctttccagaatccaccccatttgtttttacaatcattttaacctgcagtgatcacctcagtcatagcatttaactttgaatgcaatgtgtctcaaattaggatctaagaagaattctctggagtttgtgagttttgcattggaaaagcacttgtaaagcacttgttcataattgagtagaggagaaagaaacactagacaaataacataatgaaactttgatcaatgctgagaaggagaaatacaatgcagattgtaaaagtggattttctaaactattttgacctattttaaaataattggatcttagaatgtattttaacacgatttttaaaaatgtaatattgccctctgaaactttgtaaggctgcttcagtctgttacagcagcaatcactacaagatcctttgttgatgaaatagaatggtaaaatttgggtgagccatgtgcccagccaataaacttgacttttttttttttttttttttttttgagacagagtctcgctctgttgcccaggctggagtgcagtggtgctgtctcggctcactgcaagctccacctcctgggttcacaccattctcctgcctcagcctcccaagtagctgggactacaggcgcctgccacgaagcccagctaatttttttgtatttttagtagagacggggccaggatggtctcgatctcctgacctcgtgatccacccgccttggcctcccagagtgctgggattacaggcgtgagccaccgcacccggcctaaacttgagttttaaaaagtcctaccctgggtgacagagcaagactccatctcaaaaaaaaaaaaaaaaaaaaagactttgggatccttaaccaagacagcgagtagtagaacaggtaacatggaaaatcaaacaactacaactaaaagacttggaaagagtctacgtgaaattatttcagatgaagaaaaagccctcattgcaccttggttcaagtgaccctgtaatctcagacctggttctaggtctctctatacctccctctaccactcagtgacatttgagtataggtaaatcacagttattattaaaattcattttctccatctgtgaaaagatagcaatacctgtctttacccagggggactgtgtgaggctctagagaagtaatataaaagaaaatatgttgcaaatcataggaagctatagaaatgcttattctgttactaaaatttatataccattgtgtatagttccaacttggacaacagtgaagctctataattcacttagagattgggggtagaggcagtaaaagggcaaggatattccagaaggaggaactaaaaagcccctaaataatttgacccaagcatcggtaataaggcttaagaaacataattttgctcacccatgttggccagactggttttgaactcctggtttcaagtgatccaccagccttggcctcccacagtgctaggattacaggcatgagccactgcacttggctgaatgccagtatcttaatagcaaccctgacccagagtatttcacaactactttagctattaacctctttaaaactgagtacttggctcaaagtgattttttggtttactttttattatgcaaaatttcagaaatattcaaatgtagaaagaatagtacaatgaactctatgtatacccatcaccagctgcagcaatcaactcgtgtacttctatttgattcataacccctcctactcccaaccttccattgttttattttgaagtaaatataacaccttatatcatttcgtttatatatatttcaatattagcgagactttctaaatgaatagaatcaaaaggtaacttctataaaatgatgatgagttggtactgataaacagctaacataataattatggtataaattagattttgataaaaaccaactttttccactgcatgtttggtaaaaaatcggcagagggaccaaaaggctttcttgccatagtgtttttaaaatgtaatttcttttgtaactttaaatatcctattctttcttgcccttttcttctgtaattgcttaagcagaataaagtgaagttgtattattaatttttttagcaacgtaaaataccagtttgagtaatctcaatataccattgggaaataagtaatttgaaatattcataaaatctcaaatgtctgtaagttgggtagctttgcttaaatagcagttttataagtacaatttttatttgttgagtggactttcaccgaattattcaaaggtagactattatttaatggtgggactaaacataaagtattatatttaattttatttttatatataatgaagtattagctactcatttttaacttactgcttgatgtagcccaaatgcatactgtttaattttttaaccatgaaactaggttgtctttaagcattttgtcatatcatttagctgtggtactgtgctgaaaataatgtgttatttgaagtttgaatattcccctttattaaaagcctgtacatttggaagaaaatggttattttgtgttacagtgttactttatacagcttttatgtataattcctcaggtaattgaagtagaaccattaatgtgtgtaagcatatcttctaaagtttgtttaaaggatagtcatcttttttattctctgaaagtgttatgtgacttggtactttcataactttaaatatgcagaagaaagaattttgaggggaattacatcagatttttattatatttttcatttgttattgcattttattctttagtttcatatacataataatttctaacctaaccagaaaaccaagattttttttcaatccaaacttaactaggtgtgtgttattctgcttatttttcttgctgtaataaatcactgttaattctgtgagtggtctagaataactggaaagcagtcattgcagctgaaaataatcgggtttttacattaagagtgtgtttttagtttctaaaagtttacaattgatttctttctgtgatgaacttttttttttccttgtttaaaaacagttcactgtggggaagaattttctcctgggtgatgaaatgattgaaatctttactgtatctttgggaagagaaaacaatgatttctaagcaacctaggaagagttattggttacactaaagaatattcatgggttttatgagaaggctatggtgatctgtgtaaaacttaagaaaatcatggctgctttagcagaaatagcaatttatttcttaaaagcaaatctgttttaactgcttatacataattttttctgtttggtgctggagaaaggatatattatttaacatataaaaagctcatataagattataacttaagaaatagcaagtctttcctatgcctctaacattgtgaacatgaacatgtaatgttttattttcttgttaacacatttacaatttcttcttaaaggcaaatcctcccccagtactggtcaacacagatagcttggaaacaccaacttacgtaagttccatttcctccccacattgaagtaattctgcctttcctgttccgttttttgatacaaatgcgaagaccatggcattgttttctctaatacatttctcttaagatgttctatcactatatactatagctgtaattgctatagtaaattaagtagtatggtcctcctttggtcatttttttttccttttgtaaagcagaaattttgaaatagaaattcgtaatttaattcagaaattatgatggctaactttcacaaaaggttgtctctgaccattggttgcttacacagtgccatatatttaaatcattttagaagtctaattgaatgactagatttttagtaaccaggttttttttgtgcattcatatatacgaaaataattagttataactttgtaattttaaattgatcagggacaaaagtccacttgttgcataattttattatatgaaagttccagaatagataaatccatagttactgaaagtagattagcagttgccaggtggtgggtgtagggcagaatggggagtgactgctaataggtacagggtttgtttatggggtaataaggatgttctggaattagaaagtaatgatgatggcacaactctgtgaataaactagaaactactgaattgcatactttaaaaaggtagattttatgatatgtgaatatctcaacataatttgttaaggtaaaaaagtagaaaaaggtgagttaataacataaatgcaaattaaaacaattaatacatcttaaacattatgttatcaaaagagcaaaaagtttgtcagtacattctgctggtgacagtatggggtaaaaatatactgctacatttttgttgaagtttaagtggataaaactttagaaaatgccgcaatttcgtgataatgattgagtctaaaaaccattatttttatattttttcttttgtaactttttgtattgtatgtaagaagccattgcataatccaacatcacaaagacttagagttaagttttcttctaagagttttatggttttgcttttagattttggtctttgattcattttgagttgatttttgtataatgtgaagtagaggtccaacttcattcttttgtatgtggatagcatcactgtttgttgaaaagactattctttccgcattgaatggtcttggcaaccatatagaaaatcagttaactgtaaatatatgggtatatttctttaattcctttcaataatgttctttagttttctgtgtacaagtcttggagttcttttgttaaattcacttctatgtattctctctctttttttttttttttttttttcttgagacagtttcactctgtcacccaggctggagtgcattggcacaatctcagctcactgcaacctccacctcccagacccaagatgatcctcccacctcagcctcccatgtagttgggaacacggacacgtgccaccatgactggctattttttttttttttttgtatttttggtagagatggggttttaccatgttgcctaggttgatcttgaactcctgagctcaagtcatccagcccgcctcagcctcccaaagtgctgggatttcaggggtgagccatcatgcccagccagtattttattcttacgatgctgttataaatggaattgttttgtttatttttggagtttttattgctagcatatgggaatataattgacttttaggtgtttatcttttatcctacaaccttgctgaactcatttattacctctggtagttatgtagtttgaattttctatatacaagatcatgtcactggcaaatagagatagtttacctctggatgccttttatttcttttttttttttaattttaaaggatgggaaacttcaggattttattttttgttttttggattttttttttaatttcagtaagtttttagggagcgggtgttgtttggttacatgaataagttagtggtgatttctgagattttggtgcacccatcatctgagcagtgtatactgtacccagtatgtagtcttttatccctcaccccagtcccacgctttcccgagtccccaaatgccaatgtatcattctcatgcctttgcatcctcatagcttagctcccacttatgagtgagaacatactgtgtttggttttccattcctgagttacttcacttagaataataatctccagttccattcaggttgctgcaaatgccattatttcattcctttttatggctgagtagtattccatggtgtgtgtgtgtgtgtgtgtgtgtgtgtgtgtgtgtgtgcacaccatatattttttatccactcatggaaaaatgggtatttgggctggttccatatttttgcaattgtgaattgcgctgctataaacatgcatgtgcaagtatctttttcatataatgacttattttcctctgtgtagatacctagtagtagaattgctggatcaaacggtagatctccttttagttctttaaggactctctgtactgttttccatagtggttgtactagtttacattcccatcaacagtgtaaaagtgttccttttcactgcatccacgccaacatctatttttttttatttttttatgatgaccattcttgcaggggtaaggtaatatcacattgtggttttgattttcattttcccgatagtgatgttgagcacttttccatatgcttgtcagccatttgcgtatcttcctttgagaattttctattcatgtccttagcccacttttggatgagattgtttttttcttgctgatttgtttgtttgagttccttgtagattctggatattagtcctttgtcagaagtatagattgtgaagattttctcccactctgtaggttgcctgttaactctgctgattattttgttgtgcagaagcttcttagtttaattaaatcccatctgcatatctttgtttttgttggatttgcttttgggttcttggtcatgaagtctttgcctaagccaatgtttagaagggttttctgatgttatcttctaaaattttaatggtttcaggtcttagatttaagtttttgatccattttgagttgatgtttttataaggtgagagatgaggatccagtttcattttctacatgtggctagccaattatcccagcaccatttgtcaaatagggtgtcctttccccactttatgtttttgtttgctttgtcaaagatcaggtggctgtaagtatttggctttatttctgggttttctattctgcttcattctgtgtgtccatttttataccagtaccatgctgttttgatgactatggcctcatagtatagtttggagtcaggtaatgtgatgcctccagatttgttccttttgcttagtttggctttgtctgtggaggctcttttttggttccatatgaattttaggaatgttttctctagttctgtgaagaatgatggtggtattttggtgggaattgcattgaatttgtagattgcttttggcagtatagtcattttcacagtattgattctacctgtccatgagcttgggatgtgtttttgtttgtgtcatctgtgatttctttcagcagtgttttgtagttttctttgtagaggtctttcacctccttggttaagtatattcttaagtattttattttcctttagctattgtaaaaagggtcgagttctttttattttattttattttatttatttatttatttatttatttgagacagtgtctcactctgtttgttgcccaggttggagtacagtagcacaatctcagctcactgcaacctccgcctcctgggttcaagtgcttctcctgtctcagcccccaccctaccccaccccttggcccccgccctgagtagctgggattaaagacgtgcaccaccacacctggctaatttttgtatttttagtaaagtactcagtgctacctaaaaagccccttttatgtgctgcttagaaacctacatcatgaattggcattaaattaagcaccaggaatatttactgagcacctaccttgtgaggaaacttaaaggtgaaaaatctcagattccttaaggcagaaatcataaggtcacagtatcaaaattttacgttaatgccaaaagggccatataagcacactcatttggaaatgttttcgaaaataaaattttagattatttagaaataaacaaatgaacaaaaatggagctcagtgcagctagcagttgtgggatttggcctaatccatatgccaaggaaaattggtaaattttgaggtttctaaaaatagaatagagtaagcataaattgagcattcaactcaaaaatcttttttagaaaatcaaaggactaaagaactgttaaaaacagaaagtaataccatgaaatgtaatagattcatcaataatgtcaaaactgcttattcgataaagactgatagacttttagcaagtcttgagtaagaaacaagatgatgcaaataacctttagaataagaaaggggatattgctgcaaataaaaattttactcgtaacaaaggacttcctgtcaagtaggtaagcctcccgtactctagatgcacagacatgatcaacacagctcttgaagttactcctcctaaactgagataaagagattttacgtgtgtgtgtgtgtgtgtgtgtgtgagagagagagagagagcaagcaagcgagctcctggtcaacatagaccccatctctatgaaaaacaaaagtaaacagccaggcatggtggcatgtgcctgtagtctcagctactcaagaggctaaggcaggaggatcacttgagtccaggagtttgaggctgcaacgagctatgattatgccactgcattccagcctgggtaacagagtgaaatcccaactctctctatataaatgcctttataacatataatctctaagaggaaaatgtctatagatgagaaagaagagggaacaaaatagtaatagggtttgaatctaggagaatcacaagagttaagaacccaaaagggtagtagagatgggcttcaaaagttctcaaggaagaaactcctggtccctatattagacctgaattaagggctacattttatagtatggttaagaaagcaaagtagcttatgtaggttttgttatttctcttgcagttatctatcattgcataacaaactaccctgaagcttaggggcttaaaagaacaacagttcattttttctcataatgaattggatggctctgctttacatggtgtgggttagggcacttgacaaggttgggaggtccaaatagccttattcacgtggctgatagttggtggtgctgactgctggttaggagtgtagctggggcttttggccaagggttttggttctctgttggttagatctctctgtaggctgtttgagttttactcatgttatagctgctgggttctaaagaaaatatattccaagcaaaggcaaataatactatcaggcatcagatgacctagtctcagaaatcacacagcatcatttgtgccacatttattttagtcaaagctagtcacagggcttgcctagatctaattgaagaggaaagagactccttttgatggtagggtgatttagttatattgcaaaagaatgtctggaatggaagatgtgagccatcttcagaagtagaatttatcacagtccacatttgatttagatagagttttgcccagcctcatatcacgagaaattttaaaggaaggattcaaacccatgttcatctgattccagggacttgtttcaccagtggcctttactgtaggagttaacttctttcaggagagactaggaaataaattggagggagataaattgtgaccaagatatcttgaatggtgactgattttgacataaaacatgtaagtgaaatttgtgaccgaggaggcacaaaattccagatgtcgaagtggaaaattgcaggatatgtaatggaaagagcaagtcgttcacagaaagggttggtatgtaaggcctatgaagaggtgaagaatgaagggaagtagtacattggggtcagttcattcgaagacatgattaccaacccatagagtttggatatttctaggaagggagagttgtgaaagttttagaggaagtatgttatgggctttaaaaagatccagctgttgccaggcacggtggctcacgcctgtaatcccagcactttgggaggccgaggcgggtggatcacgaggtcagaagatcgagaccatcctggctaacacggtgaaaccccatctctactaaaaatacaaaaaattagccgggcgtggtgggcaggcacctgtagtcccagctactcgggaggctgaggcaggagaatggtgtgaacccgggaggcggagcttgtagtgaaccaagatcacgccaccactgcactccagcctgggcaacagagcgagactccatctcaaaaaaacaaaacaaaaaagatccagctgtttaaaacagtgatttgggcagtggggaatactaatctaagcgattaggcagactgcattgacagtattccattccagaggaggttgaacaaggcctgaacaaaggtattagaaatgagagtgaagaggtgatgattttccaaaaaattaaggtgttcaaatcagaaacagttggtaactgattagatgtgtggatcaagacagagaaggatcggaggttgaaactattaaaagctgaatgtacctatcctggatttgaaagtcatgataccacgaatgttgtcaactcattaatcacatttgtatttttccattccttgaaaatcttccccagaattattaaaatgaagctattgtgtttgattactgtcgcattcaacaggttttcattaataaatcatacaaaaattttgccttgccattttggattttacactctgaagtttctgagctgcttttcttttcccctgtaggttaatggcacagatgcagattatgaatatgaagaaatcacacttgaaagggtaaaaactattatcttaatctgttgttctagagaactttgtaatatactgctttttcatacagaatccaagggagatctctcaaaaacagaactatatgatattttctaagttcccagttcataaaattggccaaggtattttcaaaacatttgccttttctttagtaaccttatttttttaataaactttttattttacaatagttttagatttacaaagaagttgtaaagatagtcccaagagtttccatttactctggattcagcctcctctattgttaacatcttctattactagagtacatttatttcaactaagacacctgtattcatacattattattaactgaagtctctatttccttactttttatgttattctctctcagaggcccatccaggaaactacattacgtttagttatcctgccgccttagacccctctagattgtgatagtttctcagatttttcttgctttttaattttgtttatattgtttatatgcatatgataatgaagtattgttcgtattaagtaagtagtatactagtaacatggtcattatatcaattttcttttctagcaaaataaccatacttctaacagacagagctgtattaaaaactaattatggtatacttgcccaatcagaaaatgacttgaaggtgcaattcagatgtgcaaattttcttaagatatgtttttccctcaagaatatctgcactcacgcctgtaatcccagcactttgggaggccgaggcgggtgaatcacttgaggccagaagttcaagaccagcctggccaacatggcaaaactccgtctctactaaaaatacaaaaattagccaggtgtggtaacgcagacctgtaatcccagctactcgaatcaggagaatcacttgaacccaggagtcagaggttgcagtgagccgagatcgcactctagcctgggtgacagagtgagactctgtctaaaaaaaagaaaaaagaatatctgcattcagtttttattgtatgttataatagtaatgccaccttatctggctagcattttatggaaatctagtgtttcacacaagcagatttcttaagtaactaaatgtgtgtatactcaagactgaaatcctagataattagatttatttatattggaatagaatctgagaaaaataaatctgagagagtctcttacatgtatatctttattgccatctacttaaattcggatcacttgctcaagttgggtggctactggagtaatattcaagtaagcacagtattaatgtactgtacatactttaatatagtagtttgtgatgtctcctaactttttatattattgattttttatcttttcccagggccttttaaattccttttgtttagttaggactatacattgtatttttcactggttgaagaacttgagtacctaagtaatttggtaacctcccataatccactggtactgttcttaagattcaggtaattcatgaagttagattgaaaaacatttttttattaaaatagaattttaagacaaatggtggtagagtgggtgtttacactgtttaatactaacagttaaatgataggtccacatatatttgcttacttgagttgcctgaaattcagttagaacattcttcaagaaataaacattttttaataccattggttaaatcaattatttttaaaggctttttgtagcagtcgaaccctttctgtgaagaacatattcagaaatcttgtttctccagttcataaaacaagcaaaaagtagagctgctttggcaaaatttactttgctgtcaagaaaattcaccaatgttaagttctcaggttggtctttcagtcagtgtgaaacaatgccttttgctaatcgggtatattggttaaacatgtcagggactgatggcagctatcacttagcagccacaatttggtcatttaaaaataagctgatgtcaagttagcagaagaaaagcaccatcgccacccccttttttaaaggctaaaacagtatatgggttttgcctactcagaaataacagcgggaagatcacttcagcatttgtctcttaggagagatgtgccctaccaaacatggctgaggtgcagtctaaaagaaacagacttacagtgacacctctgcagatgggtgactaatccaacgacaagttgcacatacttttaaagaaagaactgtggagtatacttcaaaagtccttggtgtattttcttgaacctcacctgttcagcagtaatgcctctgaaaggactttcctccagaacaagtccatttaatttagaatctttatattactcacccatatacctttatttgttgtgttccttatgttagtacagtttctgcgtcctttaatgacaggaacctgtccataaagataaatcatattcagtctcaattttttttcttctatcctcagggaaattcagggcttggtttcagcattgcaggaggtacggacaacccacacattggagatgactcaagtattttcattaccaaaattatcacagggggagcagccgcccaagatggaagattgcggtatgttttgcgctttttattgtgatgctgaatccactttgtgtatttttcttgaagcagactggataagggataaatacaaataacaaacacgatcatgataactagcatagggtagatgctttaacaacattcaagtcaatgaatgagataattatgctctaagcattgtgttcctgttttcatttagactccagttttatcttagatattataacattttgaataacaaatttggttgatggtttaaatctttgtgagcatatttatagaaatcatgagtttccctttgtgttttcagatacactcacagaatattttccatttcctctctggctgggaaacatgtgtataaacttatttaagtacactcacagaatattttccatttcctctctggctgggaaacatgtatataaacttatttaagatacggaggatagaggatcacacatccatgttgaatcccacaccacaaagactatatgcaaactttaaataatatattttcttattgactagatgaaaataacatttgtctctgtttaaatttagtgttccattttggaagatatattttgcaaactttgattttttgagggtcataaattatgtcatttttcctatttccttgtttgttgttcaaataccctgaagttttaggactaaagagtttatgtagtctgttaaaaacagcatcttattttaaggacgttgatgccttacgcagtttttgaatttctaagctttataattctcactgggtatgacaggtggtatattaatgaaatcaaatagatataaaaattaatcatttgaccattcatgtaaatgtagacatttacttcctgattctgttagatatagaagcttgtcaggaccagttttaatattttaattatgttttgtttaccctctctacccaatttgagatgaccatctttttttcctggtggaataccatgcaatcaaagagaccagaactagggaaaaggctaagactaggaacaaatcagacttttaaaaaacataacaccatggcaaattataagttctttacctacgaaacctttgaattaagtgacctaatctttatataaatttcaaaaaataacttaattgttttatgtctaatatataggttggaataggcactcagaaaattatttttactttatctcagttttcacactatctctgtgaccttaaactcgtgatgtgagcctcagttttcttatctttgaatcacagctctgtcacttattatctgggtggccttaggaaagttatttacattctttgtgcctcagtttctccatctgtgaaatagggattaaaatatatattaagcttacaggtgtcatgagggttaaaataccaagaaagtgcctggcatgtggttagtgctaaataaatgtttgctatttttataaagtgtgtcttaatgcctacacagaataagcatgcaggaagtatgcaaatggtagctgtaattattatttaacatttttatataatctattattttcactatttcttttgttccttttgctggcccttgggaaatgtttgtatttgtttatattagtttttgatatactttcttcatttatgttttctggaattactccagaattatttataattctctttaccttaaaaaagaagtaacaaaaaattggtaaagtggaaaatttatatttaaattatatttaatttttatttttaatatttaattgttttctcagggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtatgtggtaagtcaaactaagataaatctttaagaaatctctgagttaaatatacctatgaactttatctgtgacatacattccaagtacagtattagtaatattctacagaacttgagtggattttaatttctccgttatttctactgatttttgtcttacgtagcattttagaatatttacatttctaccaagattgcagcatttgaaaagttcctttttttgcggggtttttttgtttgtttttttgaggcagggttttgccctgtcaccctggctggagtccagtggtgcagtcatggcttactgcagcctcagcctcctgagctcaagcgatcctcccacctcaccctcccaagtagcttggactgcatgcacacaccaccacactgggctgattttttttattttttgtagagacggaggcctccctgcattgcctaggctggtctcaaactcctgggctcaagcagttctcccacctcagccccgcagagtgctggtattacaagtgtgagccactgcacctggcccaaaattcttacgtttattgatgtatgcttttatacattttactgcagtgagcatatatataaatttataagttttttatgatttttatattcaatatttgctcagcatgtttttaagagtttttaaaagtagggaacaaaatatctatttgttttataagtggatatgtccctatttgtattaagtattcttatattgaagacttctagcattaaaagagtgaaatatttgtgtccttgaacactttgaagtttagtattgctattaacttgtgataatctacaaaatactttaaatgcaggtacacaggctaagttaaaagaagaagtgtttataatatgtattatgagcagttacatctgcagtaaaggactgttaagatgtgattgctgaatttttaaaacattgatggcttgaggataaatggaaatagtagtttcaatatgtggcttcatggaagagggaggatgtcaacaaatgaaaaaggaatggagagctgagaaattatctgatattgaagctatgggatttaggaattacagaaattccttacttaaaattgttaattcatagaatattgaagaagaacaaaggtattcacatttttaaagcctgttggttctgcccaccatcaccagacaatgttgttatttcttctcaataattttgttcttgtgaaaatattaaaagtgtaggtaagcataattatgatggaaacaaaagtaaaacataatttcgcaatgtcactttggaataacaagtgcatttgcgaaaagatactaagaaggaacatgtgggataaaaggaatctattcgtaactctaggagcagctgtatgtctaagtgtcccttgattgcagaacatatactagtagataactaaatagattcttttctattttaaaaaatattagtgtgagggaataattaccttgtagttttcaaccatttctttctgggcttaagttcatatttatggatgagaatctagaactgttttccaaacaggtcttgggtttagcattgctggaggtgttggaaatcagcatattcctggggataatagcatctatgtaaccaaaataattgaaggaggtgcagcacataaggatggcaaacttcagattggagataaacttttagcagtaagtataagaaatctattgtcttttaaatcattttgtagtctgtttatttttctgatagatactggaatttctccataccaaaaaggtctaaatgatgtttaaattagcaaatactagccttgctgtatcaaatcctaaaaaatgattcttggtaattctttatttgtcatttctcttttctctgctagctcctcctcccttttccttttattcctttgttgttgttgagggcttgtatgcacagagtgtttcatcataatccttaggtttataaaacaatgtcatcatttgtttatgcatgacccttttttattttacttcacttaatagtataatgaaacctagtaattacccagcccaagaattagaacatcaaccattttgtgtttcttattcctttgcttcttaaaaattgtttaatcaggccgggtgtggtggctcacacctgtctgtaatcttagcactttgggaggctgaggtaggtagattgcttgagcccaggagtttaagaccagcctgggcagcatggcaaaaccctgtctctacaaaaaatacagaaattaaccagacctggtgatatacacctatagtcccagctccttgggaggctgaggtgagaagatcacctgagcccaggaggttgaggttacagtgagctgtgattgtcccactgcactgcagtctgggtgacagagtgaaagcccatctcaaaaaaaaaaaaagtttaattatatacatatgcctaaataattttgtttagtattatttgttttgaagctttttcaaaacactattgcactgtatgagactttcatctccagtatttttttcactcaatattgctttactgagacttacccatatcattgcttagagctaaagttcattcattttatctctacatactattccactgtatgtctgtactgcaatttatttgtccagtcttcatcagtgtattagtttgttttcacactgctatgaagaattacccgagactgggtaatttataaaggaaagcggtttaattgactcaccagactcaggaaacttacagtcatggtggagggtgggggaaagcaaacacgcccttcttcacatgccagcaggagagagacgtgccagcagtggaaatgccagatgcttataaaacaatcacatctcatgagactcactcactatcaagagaacatcatggggagccacctccgtgatctaatcacctcctacaaggtccctcccccaacacatggggattacaattcaggatgacatttgggtggggacacagagccataccatatcaatcaataactgtctcagtccatgttccttagggaaacggaatctgaagaaaagctaaagtgctaaggtattatttggctgtgtgatctcaagaaggctagagtgagtaaaaatgaggagtgaagcagagaatgaacgagagccaatagaaggtagaatgtgtctgagctggctgtaattttataaggtagcttgttgcttgtcatgtataacagtcttctaggcagacactgtaaaaaccatccgggcatcataaaccttacatccagccatccagagaaaagaaagaaaggtttatctgctggcccttttattctcctgtctcttgtctaccccctaggggttatttgtcccaagcttttggattgtgttacccaactcccctgggcgcagtttctagggaagccagctcctatactccatggcacaacacttcacccaagcccaaaaatggtagagttgcagtggtatgacaggtcaaacataggtttgtgacatgttatggccctcactgtgtggaacacatcagccatgcccagtcccagccagaagaggctcagaaaactgggaagggcaggagacaagatgaaagtagtataatagtcaggactctccactgagcaagcagccaaggcctagcagaatctgaaaaggcacataaactggatctggcatagtaggaagttggtttttaaaaatatactagcaagtactggtttttaaaaatctattttaagtcttttttttttttttttttttttggtattatgaataattttcctgggaagagctgctgtgtgttctggtgaacatgtacaagaattttacttgactgtcatgggattattgattatcctactagtagcattctttttaaaaaccatcctgttgttttccaggctgcttgtaaaaatttacatcagcaatatataaaagattcctttgttctacatcctgtttagtactgtttattgttgcaaggagactttttttagttaatgatggcgaaaaggaaagagcagaacttgaactatgtttctctaacttatcctttcacagctaagatcaccactctttcctcaaactataaccagtaccatctcaccatcactcatcactcacacacaaacacagtcaagacagccttctgttgcactagttttctcagttttactttttaatttcttggctaccatgttttcctttatggtttctctagaactggctttggtggtaggagacagcaacctgtgctgataccattgtggcaagtctctctcttaaatcaacttttagtgaggcttttgttctcttaattacactggaatcattcaattctcagtcctcatcttaattgacttatctggctggagtttgacacaccttcctccttctaacactttttcatttgcctaatagtcaccctttatcttggtatttctcttcttagtagccactcttcattctgtctttctgatgtctggtgcctcctcatatctgtaacctctaaacattgaagtaatccagaactcactccttgtccattttctcctttttactattcactcccaaggtcactgtttcttaatgtgtagaagacgactctggtagatggtcaaataacttttctctggcgtaaaactttgggatcatcatcttacacatttcacattaaatccctcagcaaattgtgtcagctcttgtgtcaggtatctagtgatatgtgagaaaacacagagattaatggctaaaaaacaccactcatgtatttgtttacaattctgcagattggatagggcttggcaggaacaacttgtctttgctgtactaggccacaaaatccactgttaggttggctgacacatatggtgggcaagttggctcttagctgggaactcagctgggactgttagccaggtgcttaattatccagtggtctctttgcgtggttagggtgagtttcacacaggatggtggctaggttccaaaagtaagctttccaaagaagacaagcactggtacattgtttttatcaatcttctctttccttcacaactactgtacctcattggctaaagctagttacgtggacaagcaaaattcagtgtagaaagagatttttacaagggtgtgaataccaggatgcatggcttattgtaggccaccaaagaaacagtataccacagctatttaatatgtatttcagcagtataccacagctatttaatgtgtatttcagaagtataccacagctatttaatgtgtatttcagcagtataccacagctatttaatgtgtatttcagcagtataccacagctatttaatgtgtatttcagcagtataccacagctatttaatgtgtatttcagcagtataccacagctatttaatgtgtatttcagcagtatgccacagctatttaatgtgtatttcagcagtatgccacagctatttaatgtgtatttcagcagtatgccacagctatttaatgtgtatttcagcagtatgccacagctatttaatgtgtatttcagcagtatgccacagctatttaatgtgtatttcagcagtatgccacagctatttaatgtgtatttcagcagtatgccacagctatttaatgtgtatttcagcagtatgccacagctatttaatatgtatttcaaaatgcaggcagtccttgctttgcatggtaatgtggagccataaaaatgaccatgctgctgagactctgcaaagcaatgttaatcatcagtgaagggaaattattattctgtgacctttacatttttttgtgaaaatattaaaaactgcaatagtcaactataaaggtacaaattaggaaaaagtgaaaaatatattaaagttaatattgttaatacatggtaatttaaaacggaaacattgataatgttttacttatttgcaaaaaaaaaaaatgtatcaaagagaagaacaatccaaacctaaagcaaacagaagggtggaaataataaagattagagcagaaattaatgaaataggtaatagaaaagatgtaagaagacagacaaaactgaaagttggtcctttgaaaaaaaaatcaacaaaatgacaaaccttcagaccagccaagaaaaaagagagaaggctgaaatttctgaaagcaagcatgaaagagggaaaacaagagactattatgagtaactatgtgctaatacctgaggtaacttagatgaaattgacagattgctagaaagacataaactaccacttctaatcagtgttatagttgagattctatccagggcaataagaaaagaaaaagaaaaagaaaatcagattagaaaggaagaaataggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagctgagatcccgccactgcactccagcctgggcgacagagcgagactccgtctcaaaaaaaaaaaaaaaaaaaaaaaaaaagaaaggaagaaataaaactatatttgctgatgtcatcatattgtatatagactatcctaggaacctgctaatagaactaataaattagtttagtattggttgcaggatacatcactacctaaaaatcagttatatttctatacagaagataggtgaatggccaaaaaataattgaaaaaaaatcaacttgagtattacgaaagtagaaatttaaaactaattgatgtataaattaaaagatgcatcattttacagattttttaaattagttgataatgtttaatgttggcaaaggtctaagtagatgggcactctcatattctgtggtagtgagtataaatttactaaaaccatttaggagaacaatttaaatatttgtgctcaattgtgttctaatagttttccaatctaaatatgggaatattaacagatatgatctttaataaattatgatatagccacacaatgggctactgtgcagctgttttgttacaatgtagtaattctattaatttgtgtcccaacatggaacagtctctaaggtaccttacattaaaaatcctaacataaaaacaaaaattttagtatgttttcatttctttaaagataaaaatgtctaaaacgcatccacacacattcctaaatgcctaagaatgagagaaaatcaagactgggagaataggaggtatggagactggaatcaagatgggctattctgttaacattcaacgacttcacatgtcatgataaacaacttactgagatcatagacatcaaacatgggtattttctttcggcatacctttattttccttaaaccactctcttattttccctttcttttcgtgaaattgtttccaaaactcagagaacaagtgaatatgtcataaatgtcttttgggactttttttaggtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactgtaagtctgttagcatacgtttgcttaaatttatcttacttcttcagttgtgatgccattagtgaaatgttctcagtataataaagtttaaacattatgcaaatatttttaaagaaacaattaagcatgttaatctactcattttttaaaatctactttaagtcaaaatttttataattagaagggggggatccttttcacctttattattttatagtagtagttacatttaaaggattttcaaacttttatgtaagtaacagtcactaaagaacatttgcaaatattgaaattgttttgttctaagttttccacttgagcacagaaatttgcttgaacaagccgttcattctattaacaagcaaagtacaggcatacctcattttattgggctttgctttattgcacttcacagagactacatttattacaaattgaaggtttatggcaatcctgaattgagcaaatttatcagcaccttttttcttcagcaacatgttctcacttcatgtctcttaatgtctctgtgtcacattttggtaaatctcgcaatatttcaaacttttttcattattattatatctgttacagtaatatgtgatcactagtctttgatgttactattttaattgttttggagtgccacaaccacactcatataagacagcaagcttaatagataaatgtgtgtgttctgactgctcctctgatgactagtcattcccctatctccctcgctctcctcgggcctccctattccccaagatacaacaatattgatattaggccagttaataaatctacaatgacctctgagtgctcaagtgaaaagttgcatatttctcattatatgtcaaaaagatttaacttagtgaggaaggcatgttcaatggcaataaagggagaaagctagacctcttgctgcagttagccaagttgtgaatgccaaggaaaagttcttgaagaaaattaaaagtactgttacagtgaacacactaatgataagaaagcaagacaatctgattgctgttgtggacaaagtttgaagtggtctagatagatcaaaccaaccataagattccttcaaaccaaagcctaatccagaacaagaccctaactgtgcttcaattctgaaaaggctgagagaggtgaggaagctgtagaagagaaatgtgaggctagcaggggttggttcatgaggttgagggaaagaagtcatctctataacatgaaagtgcaaggtaaagcagcaagtgctgctgtaggagctgcagcaagttatccagaagatctggctatgatacttaatggaagtggctacaccaaacaacaatttttcaatgtagatgaaacagccttctactggaaaaagacaccttttaggactttcacagctagagaggataagtcagtgcctgacttcaaagcttcaaagtacaagctgactttcttgttagttgctaatgcagctggtgattttcagttgaagccaatgcccatttaccagtccagaaaatccaaggaattatgctaagcctgtctgcctgttctgtataactgtaatgaaacctgtgctctataactgaagcaacaaagcctgaatgacagcatatctgttgacagcatggtttactgaatattttaagccaactattgagacctgctgctcagaaaaaaacaaaaaaaaaacactcctttcaaaatattagtgctctgagacaatgcacctagctgcccaagagctatgatggcagtgtgcagggagactgatgttgttttgatgcttactaacttgtcatccactctgtagtccatggatcaaggaataattttgactttcaagtcttactatttaagaaatacattttataaagctatagctgtcataggtagtgattccgctgatggatctgggcaaagtaaattgaaaaccttctgcaaaggattcaccagtctagatgcctttaaggacattcatgattcatgggaggaggtcacaatatcagcattaacaggagtttcaaagatgttgattccagccctcttggatgacttggaacaggtcaaaactttagtggcagaagttactgcaaattggtagaaataataagagaactagaattagaagtggagcctgaagatgtgactgaattgctgcaacctcatgataaaactttaacaactaaggagttgcttcttatagataatcaaagaaagtggtttcttgagatggaatctaatcctggtaggtgaagatgatgtgaacattatcgaaacggcaacaaaggattttgggatattacataaacttagttgataaagcagcagtagggtttaagagaattcacttcagttttgaaagaagttctactgtgggtaaaatgctaacaaaccagcatcacatgcttcagggaaatcttttgtaaaagaacgagtcagtggatatggccaactgcatttttgtcttattttaagaaattaacacaggcaccccacccttcagcaactaccaccctcagtatcaaggctatcattattaaggcaagatgctccaccagcaaaaacattataacttgctgaaggctgagatgattgctagcggtttttttttagcaataaagtatttttaaattaaggcctgtacattgtatttttagacataatgctattccttacttaatatagtgtaaacataacttgtacatgcactgggaaaccaaaaaatttataatgacaggctttattgcaatattcgctttattgctgtggtatggaactgtaatatctctgaggtatgtctgtaattctgaggtttctggtgctgctagttcatggcctgcactttgagaaacactgatttacaatatatctaaaattaaagggattttctttgctcttaggtacatgaggagagatactatttatctttgtactttcaggttctagtgcttatatttgtatgcagttcagttgtgttgcagttgattaaattgttcttaaagtacttacgtatttttaggtttcttactttatatatatatatatatatatatatatatatatatatatttttttttttttttttttttttttttttttttttggagacagaatctcgctctgttgcccaggctggagtgcagtggtgcaatctcagctcactgcaacctccgcctcccaggttcaagcgatcctcctgcctcagcccccctagtagcagggattacaggcttgcgacaccatgactggctaacttttgtatttttagtagagacggggtttcgccatgttggccaggctggtctcaaactcctggcctcaggtgatccacctgcctcggcctctcaaagtgctgggattacaggcgtgagccaccgcacctggccattttatattcagttttttaaatatataagctgagaagagatttaagtatattttttaatgtgtttgtattggtggaaaaatgaaatctgtatttgttctttgcattgagttaatgtttgaagaacccgtaaataataaagatcttaaacgtactgggtataacctgcttttgagtgctccttttttaaattgtagaattttagaaatattggtgatttttaaagtaacagtgcttccaattttagaactgtcaagattcattatattactaatcattatcagttaaaaacatgacattttgaaatctacatactgccctccagtaatgtatcttcattatctgctcattgatttattaattgctcaagtataattgaattatttccttaatagtatttaacctgtctgatgtacagggatggtgtcttatacttcttttgtgtcaaagaaaagaaccttgctacttatttgaaattcttacatatacttcctctagcacataaactttatataaaggctttgtgtattttttaaataatgagccattttattcatcaattcaagtatcttattttaaatgctgcctatctaataaccatgtgcacattgtgacagttgttccacgaattgagtattagtgccctgattatgattatgttgttttttttttttaagatggagtttcgctcttgttgcccaggctggagtgcagtggcgtgatctcggatcaccacaacctctgcctcccagattcaagccattctcttgcctcagtagctgggattacaggcatgcgccaccacgccctgctaattttgtatttttagtagagacggggtttctccatgtttggtcaggctggtctcgaactcccgacctcagatgatccacccacttcggcctcccaaagcgctgggattataggcatgagccaccgagcccagctgattatgttactttttcccccatctgttattgaactaataaagcattatgaaaaagctgacattcaccttgcagtttcaacttgatcataatattttgcttccagtcccttcccttcttaggcaactgtagatgtgggtttcgttgtacacttctgcatatgcaattcataaacaatctgtttgtgttttttgaaaagcacttgtgtttaaattttttttacataagtgagttttacttgtcagttcttctgaagcctgcacagtcaccctgctgtcaggctattcagcttactctctatccctggctgtggtgatctggtgttctcttcatcagtctggctgtagtcactgaagactttagtgcgaaggcccattgtcgttttgccactgttactcatgctgtcattcctggtcatgtccaaaaaccacactaatgattcatccaacaccctgactttttggtttcttcatctctttctgactatcctgccctccacttcaactcagttacttgcttctaagataatactttagattttgttatctataattattaactttcatcacctctaaaataccagtttgatcatcccattgtgtgactacaaccctcagttcattcacctctattctagcaattccatctcattttgaccttcagtcatttgacattattattttgttgccccttgtctcaatttttctatttgtattagcttagattccatggtttctcatgttcacttcattgcacatcttcaagtcctttgcccccttcttcttcgcagcagaatcccccaacactggtgcaggcaaactctgctatttcatttatggttcctaaaaagcagaaccatggagaaaagcacaaaattctgctttttacgtatggccataaatcatagatagtgccttactcttgcctgcagtcctactacatttccctaattcactctcccactctaaagaatttttctctcccctcaaaccttcacttgccatctactattcatgaatgatgatctcacttcatatttcatataagcacccagaagagaatttccttatttttccactttcagatatacctatgtaattatatttttaccccgaaactcgactttcacttgtgttttaatgggagtcactgtcattgttcctgttgaaaaccaggtcttccatttgtatactgaatgtcattgtttgttgtctgcagagaatcttgttcttgcagctgtcccttctctctcttgcataatcaaatcctctgtctactggatcattaccatcagcacacgaacatgtttacatactccttatctgaaggaaataggagggatcgtcctacagtcttaagatacctctctaacactgctccttttctctgcttaatatcaccgagagctgattttcctaccatgttaagacttcttcacatcaaaaaggaaaaaagccaggcacaatggtgcgtgcctgtggtcccaattatttggcaggctgaggcaggagggttgtttgaacccaggagtttgggggttatagtgcactattattgcacctgtgtctggccactgcactccagcctgggcaacataatgagacccatctcttaaaaaagagaccaggcacggtggctcacgcctgtaatcccagcactttgtgaggccgaggcgggcggagcatgaggtcagcagatcaagaccatcctggctaacccagtgaaaccccatctctactaaaactacaaaaaattacccgggcatggtggcaagtgcctgcagtccccactactcgggaggctaaggcaggagaattgcttgaacccaggaggcggagtttgcagtgagctgagatcgcgccactgtagtccagcctgggcgacaaagcaagactctgtaagaaaaataaaaaaacatacccagtaaagaaatggggaaagtctataaaaagattcttttacctgagacaggatctcactcagctgctcaggctgcagtggagtgacacgatgatagttccttgtagccttgaattcctgggctcaggccatcctcccacatcagccttccaagtgtctaggatagcatgcccagctaatttttaaaattgttttgtagagatggggtctcactatgttgcctaagctcctaacctcaagtgatcctgcctcagtgcccccaaagtgttgggattgcagataggagccactgcacctgacctctttatttaatttttaattgaattaaaacatatattcagtaagggtaccaattttaagaatttagcttaatgatcagtcacatggctttttaaaactgctatgtattattccattgtataagtgtacaacaatttttttcattttactgttgagtcacttacagttctgatcttttatgagtgtagctgctgtggatgtttttgcacatccttgtcagacataagcagtcatttctcatggagtgaggttgctgtgttacagggtaggcatatgtttagtctccagcggatactgctgaacaatttcaacagtataggaggcaattaagaccccagtttttctacatcctcaccaacccttggtattatccatctttttaattatgaatagtatgtatatgtataaagttatctcatgattttaatgattattatttattcatttattgctggttgttcctgatgattaattattttcagcatttttgcctgtgcttattgctttgactcttgttcaatgcaatgtctgttcaaatctttttacatttttccattggttttattattgatttaaaggaagttttatgtatttgagaaataactctaatcagttacatctgttgcagatgtcttcactgagtttatgttttccctcaaaacaatggtactttttgatggataaaattttttaattccttatcagtcttttctattaaggtagtgcttttagtgacctgttgaaatttttcctatccttaggtcataagggacttgtaggagctttattattttgcctttcacatttaggtccgatccattttgatctaatttttgcatgtaatgagagattttttaatatgcagatatataattgatctagcatcatttattgaaagaccatttctgccactgaattgcattggtgcttttcttttaagtgaccacatatatatgaacctatttctaggctcttctgtttcattgaactatttgtctttgtaccacctgcagtctcttaattatcataattttataataaatattgatgtaaagtaaatcttaattttgttactgttcaagattatgttgggtctttgaatttcctttttaattttaggatcaaaaacattacagatcggtttaggaagaattaaattgagtttcttaatcagtccattaatatgaatatctcttcttttattgaagtccttcttacattctctctgcagtgttgtatagtagaggttttatatgttagatttagtcctggctatttgatgtttttcatgctattataaatgtactactttgtaaatgtttctaattttaactgatatataggaaatatctgttttgtatattaattgcttagtcaacaatcttgctaaatttgttaatgttaggttttataggtctttcagatcgtctacgtatataaccatgtcatctgtgaacaatgaattttacttccttctttcctatctttatactgttcattttcttttttcttgtctgatgcattggtaagacctccagttcagtgttgaacagaaatggtgataataaatatcactgtcatgttcacaaactgggggacacagtatttcaccattgtatatggtgttaccagcaggtcttctgtagataccctttttgtattaagaaagttaatctttattcctggtttatggggagtttttatcctgtaagtattgaattttatccaattatttatggagatgatttttctcttttattttgttaacgtgataaattacattgattttctaacgctaaaccattcatttgtggggggaaaaaacccacatccttataatatatattatatatcattgattttgaactgcttatattttgtttaggtttacatctgtgttcacaagcatgaacttaacgatagtgtcctgaaatttttctgtcttgtaatgtttcagaatgttatttcatctctagatgttttgttgaattttccaatgaagctatctatctgtctggccctggagttttcttgggaaggattttagttctgaatgcattttccttagcagacacaagaatgttcagattttctttctcttgttacctaagaggactagataacatttgatttttttttttttttttttttgtggtgattgtcaagcattgatggaggggatgtttctcacagaggcagccttgcaagtgagcagatgtcaaaattggaaaacaatttttgtactagttagaaaaatatttttagcaagaatagtaaaagaaatagggaagatcatagaagttatacatgaactatagaagataaagagccacaatgtttataaccaaaataaggtagtcaaaatatgatactcaggaataaaagtaggaaaaaaaagaagtctgttgaatctaacagagaatacagtttctctgccgacattaaaatgttcctgttttttacagtatatattttctcgcttttaacttatattctctttagctgcatggccttgctacttctgatttggacaccagtcttttcccattctcacttcaagctcttctacttgcttttctataaaatcttatagtgttgaatcattcatcttaatatataagaaaaatgaattaggcactcttgtgcttctctgggggacctttttacataagatttggggtataagaaatagtactgttttatctgatccttctttgaggccgtcatttctttcataggaacattaatttttagtctctgttgtctgagagtatgtggtacatgtgagattaactgccccagaaaggatgcattgactaaagggatagtctggatgtgtcagggaaaatgtatattttctggtttgggcatttgactggatttcttgtctagttgttttttttgtttcatctaaatatgaaaatgcagcaaaagaatttaagagtcaaaaatcagtaaactctggatttttaacaggctagtgattgtagaggttcacgtgggtatctattgattgagggctacataccaattcacttgaaaatcccatattcttactgaccacccaggaaagactttggactttcaaagttaagagccattggtagaaagtcctttggctcaaatacaaacgagcatcttatatatgaactggataggaaacaattgctgttggatactgcaaacctgtaatatcaatagatacactgcatctctaaaatactatcgtttcagtcatttcctgttgtctttcatccagttcactttattcctttatgttacctatctggccactatagtaatttgaactaataattcctgcatttttgtactccagtgcgtagtatgctgcttccctccatagaagatatgctctaatttaataaaaaagagattaatgcttgataattaaataatacagctacttttgaagtgctttgtaactttatcatagttgaagcctcaagaaagttaaatattgcttcctctgtgttttggtaatgattggaataattcaagtgtcttatgtctttgtaagctacagctgccatgtgttacctacctgtgtctttagaaagcatggtcaggaatcactataattttctgttattagcttttgctagaatggaaaacctatatgtggtatttattactattgaagtgaaccaacgtttggtttttgcttttttttttttttttttctttctcgagacagggcatctcactctgtcacctacgtaggctggagtgcagtgatgcgatctcggctcactgcaacctccacctcccaggttcaagcaattctcccacctcagcctcccgagtaagtgggactacaggccacaccaccaagtctggctaatttttgtatttttttggtagagatgggatttcaccatgttggccaggctggtcgcgaactcctgacctcaggtgatccgcctgccttggcctcccaaagtgctagggttacaggcgtgagccactacgcctggacgacagtttttgcttgtttttcgtttttgctttttaccaggtttttattcttctatgggtgaatttaaaagcatagatgtaaattaggttgacagatctgagctagtataaggacatagtcttttcgcacttattggaaagcctctgatttttattattcacaatcaaatttggactgtatataattctttaagtaatctgggtgtggtggcttatgcctgtaatcccaacactttgggaggctgaggtgggagtatcacttcaggacaggagtttgagactaacctgggcaacataatgtccagttttttggctgatgagtaaatcttctctaccaaattctgatatataaaggagtgcatataaattacacattaatcactcataaatggaatactgattggcttgtttcgtgtttgaagtatttttcactttgtttattttgaagcttcttctcagcctgttgataaccatgttagcccatcttccttcttgggccagacaccagcatctccagccagatactccccagtttctaaagcagtacttggagatgatgaaattacaaggtaaggaagttaacatttatccttcttacataaaatcaactattaaattgaattttaatcagccatgtaagatagccacaatttttaggactaaaaaattttattgacagttagtgagcttaaaggttaatttttttccataggaggattcattgaagagcctgaaatatacatgttttatttttacaaataaattaccactccttttttaaaattaatactgcttttctttgaggcttggtaaattgtccttaggaattagcttagtaaaactaagttaagaaaattcttatgcatattttaaagtaacattttatatgttccttatctaatatataccataaaaatatggcagttatttgatttgtgttcagaattcaataagtggtggtttggtttggttttagcaggagggtcttactctgttgcccaggctggagtgcagtgctatgaacgtacatcactgcagcctccaactcctagactcaagctatcctcccgtatctgcctccctaggtactaagattacaggcgtgatcccctttgcctggctggtgggtgggtttgtttgtttgctatatatccttgatattctgacacacaaaatttactttcatctaaaattactacctgcactgaaatgtatagattaactgtctttttaatcccaaagaattctaatgaggtagaaaaaaattggtgaaaaagcattgtagatctttttcatattattcaatatagtaataagacactatagagtttgctttgtaatttgtacacgtcttttatattacagattcaacattaaaatgtgtactaagtaatgtctgttcttaacgtttattgattacattattgttagcattattattattttttacttatcagactcctgattctaggcagtgatctttaggacagataggagtgtttgtctcttttctttcataaagaattagcaatgttggaaacttaataggttgtcagtaattgtgtttgggatgaaaattagcagaaagaatagtgttcttatttgtttgtgatgggaatatccaaggctgctagtcttcaggcagtgcttctagagtgacctttcattgccatttatttttattactttctaatagtgcctatttaaggccgtaaagagggaaactgtaatagtgaatggcttatctagtctttaatctctttgcatattttacaaactaaaaaataagttatatttgcaccttgattactgttcctcatgcttcttcacttgagtctcttgtctagaatattgcattggacttttaagtatgaaccactcccttttgataatcacactactttgtaataatgaagtataaaatctttccaacattataagttcttcacaatttgactttaagcagtctttcagatgttaccaatatcaaaaaagtaaaaaaaaaaatcacaacatacctacattttggttctaaagtttattttttaacagctttattgagatatgattcacatatcataaatttcacctgtttaaagtatacaatttgtggtatattacatcagtttttaaaaattgtagcgaaatatatataacaaaatttgacattttaactatttttaagtgtacaattcagtagtgttaattgcattcacaattttcggaacccttcactatttccaaaaccttttcattacttcagacaaactctgtgaccattaagcagtaattctcccttccactgtcttcccagcccctggtaacctttaatctactttttgtctctatgaatttgcctattctggatagtttataaaagtggaactgtataatatttgtccttttgtgactggcctatttcacttatgttgtcaagatacactcatttgttagcatgtatcagaatttcatttgtttttatgacaatactgttcaattatacatatatgccacattttgtttattcatctaatgatgggcacttgagttattttcaccttttggttattgtgagtaattctataataaacactggcatgcaagtatctgtccaaatcactgctttcagttacttgggatatatacctaagggtggaattgctgagtcatatggtaattctatgttagctttctgaggaaccaccaaactggttttcgtagtgcctgcaccgttttatattctcatcagtaatgtgtgagttgcaatttctttacatcctcatcaacacttgttactttttgttttgtggtttttttaatagccatcctagtagacctgaagtatctcattatttttatatctctttccctagtgactgatgatgttgagcaccttttcatgtgcttacattatttgaaaatcagagtgtattttcccctggaaatactgttgaatttcagctgagtattttttaatcaagtataatttcctaatataaaattctaattcatacatattttaaagcataatgggaacagtaaatccggaattcaccatctaatttaggaaataaaacatcactaatatgataaaacctacctgtgcccctgcagataggttttaattatttcatataaaaagcctgaagatgggcatttccaaggttggtatagcaaccttaggcctgtggtgtcttcggtatactcttggtttcaccttcctgattataatatgtccaaaccagtaaagggattgtattattcagtcgtgtggggttttgtttattttgtttcgtttttttgaggaaaggaaggtagcaaagatgctttgtccttgataaggtttgtctgtctctagaaaatgacaataaaatttcccttcatttaccagaggttagaatggggttatactctcacctcagcaaaggggcatgggattgcaataacttgtttaggttggttatggttcatccctttgagactggagaaagggcctgccttctctaagacaaaaggatacctgccttttaaacttctaagtaggggcagtgattgctttgaaggcaataaagtgtgcaacatcagcttttcatgagtatgtgtatttcctgataagctcttataatacttttaaatttccacgttttttttctgttttggtttcatttctgttttatataacacaggttttttgcttttatataaaattagattttttcctttgatttgtaggcttagaatctctttatctcgtagttttagaaaaaccatttatattttgtctagctttctttgtagtttgataacataaaaattatcagtaggtagttctcactgatagaatgtcaggttttatataaaatttccaagatactcaattttttttaatttttagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaagacacgttagtcaagatcacgtttttgttattttcactggacctatttttaaagcaaggtcttctgtttttttatatcctaaagtaatggggatatcttggttatcttcttaacattttacagcttaattgtagaattgtagtgtcagagaacatattatataataggtgttcttttatagaaaggggtcagtttttataaatgtgcttgaagaaattatgtgttctctatttattgactggaaagtttgctatgtgtctattaactcaagtttgttacttgtgtacttctttatactttaatctgttaccttcttgatctattgaggttttgaaagctatccaaatatgatttttttaaagctacccaaacatgggttcaacagttggtcctcatagcattaggtttttttagtatgtcttttgaaattgtattattgggtacacatagttttatagttgttattatgtaatgaacatcttgatttataatagtggttttaccctagaatctatattgtctgctattaatgtggctgattttttttttttggcttgatatttgtgtcatcttttctcctcttcttactttcaatttgtgtgcttatgttgttacccatacacaatttttgtctaaaacttacctatagttctactgtgacacacagactttgggaaactttaattctaatcatgccatttctagtattttacttctgtttcatgtttatacccataaattgtaatttttatttttgtttattaaaagttaatccacaggtcatacaatttttgtttaccgtcccatcttgtatcttccctcttctgtgtttctcagtggaccactaacagcatttggattgtacagttatttgttgtataggactgtcttgctcttcatagaaaatttccctttttttttttttttttttttttccttgagatggagtctcgctctgttgcccaggctggatggagtgcagtggcgcgatcttggctcactgcaagctccgcctcccgggttcatgccattctcctgcctcagcttccctagtagctgggactacaggcacccgccaccacgcctggctaatttttttgtatttttagagacggggtttcaccttgttaaccaggatggtctcgatctcctgacctcgtgatcctcccacctcggcctcccaaagtgccgggactacaggcgtgagccactgcacctggccgaaaatttcccttttttaaaagctttcatatacatgctacatgctagtaaaactccctagtcattgtaaaaagcaaaaatgcccttcagatatctaaatgcaccttagtgtgcaagcccttgatttgtgctttcagcaatggttccttaatcgtaaatattctagactttatctgaaagtatctttattttatttcactttaaaagttagttcaatctagaattacacaggttgatagctgttacctctcagtattttgaagatactgttttatgttgtctggcgtgttgtttctatttaacgaaagaagtctactctgtcttgttcgtaggtgacttgtgggggtttgctggctgcttgtaagatgctttgtgtttgatgtgctgcagtttcactaaaatgtgaaactttgtcgatgtctagcatattatttattgtgtttgggattcattatgcctactgagtcagaggagtcatgtctttcatcaattctaaaaacttctctcatcaattctgaagacttagccattgtcttttcaaattttgcctttcccatgttgtatgtactctgtccctaaactcctatgagtggatgtgaatctgtttttcatgtctgttaaccccaatttcatatttacagctctgtctccttgtaattcaagtttataaattttcttttcttttttctttcttttattttttaagagacagggcttcagtgcattgcctaggctggagtacagtggctattcacaggcacaatcatagagcactattatagcctcaaacttacgggctcaaacgatattcctgcctgagcctcccaagaagctgaaactgtagcagcttcaattttcttatctatatctaatctgaaactacatcttatctataccttacctataactgtatcttaactatatcttatctatatctaatctgaaactatagcagcttaaattttctttatctaatcttaaaagctacgattttaagatacagaaattgtcggcttggttcaaaaaagcaagaccaaactatatactgtttatcagaaatttactttaaatataaaggttcatgggttgtaagtaaaagtgaaaaaaggtacactatgcaaatagcatactaaagctactgtcttaatatgagacaaaatagaatttaagacaaataatgttattatacatagatttcataattataaaagcagcgagaaagataaaagtgtcatttcatcaagaagacatacctagtaatactttcaaaatacatgaagtataaattatcagaactaaggaaggaaatggacaaatctacagtcacatttggagatttaaatgccctcttctttaattgatagaacaagtagacacaaggaaaagaagaagaatctcatttcttacttcatgttgtatagaaaaattaacttgaaatggaccatagaactaaacttctaaaagaaaacatacaagaaaatcttagtaaatatggattagacaaatttcttaaatagtaccagagggccaccaagtcagttcaatagagaagggaaaatctttttaacaaatggtgctataatacctagatatctgtatataaaattataaacctaaaccagtcttactccagacataaaatttaattctagatggattatagatctaaatataaaactcagaaccataatcttcctagaagaaaatatcagagactatgttcacaggcctagagtaggtaacagttccttggacaaaatgcataaaacactaaccataaagaagatgacattaagaaaccaaatacgctgggtgacgtgactcttgcttataatcccagtaactcaggaggctgaggcaggtggatcgcctgaggccaggcgtttgagaccagcctgatcaatatagcaagaccccatctttaaaaaaaaaatttttttttaattagccagacatagtagtgggcacttgtagtcccagcaacttgggaggctaaggcaggaggatcacttgagcttaggtgtttgaagctacagtgagtgagctttgatcccaccactgcactccagcctgggcaacagagcaacaccctgtctcaaaaaaaaagaaagaaaaaaaccaaataggcaagccacacagtggtaaaaaatattctcagcacatacatgacatactacttgtatccacaatatataaatatctcctacaaatcaacaataaaaagatgaataacccaattaaaaatgcaccaaagacttgagcaggtacagcacaaaagatatgtgaatggccagtaagcacatgaaaaggtgcttaacattaggcatcagagaagtgcacaaaccgcagtgaatgaagaggtttgtagggagttgaataagagtgatgtaattgttctatattttgattgtgggtggctgcacgaaattcacatttgccaaaacttaactatacactaaagaagattgattatgcctagataaaaataggtattcttgaagtcgtaatgaaatactatatcccacttagttgaacaacaaaagaaaaaaataacaacattcattgatgaggatgtggagcagctacaaccctcattcactactagtggacgtgtaaatggtataccactacaagaacttttgggaaggtttttaagaagttaaacatacatctaatcttatcacccaggttttacccaggacaaatgaaagcatacatcaacaaaaacactttgacaagaacattcttaacaaccttattcataataatctagaccttgaaatgacccaggtttccatcagcaggacaattgctaaattgtggtatgtttacacaatataatactactcagcaattaaaaggaacaactactgaaacacaaaacaagtatgttgagcaaaacagataacaaaaatacaatctatataattccagttacatgataatcaagagcaggtgacactaacttgtggtgctgtaagtcagaaagtggttgccagtgattgggactgactatagaagtgcacagttgaacatcggtggaaaagatacatgtcttgtctggggtagtggtttcatgatttttatggttagcaaaatcctttcagctgagctgttcaaatttctacatttcattgtaaaatatactgtaatttatttaagttacagtatgataaggaaaacttagtggtagggaatggacttaaaagattaatattgttgaacatattacctagttatttagggaaataaaattagcttagagcctcacttcacactttgtgtccaaataaattttcgtttagcctagagttcagtaatagatgtttttaaattgtccctttggaaccactttagataggtcattgatacagtgctaaagtgtgtgagaccaaccaactcaacctagttcacccagaacattcatggttttagaactgaatgccccatgtctggaaaccctttggtcttgattctaaaactggaagtctcagctagtccagggaagtagctcaccctaatgtgagtgcagttaaatacagcattatgtttagcaatatgcatcagtaaccttaaaattttaatgcttactgaacttctctagggaaatgccctaaaagcactaggaaatagtagaccgatcaataaacttaaaaggaaaattggaggagtgaattctccataaggcctttgaaaacctccgtgtatccttggaaccagaaggccacacacatgttcagggctgtgcgcatgctcaggaaagactagaaaaggccttaaactctcacctctacctgatcatgagcctctgtgcaagcgatttaaggcagttgttaattgcttatctgagtgttaaaggtgggccccaaaatgcacatatagcccttggaaaagagtggaagatttgtaagtttcaggtatttaaggaaatatgtattcagtcattaaccactaagctaaccagacagagacctcagtggccacacacaacaaagaatacggactttataacattaagaaaagtcactaacagacagcaatgacaagcgtagataagaggacagttctgctatctggagttgccgtattatatttattttaaatgcctatttttcgtcataaaattttgagacaagcggaaagaaaagtatggcccatatacaggagaaaaacgcaatcaatggatatcgttcctagggaaggtcagacattgaacatgctaaacaaagacattaaaccaggtattttaaatacgttcaaggaataaaagaaaaccatcctgtagactgacatgaaagtaaaggaacaatatctcaccatgtaaaaaatatcaataaagagttagaaattatatgtaagaaccaaatagaaattctggagttggaaagtacagtaacttaaatgaaaaattctctagacaaggtcaacagcagatttgagctggcagaagaaagaatcagcaaacttgaagatgggtcaattgagattttgatgctgaagaactgaacaataacaaagaaagaaagaatgaagaaaaattaacagcttcagagacctatgggatactatcaaatttaccaacataatgggagtatgtgaaagatgggaaagagagaaaaaagaagaaagaatatttgaataaatactcgcccaaaaacttctagaacttgattaaaaccattaatccaagaacctcagtgaactccaagttaaattaatttaaagagatctacaacatagacacattacaatcgaactgtctaaagccgaaggcagaatattgaaagtagcaaaaagaaatgactcaccacgtgcaagggatcctcaacaaggttaatagctgatttctcatcagaaaccatggaggtcagaaagcagtgaaataacaaattcaaaattctgaaaagaaaaaaactttgttgactagaactctatatccagcaaaactatcttttgaaaataaagaagaaatcaggacattgccagataaacaaaagctgaaggagttcatctctcaaaaacctgccctataggaaataagagaatccttcagactaaaatgaaaggaaactagagagtaactcaaatccacatgaagaaataaagagcctaagtaaaggcaactacacaggtaaatataaaacaacataagggtattgttttatatgcaactctttttttctccaacctgattttaaaaacaactgaataaagcaataattacaaatttgatgtgcacacatcgtataaacataaaattaatatgacaacaccacaaggcgggtaaagaaactaggttcttataaaatgtttgtttgtttacttatttatttttagaggcagcatctcactctgtcccccaggctggagtgcagtagcacagtcatagctcactgcagcctcaaacttactcaggcaatcctcgtgcctcagcctcccgagtagctgggctgcaggtatgcaccactacacctggctgaattgttttctttatttttttagagataagggtctcactgtgatgcctagccagccctcaaagtgttgtactcaagtgatgctcctgcttcagtccttttgcctgagccacctgagtcactgggattacagtctagaaccaccacatctggctttaaatttttacttataatccaagataaccactaagaaaatgactaacaaatatatgtagtaaaattaatgacatgggaattaaaatggtacactaggaaatatctatttaatataaaaataatgcagtaattgaggaatagagaaagaaaagacatagaacaaataaccaaattaagtaaattctacattatcagtaattatattaaatataaacagattaagcactccagttaaaaggccaaagatgttgataaagtagattagaaaacagaatccaactacacagggtctacaagagagacactttagactcaaagacacaaaaaggttgaaagtaaacgggtggaaaagatgcattacacaaaaagtaaccaaaagacacctactgtggctgtactaatatgactaatatcaaaggacgcttgaagaaaaacattattactaaaggcgaaagacatttatagtatatcattatgtagtcatagatggtatatattttatagttatatactctaattaccaatacatttctagaaagacataaactactgaaactaactcaagaagaaatagagaattttaatagatttaaaacaaggaaattgaattagtaatcaaaaactaacaaaacacaaaaatcccaggaccagatggctgcactggtacattctgccaaacatttaaagaattaacaccaatcattcacaaactcttccccaaaaaggaataagcatgaggaatgctttccagctcattctgtgtggccagtattatccttataccaaaccaaagacatcacaagaagaaaaaattacaaaccaatatcccatatgaatatagatgtaaaaatcaacaaaataacaacctggatccaacagcatgaacaaggatgatgtaccataaccaaatggaatttattcaaggaatgcatggttagttcaacatagaaaaaccaatcaaagtaagacaccatcttaataaaggacataaagcacatgatatctcagtagacacagaaaaagcaattgtcataaaccaacagcttttcatgataagaacactaaatagactaggaataaaagggaacttcaacctgttaaagggtatctctggaaaccctatagctgacatcatactaaatggtgagagactgaaagctttccctctaaaatcaggaacaagacaagggtatctgctcttcctacttctattcaacattgtcctggaggttctagaaattaggcaagattaaaaaaaaaaaaaggctaccagaataaaaagcaagaaaactatttctgtttgcagatgacataatcttgtatagaaaaaatcttaagaaatacaacaacagactgtcaagctaataaatgagttcagttaaatttgcaggatagacaaagaaaacattgatttataatactatcaaaaagaataaaatacttaagtataaatttaaggacatggatcaacaaaagtggtatatccttttttttttgggtttggtttttttgttttttgttcttgagacagagtcttgctctgtcgcccaggctggagtgcagtggcgcaatctctgttcactgcaagctccgcctcccagcttcacgccattctcctgcctcagcctcccaagtagctgggactacaggtgcctgccaccacgcccggctaatttttttgtatttttagtagagacagggtttcaccatgttacccaggaaggtctcgatctcctgacctcgtgatctgcctgccttggcctcccaaagtgctgggattacaggcgtgagccaccacacctggccagtatatccatttttaatggattttagtggcgcattatttagcgccactaaatataaggaatgaagtactgatacatgctccaagggtgaacctggaaaataagtgaaagaagccaagcacagatggctacatattatatatcccgtttatttgaaatataccgaataggtatatataggtatatgtacagtatggtcagaaagtagcttcgtagttgccagggatggagaggagacacaggagtgactgtcagtggatacagagtttctttttggggtaatgaaaatattttggaattaggtggtaatgatggttgcacagacttgcaaatataccaaaaaccactaaactatatgctttaaaaatgtgaattctatggtatgcgaattatttctccatttttaaaaatgtcggtgtaaaagaaaaaaagtgactctaaggctatttatacaagtatctctctcagtactggaatttcttctaaaatatccttaataatgtatcttcaattgaaatgttcagtgatagtctggaaagtctttaatatgtagttttgttcaacaaattatgctcttaaaagagtttggtgcacagaaataattcattaacattcttaatcttttctacaataatctgtgaaaaacctgtctttctttatatttcttgcctgatatgttctcccaggaattgggaggattttctttatgcactaagtagaactgtttatacattgtattgagttttatatggccatcatcagctggagatactaataaccacattgtttacatttgtttatgttatggattttagatcttggttttcattgaggggggtggggggggctggctggagacagagcgtccctctctctgtcacccaggctggagtacagtgatgtgatctcagctcactgtaacttccgcctcccaggttcaagtgattctcatgcctcagcctcctgagtagctgggactacaggcacacaccaccatgcccggctaatttttgtatttttagtagagacaggtgtttgccatgttggccaggctggtctgagactcctggcctcaagtgaaccacccacctcagcttcccaaagtgctgggataacaggtgtgagccaccatgcccagcctcaaggggtatgtatttaaatttagttgcataatggtttctttttagataatataaaacatcagatctttatatggttaaaatgttctttatgtaaatttatgatcccaagaatttctgggctcatagtcaaattttttaaaagtgatatgtgatctttaacagattttagattagttctcaacaaaacaagtttttgtgtaaaaattgcatgatgatcgttcctttccaaaaattttcagtgaaggtcctgaacattgccatattctattcattgttgcttcttaattttttttaattcggtatttaaagtttattacattcaagtataatgcttccatgaatgtcctcttaagtttgtcttattgtggaaaaggaacaatctcttaagataatgtaccttgcactatatatgtatatatgcgcgcaaagtattggtaacctttgagaaataagaattaagttgcctcttcttctggagtaggattgtacctactggtagaattggataattatttcacctaaggaagggctcttaattcaaaaaataactcctggttcatttaattaacatttattctaattaaatcagtccttgaaatctgagctgttttaatatttctaaataatagctttcctattataccaaaagaatggaagttttagtttgtacaggaagaaaaataattggaactgaattgagcagtaggcgtgagaatgtggcaggaggtaaatggatgctacaagcaaaatgactttccctcccattgcttgagttcctagcaaaataaagtgtgcaaaatgatgccacttgatttttcaggttctcaaattaaggtacatttctcaatggattgatacccagccttctaggggaaaatgttttggttttactaacttgacattaagcaaggtggttttagtaaataaaatagctttgaatgataatattttgttttactacacaatatatttttagtcaatcagaacaagaaacattttagtggtaaagttattgcaactaattttttaatacatgcttactcaaagaatagactattgtgatttctaatcacagtgattcttttctcccaaattaagatttggtttgatttacaggtaaacagtgttgacctcagagctgctagtcatgagcaggcagcagctgcattgaaaaatgctggccaggctgtcacaattgttgcacaatatcgacctgaaggtaataacattcttattgtctatagttattgcttattttagtttttaaaattcttcctctttaatatttaataatgtttaacttccaagctaaacttccttttttgtgctttttttctgatttgctaatccagtatttgtttagtctgaacctagttctttttccagatcaaaagttgtttgtttttttggttttttttggtttttgttttttgtttgttgagacggggttccactcttactgcccaggctggagtgcagtggtgcgaactcagctcaccgcaacctctgcctcccaggttcaagtgattctcctgcctcagcctcccaagtaactgggattacaggcatgcaccaccataccggctaattttttgtatttttagtagagatagagtttctccatgttggtcaggctggtctcaaactcctgacctcaggcgatccgcccacctcagcctcccaaagtgctgtgattaccggtgtgagccactgcaccctgccaaaagtattttttaatgatgtgggaactggcatccacaagcttaacccacaaaacccccattatgtgggttaatttaactgtttacttttttaaatctgttctgtaactgaagacatagcttttaatgtcccttttactactttattgatctgaaaaaataataaaaaccataagcagatatagtaataatgcccaaaaaaattaggtcacccagattttttctagcttttgaattaggttataattattaatatcaagatttaagacatgtttctaatagctgttactgccgctatttaaaataaagagaagaatgccaagtttggagtatactgtgtgtctagatggtgaagtatggtggatgtgactttactaagttcctgggggaagaaggtggtgatggagaatttgaggtcatgccatagtaaacatatgtaagactctagtgtacatcagcataaccacatctccaataaaacctcagtggaatttagaaagcttaaatacccaaaagaatacatagcatatttgttgatgctcataaacaacatgatgaataaggaaaagatgatgtgagtaaaggagctaaatgagtaattctgtaatttatcaactaattacatttattcttttttgaagcagaatttcttttttaatctagtatgttttttagctgatcaaagcagcatgttgagcattgcttggtctttcttaagtatgggaggttctatcaatctagtaaaaccttggccttttaggcttagtaactaaacaggggaaaatttgtttaattgggagtaaattctgaatattaattcacattaaccaaacaatagagactaacgtatgaagtcagaatgtcaattcgttaatttttgtgagaaacaaatctgccaatgggaccctatgttgtacttttatcttctggccaacatattccaccccgtaggtacactatatggaagccgagttacagtcactggttccttagtattatagacagcctctcatttatatgtttataaggaatataaactttttaggtatggttacgggtaacttaatatctgctccctaacctcaaaacacacagaacacacaaaagcagtaagaaaaacaaaacatacacgcatgctcctacccacacaacttcacttaatattaactaaaactaagaaggcaggtatgatacctggacaaccaagtagaggtaaagactccttaagcagctgaggtcttgcagaagccacacggaaagaggggaagagttaaaatatggaatgttgagaatgtttgtgatggcacaaatttaggatatggtataaaatttcactcataatgtggtttggtttagaaaagcagaggacccgtatttggataaagcagcctgcctctgtaggatcagataatgtgacagtatttgggttttaaaacctgtaaaaatgtcctgtgcctctatctttcctgcacccctcgactttctggaatagctactctagcaaaatctagcaaagtaataagtaattttttttgtttgttttaagatggagtttcactctcttgcccaggctggagtgcagtggcacaatctcggctcactgtaacctccgcctcccaggttcaagcctcccaagtaggtgggattacaggcacctgccaccacgcccggcttatttttgtatttttaatagcgacggggtttcaccatgttggccagactggtctcctgacctcaggtgatctgcctgcctcggcctcccaaagtgctgggattacaggcgtgagccacagcccccagccccagtaataagtaatttaaaagtagcctcacattcatacaaagataataagaggtggggaaaagcatcaaagcttagtaacaggttagctacacgcacacacaacacaaaaacattaacacaaatcggattttaagaagtacaaaaggagtcatccgacactctgataatcagcatcttgcagttagtatctttcctaaaggcttgggattctctgccttgttgataatcttatatatatacatacaagacagacagatagagacaaaggtaagcttttggtagaattaagttttttatctttcaggatctatggtttgccttattagtcttccaaaaaagtacttttatgggtttttcagcttgtgtactttgaactttcttgacttggattctgattatgagaaaaaataatctctacaagacatatgaaggaacattatcttctaactcctttcagttttattaattccaaaggcaaggaataattcactttggggggcctttactgttaatctttttggagaatcattatcagaaattagctggacgtggtggctcaggcctctaatcccagcactttggaaggcctaggtgggaggattacttgagcccaggagttcgagaccagcctgggcaacatagcaagatcttgtctctgctaaaactttttttaaagttttttaattagccatgcgtggtagtgcgcacccgtagtcccagccaaggcaggattgctatgatctcaccactgcacttgagcctgggcgacagagtgagaccccgtctcaaaataaaaataaaaataatcgaacatgggaactggaaatataatactatactcgttttggactccatatcccaaagttataaagttttatcacatacttcctatagtttaagaatctcttggccaggcgcggtggctcacgcctgtaatcccagcattttgggaggcctaggcgggcagatcacgaggtcaggagatagagaccattctggctaacacggtgaaaccccgtctctactaaaaatacaaaaccaaaattagccaggcgtggtggcgggcacctgtagtcccagctgctcgcgaggctgaggcaggagaatggcgtgaacccgggaggccgagcttgcagtgagccgagatcacgccactgcactccagcctgggcgacagagcgagactctgtctcaaaaaaaaaaaaagaatctcctgtgatagtatataatagtaaaactgtacgccatgcatgatacgaaccatgttatgtttattcactcttttaactcccaagataatcctgtaagtaagcaccgttatccccgttttacgttgtagttgaataagctcttccataaagagaccaagtaatttgctagttacacaactgttaaacggttaagatttcttctagccccttttaagcgaagaaaaaccttttcctccacccttgtatgttcagtaacgggcctgtgaagtaaactgacaaaaaaaacagattaacatggaaaaaaagtttcttgtatatggatgcaagaggcaacagaagaaatactgaagctagcttgtggatgaagttaaaagcttgtacacctaatctagtagggaaaggaaggagggagaaacagcttttattagaaaaacgtacatttcttcaggaaagacaagtttttaggagaagagatgggggataaagtttgtgatgacatttgtctaaactggtatgactggtctttccattcttcggggccatcagactcctcagagggtatttatggtaacttcatttctcggaagctgcaccttttagtcagattagagaaactccgagaaggcttttttcctgcatctgttgaatctcagatatcttcagcttaaaatctttgtggcaactctggggttctgggtgggtctccataccctgttcttactctttcaactactcattaaactcttggaatctctcacctcaaatatttaatcttattgttcctcaagagtattaggccaactttcagagcttatatctcaatcttttgttcagaaagcattaattatattgtaataataccataaaagaaataaattggaaagaaactcaatatataagttaaatttattttctctttcccattggttaggtcttatatttgtgacatattttattttcgcaagaaaaaaactgtttggtggcataatccctattttgcaagtgaccagagtctagagaggttaggccatagtcacttaacttttctgcgcttcaaagctttgattgaaatcttgagttacaaaggtagatttctaacacccagtgtcctgactttattttcattattacttcttataccaaccaaagggagaagaggtggagataatctgggaagattgcagtggactagtggcatttatttgcagacatttgtcatttcttatcattttcagtagtagataggtaattaaaatttttttcagtctcctgctttcccacttcccttgctgtatttttctacgcgcctgtgctgcagttgacccttgaacaacacaggtttgaactgcgagtgtccacttacgcacgtgctgttcaaccaaactgggatagaaaatgccatatgcctgtcagattccacaaggcctcctgttagacttgaacatgcacgggttttggtatacgtggggttctggaactaatcctccgagtatgccagagagctattgtacttaaaacaactaactggccttcttaaaaatagtttccctttttctttaggccaattaatagtatccatcctctgagaattgtttctcttgggtttaatatctgtgtttaatgtattttattacagttataaatgaatgtttttctttatagggattgcatgttaagaagagattgaggaagtccaatttcccccataccccttcctcactttttacttctagtgtggcggtgaaaacaaaggttaaaatttgaaaggggatatcaaatgaaaaaatcagcttttaaatatctctccttgtataagcgtatacatactaacttgtagccagcagttcagatacgtcctaatacgtttcatgacaagaaatatggtttgatacaggaatttttgagatgttgaatggagaaaatctcttatgtaaaattatagctttgctgagttttgatgtaattctaggagaggagtgtaaatgacttaactgaaaaaagggatgaaactcttccgtcaaaataaaaatttaagaaaataggtgtagtggttagcacttcgggaggctgagacaagaggatcacttgagcctaagagttgaagatcccctgggtaacataggacaccctgtcgctgcaagtaattttaaaaatgagctgggcatagtgatgcatgcctgtaggctcagctacttgagaggctaaggtaggaagattgcttgagcccaggaggtcagagctactatgagccatgatcgtgccactgcactccagcctggatgacagagcaagagcctgtctccaaaaaaaccttaaaaacaaaacaaaaatatgttggtgggagtatttacgaaaatatacacaggataggtaaaatgtggagactgataggactaaaagtatcaattgattgaaacaaaaggaaaaggtaggaatcttaagtaggtaaatgaaatagaaggtttaaaggaaaagtaactttaaaatgccgaagtatgttttgaacatatagaaaggtagctgtgaggaattgttaagagtaaggcaaagacttggccaggcgcaatggctcacgcctgtaatcccagcactttgggaggccaaagcaggcaaatcccttgaaagcaggagttcaagaccagcctggccaacttgatgaaactctgtctctactaacataaaaattaaacaggcatggtggtacatacctgtaatttcagctactgaggaggctgaggcacaagaatcacttgaacccaggaggcagaagctgcgatgagccggaattgcaccactgcactccggcctgagcaacagagcgaggtgggggcgggtgggaagactctaagcaaagactataaatatgaagatctgaatacagtgaaagaaatagatcacaaatttaagaaattatcaggaattgacttagctcttcagtatcttaaatttttaatatctgagactatgttaactgctttgtagtaacttagttactcattaagaaagaatatttttctgcatcactaaaaagtaatgtgttctttttacacagaaagcttttaaatttctaaaatgtagactatcttaaatcactaggacttctattaatcagatcagcaaaattgctaaaaactaataatgctacatgaaatgtaatacacatcttatttaaaaagcattgcagaacttttaaggaattagcaaacaaaacatgaagggaaactaggaactcggaactcagggctaaggaagcagagaagtctcttttgtttcaagagcaacagcgtacgggcttgggagagccagttaaattttcagatatttttcaaactaaaacatagcctttattaaaaataaaattatacagaaatacaaataaattatatttaaaatagtaaaattaaaaacaaaggtaatattgaaaagtcatcacttcctagttgttttctaggaagtaaaataatagaaacataaaccagtgagactaacagaaaatacaaaaagagggttgggcgcggtggctcacgcctataattccagcactttgggaggctgaggtgggcgactcacaaggtcaggagtttgagaccagcctggtcaacacggtgaaacccctgtctctactaaaaatacaaaaattagctgggcgtggtggtgcacgcctgtaatcccagctactcaggaggctgaggcaggagaatcacttgaacccaggaggcagaggttgcagtgagccgagatcgcgccactgcactccagcctggatgacagagcgagactctctctcaaaaaaaaaaaaaaaaaagaaagtacaaaaaaagatagtagatttaaaactgaatcgcccaaaactcctcctctccctcaaaaaaattaggaaagccaaaccaaaatttgttaaaaatctacaataaaactagacaaaaagatgaaagatatcctatgaaccccaaatataagctgatgtaaacaaggtattaacagctacaagaccatctgatatcagcatctgtgcaaggggatgcaacaggagaagcccaatgttaaccagtcctcacaagaaaatgcagtaggtaaatttgagaacaccaagtgaactataagagtttttgtacaatctgcatgttgagtgcaaggaatctacactaagatatgaaggggccacgagcagtctgggccctatgacacagttaaccagctgtagttccctttccatttaaagccccacactaaggaagaactgctgggaataaaatccaaattgagtaggatagggataatagagccaaaggaaatagaaggttcagattaatgggggtaagtaaagtttcaggaaatctcacagtgtctgaggtcatgtctttaaacacttgagagaaacaacaaaatagagagttctagagctgtgaagttagaaaacctatcttgactcgtaactcctatgtaaaagttggggaaaactaatttcatattaaaatgagcagtaggaaaagatcacagtcaaatccatggaaacctatttgaaaagtgaaaataaggattagcgtaatgtctccacagtcaagctgtaccagaaagacatatagtttatgaagctagtgtaaaataaaattaatattttgaaacaaagaaaaatgatagagtatgtcgaagaacaacatcaataagttgatagaactcagaaaattagtagaaataaaaacattgttttaaaaactaaatttgactaaaagagacatacttccttaaaccaagaaggtgaaaaagaagaaaaatttgtaaagcaaaaatagaccttctctttctacaacttgatcaatttagtcctaaagccattatgtagaggagagaaaaatagtttaatctacacctcacatctggagaggtttaggagattttcggtggcccattggacttacccatgaggttggcttccatgcagggtaatgccttggtttcaggagtcagagcctgagggctggtgaggaaagcacatatgggaatgctcagagcccagtcagggaagtggatggctgttcaaattcagattgaccaaattaatatatatgttaggttattgttattcataattttcactgttgagaagagagttacaaatatggaagggaagaaaacttaaacatgaatcctgtaatactggattagaactgaagaagttggtttgaagggatggttttccattgatacagatgtaaacataaatatctacgtcagtgtgtatgtatctgtgtgtatgttattttccctggctctgcccactgagagggcctgagcctagtgccaccccaagagcagtgagcacctagcatccagatcttgccttgcaaatattatttcccactgaaattactaaggcttttttgacaaacggcaggttccccaggagtcaggcaaagaaaatgctagattgttctataatatcctttgccagaaaacaagcaagtactcaaggaatgttggagacatgtcaaatggacccagaatctaacttcaagggactctcactggccaaatcaggagcaatctcagcattcagttggtgataataatggcagattataacccactgaataaagtaggaaataatgagtttttactcatataaataaatgaattaattgaaagtttgatgagaatggagaattgtacacagtttcagtaatttatttgcaaaagggaaaagtaactttacagtagagaaacctggcagacacaacttttatcaagcgattaaagttaataacattggtgatgggacaaatcaaaattgtgtaccacctgatacagatgtattgggtagaacataacatttgtgatattcctgccaaagttggataacttcaatctaattgtgtgggaacttcaggcaaacccaaattgagagagattctacaaaacaattgacttgtaatctccaacagtattaaggtcacaaagtcaaggaaacaccgagaaactgctgtgactcaaagatctaaaaagacgtgacaactaaatgcaacaaatgactttgaaatggatccttttgctgtaaagaacattactggtgactcttcatagggatccgagcattagatggtagtaatgtattaatgttacttttgatggttttgtagttatataggaaaatatctgtaggaaatacacactgaagtattcagggatgatgagacatcaagaaggcaaattgctgtcaaatggttcaggaaaaacagtttgtgattgctctagtctttaaaaaaaattagtaagaagaaacaaaagatttgaaagtgacaggtatagaaggtaggtaaagaatattcaacatgcatgtaataggagtctcctaggaagaaatccaaaacaatgctagaaaatgcatagacaagaaatcttttctaaaattaaaaaagttatttcaaactacacttcaaaatgccataataaaatgattaggatttaaaggaaaaaaatatctggaattccacttccctcccccagcagaaaaagaaagaaaattccgttgttctcagtttatagaagacaatggagtgaacatactcaataaaggaagaagctgaatcaaacagactttcacatataaaaactggaatcaaatatatcaacaaatagagtgatagtgttcgtataaacacttcctggggtgagagaacaacctgcagacatccaaaatgataggaggagagatactgacataaggactggtgttagcattaatgaagaagattataaggaagagagtatataacatgaaaaagctatatgctctgacaattttgataaggtacaattattagaaaatggggacagaatttgaggataatatgaaaacagaataagcctcctaattgctttaaagtttttaactggatataaaaggatagtatttccaatccaatctgggaagattgcttgtaggaggagaccaaaagacaaaagccaaacaaaagtttgccattagaacaaaaggacaagcgtgtctgaattgttacacacacacttaaaagaacaaaccatatagtgagactgtgctccagttactgttgcttcatgagatactaccccaagcttaataggttaaaacagccttttaataggttttgtaggttaggaattcaggcaggattctggccagatggttcttgttttccttctggcatcaactgaggtcacttagtgggacttaggtggcaaatgagctgctttggagggcccagtttggctttgctctccttgtcttatgtgttggtggtactggctagaagtttgggctcagagcaccatcatgtgacctctgcagtatggtggttttagaacagtcttgttacatggtatctggcttccactgaacaagcattacagaagaaccaggcaaaagcttcatggcctcttctaatctgaccttgaaagtcatacgggattactttcacattttttggcatacaaatgacccaaagcactagcccagattccaggagaggggaattagattccacctgtcgatggggaaattgcaaggtcacagtgtacaagagcatgtgggatgcaggcatctttggaaaatataatctgccactggtttatttatgttaaaagcttgaataaataagacaggatggtaagaacagaactgagaacaatttcagttatatcaaaagttaattcataaaagcagacaattttcaggcttgctaatgaagcagaatttaaccctgtgcagtacataagagtcatacctaccacaaagaagtaaaggttaaaaataaaggactgcatattgctgtaaaaaaaaaaaaaagcgtggatgacatctttctatattgtgcagtgatcttctggatatacttactattaagtgaaaaaagcaaagcagggaaatgtgtattctactgtttaagaaagaagagaaatgttggctgggcacagtgggtaatcccagcactttgggaggccgaggcaggcggattacgaggtcaagagattgagaccatcctggccaacatggtgaaaccccgtctctattaaaaatgcaaaaattagctgggcatgttagcgcatgtctatagtcccagctccttgggaggctgaagcaggagaatcgcttgaagccagaaggcggaggttgcagtgagccaagatcgcgccactgcactccagcctggtgacagagtgaaactccgtctgaaaaaacaaaaagaaaagaaatgtattatgcttgtgatgtttgtgtgtatatatacacacatatatacagatataaaaatatggaataaatgtaaatgtatttgcgtgtttgtgggtatctttatattgtttaaatgttgacatataaggatcaggacagaataggatgagaaaaagggatagaagctggacttttaaatacctgtgttttatagatttgactgtggagttattttacctacttataaaatcaatgaaaaattttaaaggcaaattgaagttgaaaataaagtacaaatgaatctaaatgtgtatccacttggcaacagtaatactcaggaaggaactattccaagtgattttaaaatggtaattggccaggtacagtggctcacacttgtgatcccagagctgtgagaggccaaagcgagaggactgcttgaggccaggagttcaagaacagcctgggcaacacagcaagatgccatctctaccaaaaataattttttaaaaattagccaagcatgttggtgcacacgatggtctcacctactcggaaggctgaggcaggattgcttgagcccaggagctcaagcctgcagtgaactatgcttgtgccactgtagtccagcctgggcaacagggcaggaccctgtctctaaaaataaaaaaagaaaacaataattcaaccatacatctctagctatagcctaaggattaaaagctacaggaaatagttaactgtttacagtaatcatatcatggtagtagtgttggtggtctaattcactgttgtaatattggataaaacaagtaagtcattatgccggtacttttattctgctatctccactatcttgagaaccagaattactcatatccaagaaagcagatacaacgctaaaataggagagcttaagtaaaaacccagtggtcctaatttttcattagaaaaaccagtataaactcatgatatatttttatgatctccattcatcagtctatagtttagctgtttctacacataccaaagacaacttgccatggattgatatttatttaattatgatggatacattctactattaaggctatttatgtttttattttaagtgttttgttgtaattttgaaaggatagtaaaatattttattattaatgtggaattttaaatgtttctaagctttttgatgaattgttgcttcagttgagcttattatccgtaaaacaaagttgatgattatggtgaaagaaagagtaactcaacaataatcatgcttactcttactctgtcatcttaacctacacaaaatcccagagaagttatttgctgtaagacaggctttataagaaactcagatttgaaatgacctagttgtctgcaatttgttataaatagaggggaaaaaagatatgtgtttataaccatgtaactgcaatatttttgaaaaggtgcttaaacttttgtcattaatagatttagtagtttttaatatgtagctttaaattgtccattttcaaaatcatatttttgtataaaaaatattttaaataaaaatattcacaaatattacttcagattgcttttgtgtcttgaattttgataatttataaattataaaatcagttaaaataaattttgtttatcacttgtttaaggcatatttttccctttaatgttgaccctgcacaagttccatattgaagtatgtaaaatgaactgattgtctcaaggggaaaaagtcaataatcaaagcatctagtgtattaattattattataggtttcttccttaatataaaaattagaataaatcctgatttttaaaatttacacttaaattcaacagtaatataagattactgctgtctgatgcatggaaattgtcatttaattgactaaatgtggtataaactttaaaagagcatgtagaaaaattctaactcagccaattctaatttatggtacatttaggttattaataatttttttttgaaatttatgtgttgggcaaaatctttcgcatattactattttaaggttctaaccacatttaatcaattataggacagtttacatatttaatacgttatcttcaaataacttattttttgaaaatatatcaatttatttctctttttcttccatcagaatacagtcgttttgaagctaaaatacatgatttacgggagcagatgatgaatagtagtattagttcagggtcaggttctcttcgaactagccagaagcgatccctctatgtcaggtaaatttttttacttctaattatggcaaatcttaattagttatgcatgtaaattattttgtatttttcactataacttacttagttttaccgtaagaaaatatattgccaatcagtgttgttttttattattgattctctctgacagtgtgcctttcaagaattggaatattattgtattaataattttattaatgaaagttatgtaatccttgaataatgatgatataataaaggaagaaatttctgtggaccagaaattgttttcagattgatgtgttagtagtgactacaagcttgatgatatcatgtctaacacttagatttaacctctgtccttttctaatatattttccattcaagtaacatttaattacctggcaatttccatagtagcaaaggaggcatatgtaaataataatttaaaatgtgaatagcctcggtaaataatgcatatttggaaaatttctacatgcattttttaaacacttgggagaaggcaaatatgttattttcctataatatataaaggttaagtggcaacataggtctaataaataggtgatattagtatataaactggggtgtttctttttttttttttcatttcgttggcttataagacttaaaacagaaatccgaatgtatttgtattctgtatacttttagtagaactttaactgataactttattatactgttactgtaacattagcactgtaagtaatctgaaccattctttataaattatcatctcagtcgtcctgattctgttgggggacctgttcctaatacgtttcatttatccttctgatgagagagatatgttacatatataaacatgtatcctatacacgtgtatctatacacacaaacaggtactctgtacttgtttacatatgatatgacttactgtcttcacataatcttactctgatacatcatgaaagcaaacctttctcactttcttctttctgttccttttgtcttttgctgtacttggtacttataaccctaccagtgatgtgggaatcttaaatgcatcagatttttttttcccttcgccaattctagcagtactcattaaactcttgtgttccaaagtcattaaaagtattttatatatacaaatatatcgaagaaggaagaacatggatttttctactctcttttttacactttctttttttttgcttatctacatttcctaattttagtataattaataggtgttgccttttatttgtacttgattaaatatttacaaaggcataaaaatcagaacataataggttatatttattttcggtacatttagtgaatcttcacttgttatttttagagaagtaatgctctattttctttctgttttttttttttttttaaagacagggtctcactttgtcacccaggctgaagtgcagtggcgcgatctcagctcactgtagcctcaacctcccgggttcaagggatccttccgcctcagccccccaagtagctgggactgtaggcacatgccaccatgcctggctaatttttgtgtttttagtagagatggggtttcaccatgtttgccaggctggtctcgatctcctgacttcatgggcctcacccaccttggcctcccaagtgctggcattacaggcatgagccactgtgcccagcttctattttttaaaaccatatattatctaaagacttataatgaaaaacaactgtcaccggcaccagcccctagtttcattctccagaaacaagcatcctccattttcctagcaaacttccttcacctccttatttctaaatatgaagccttcgcctctatatttctaaataacatgcatatactgctatcttctactttaccagttttgcgcattagtcttacaaccatggtagatgagaacgtttctgtgtagaaccaaaccactcattcagtctcatcaccatcacccaaacatagcctatctctgttaataaaactaatagcatttacagtcatgtgactatgcaatagctgtcatgactcagtcgagtggtaccctatgagctgcctcctttcttctgcagcccttcatttttcctggacttaataattgtcttgcattttatttgatttttcatattcttactactaaatatctttctgtatcttccagtaaccactgtagagtttttcacatgatgaaaacatatggtcacacatacggtctgatagttcaggttttttctatctttatgctccagtctagactagttcctctgtaaacgtgctgtatagctctcagctgggacttcccttttgccattattctatttcctttggctgtctactatgtcacatgtttcctagatgccacattttcttctttctcaattaatcttcctagagcacatcctccagtaaattcctgcgaaaaggtgtgtgggaggcaccctttgaggcttagcatgtctgaaatgactttgttttgccttctccccagtagagaatttggaatgtgggggagggaatgataccctgttttattttgcaggagctccctcatcttccatttcttttgtggacatgatctggtgtgtctctgagattttcttctgcttttttgtattctttgctttctctgtattccttttttctagctatcctattttcttggaggttttttctttagtgttttatataaggcattctttaaatatccagtgttcctttcattgttttccactcttaggaatagagaaatgaagataatggatttaactagaagacagtggggtaaagggggggataaattggctcttaaattttctctcctgtcccacgtcattctgttcttttctataattaaatatccttagagaagaatccctgtctcctgccaatagtataaaccaagttgctagaattttattttcatccatttcagtccaaccaccttccccttctccaccaagtttcagagtatacagctcctcaaattcaatttctctggagactaaaccactggtcttctgtgggtttggggactgggaaaaggaactttggtggggttggtctaagtgctacatacagtgtttctaccttctgtttttagtacagtaacttatccctgcctaccttggtactactgtacacttctaatttatgaccatctccaggattcttatggaataaaacttgtttctataaccctctctgctgccactccatttatagcttctttcattctgctaaatttaattagcatcatccagaaatgtgttaaaatctctcttcccctgttgtcttctctcttttgtatttttcgtattttattgtcattttaatgagtcagggtggagaagaaatagacacagtgtgctatagttaatcagaagcctcatggttctttttgagatggggtcttgccctgttggctaagcttgtcttggactcctgggctcaagggatcctcacaccttaacatcccaagtagctgggactacaggcacacaccaccaccaccaccacacctgagtcttgtggggttttttttagtcaatgtatttctaatttcaaaagccaaaaaaaaaaaaggctgcaaaaaactacctacagaatacctctttataaagctctgaaacaagcaaaaacatacattatatcttttagtcactcacatattatatgataaaaccaaaccaaccaaaaaagaatgagtcaaagaaataaacattaagaatgatagttacattctaatagtggttaactcttgatccaagggaatcaggatcagagggaatatacgcaggtgaatgtgaattactgatgaaggttttgtgtgtagtcttgggttgggtagtaggtgaacagatgttcattgcactcttacgattaataactcacatgtattccatgggtttctttttttatgaatcaaatatattaaaagagaatgttaaaatgctaacgtaagtagagattgtgggtgatttcctttgttgttcaataatactgttacattttgtgattcaaaagatgaatttttataataatgtaagaagttagtattttccttttctgaatgtcttgacatttgtactacctcttaaggtactttattttctattttatattatgcttatttgtgccctcatcttctctatgtttgaatgtatgtttaagtgagccctcctgcttaacgatcccccctgcttccctagcacctttagccccacgaaaagacttgaaagaactcatttgaaaaaccattaactactagtttatttatttagccatcaagtaattccacccctcttgagttttacttgaagagctaggttcttaaatgttgggtagtgtgaaaaagattacgattttcatcctaatttccagttgccaaattagaacaaaagaatgaataaattatattataaatgtaattgctgtgatcctttcttacactcttgagagagcttatttggacttaagaatttgatttattttaatgttgtacattaattaatcaagtggtagcacacaatattttctttttatcaaattttaaaatattcttaacactttgcaattaccgtattaaattattactttctccaaaatatttggcagctgttaaagtcatctgtaattagtgtccatcattgttactgactctgaaaactctatcaactctagtattgtgaacaaatggaaggaataattaatggacagaatagtcactatgttgatctagtcgtacagtccacaactaataaatcaaatatatcagggaatttgttttcctacatgtatctaatcaaagtaaagagaagaatgtatcttaatactttttgtttattaatttcaaactctctggatttgtctattttagaattcaatataacttaccattggattacaatccaagagcgtttttaaaatttgtcttgtgatattgaaagaaacaaataatacaatacagtattttcatagcaagttgattttgctatttcttttttgtcttatcttgtatgcagtgcagaattgaactgggcattatttggcctactatgatatatttaattacccaaattacatatactttcagaaccctatgatatgttgattaatattataacaagtgattatggactttttttcttctgactctagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcaggtatgcctgtttcttaccacttgaatgtgaggcaacataaataattgatgttcttttaaattttttttaatttgtgacaacatggatggacctggagtgcattattctaattgaaaaaagccagacacagaaagacaaaaatcgtatgatcacatttttatgtgaaatctaaagtagtcgaagtcatacagagaagaatggtggttaccaggggttaggaggatggggaaatgagatacaaagtttccgtgacacaagatgagtgagttctgcacctccaacatgtaagcatggcaactacaggtaatagtactgtacttgaaatttgttaagagggtcggtcctaagtgttcttaccccccaaaaaaaggcaaccaggtgaggtaatggatatgttaattaggttgactgtagtaattatttcacagtatgtatatatataatatatatatataaaatcattaagttgtacaacttaaatatatacaattaggctgggcacggtggctcattcctgtaatcccagcacttttgggaggctgaggcgggtggatcacttgaggtcaggagttcaagacgagcctggccaacgtggtgaaagcctgtctctactaaaaatacaaaaattacctgggcatggaggcacacgcctgtagtcccagctgctcgggaggcttaggcaggagaattgcttgaactcaggaggccgaaattgcagtgacctgagtttgcaccactgcactccagcctgggagacagagcaaaactctgtctaaatatctatatctatatctatatctatctatatatataaaatatacacataaaaaaattaaaaataatcaccagaactgaaaaaataaatttattttactaaaatgattttatgctcagttttttatattgtgtttcacagccatttgattttattcaaatggaattgtaaccagtgacataactagaaaatatgggccaggtgcagtggctcacacctgtaatcccagcactttaggaggccgaggtgggcggatcacgaggtcaggagtttgagaccagcctggccagtatggtgaaaccccgtctctactaaaaatacaaacattagctgggtgtggtggcgggcgcctgtaatcgcagctacttgggaggctgaggcaggagaattgcttgaacccaggaggtggaggttgcagtgagctgaaattgcaccactgcactccagcctcggcgacagagcaagactctgactcaaaaaaaaaaaaacaacaaaaagtgatgcctccaagcagaaattgatctaaagctactagttactgaaaacaaagtaagtatatattaaatcagtgtgccatttagctataccagtgaagagaaaactgaaagtgtctgtggttggtgtaggtaagtaagaggacttaaattttgtatttttggtggcatgaatttcttccttcatgccaaaatgtttggaaatatctggtaatacgcttcacttctctttttccttgcttaaattacatgtattggtgcagttcactggtcttttctctttgcttttaatgattatatataggtagataggtaggtaggtagattgatttttttaagagacaaggtcttgctctgtcgcccacgctggagtgcagtgacatgatcatagcccactgaacctcagactcctgggctcaagctatccccccacctcagctagtagctgggactccaggcgcgtgtcactgcacccggctaagttttttgtttttgtttttgtttttgtttttgtttgtggagatgggttctagctatgttgcccaggcaagtcttaaactcttggcttcaagcgattttctcaccccagcctcccacagctctgggatgacagctgtgagccactgcagccagccctaatgattcattttagtgattcatgggtgtatacttagcacatagcaaaagtagttaaggacaggccctctttgcaaaggatggtcccagcttagaggacctcttctaaggcctgtgaagtgctgttgagtgtctctgcttttgtggggaaggtgttaaaatgtcatttcagaattcccctgagatagcttatttatgagatctgcttcatccaaatcattgtctggaagttcttctttaagagctttttaaagtagtagtagtaagatagccagcaaaaatagttaatgagatcataaagaaatgtttattataactagttaattcattttaagtcgattatgctgtaataaacatctttttcttattagttgaatttatacctatttcgtaactatttctagacctttatttatttacctgtttgtagaagttgaaaagtaatattattaaattataatcaagatttataattatgattttcgggcttataactgctgttggctgtatccatatatttagcatgatccaactatttggctagatctttcagttgatgacaaatcctcttttagcaatgcagcaatcagcataacttttttccagaaatagaacatagtctgctttaaattcggaaatgcttcctctatgccttgttgagtcagtagaaaccttacatcttaaatatcaaggtcagagctcctaaaaattgtcttggttcttggagtctcataccttacaaaggctttctgtgcctacacccaataataaacactgttggcttcactggagagatttttttttcattttgtacaaaaattctataagattgtgttttaaagcaagcaataatgtaagaaagatatcttgagacctctgccaatttccacattcatgagtagcattgcagaatataatcttactcccgtaaaatacagtaagaaaccacaactaattatgccatttcgttcttgaatgtattcaaaacttaccttttcttaaatagaactatctctttcttagacctcttctaaaataacataggaattgtaattcctacaattcttggctttcaggaataatatttacaaatatagacaatttaagttgctgaattatgtactaaacaaaataatgattagaaaacaaagttgagttgtaaatgctcacccactaaatgctagttttgtggtgctgttgataagtacctaggcaagattataaattattcaggtcatggagcctcagaattgttcttgaatcgtaaaaatcatgagttttaatttttttttttgtttggggtgggggacggagtcttgctctttcacccaggatagagtgcagtggcatgatcttggttcactgcaacctccacttcctggattcaagcgattctcctgcctcagcctcccaagtagctgggattacaggcacccgccactgcgcccagctaatttttatatttttagtagagacagggtttcaccatgttggccagactggtcttgaactcctgaccttgtgatccacccgcctcggcctcccaaagtgctgggattacaggcgtgagccactgcgccaagacttaaatttaaaatttaaattcatgaatgctaaggtcctgctgtacccatagtaaaactaaatagataataaggaaaaaataaaattcatttattcatagtcttgttttggtaggcttttctgttatatgctaacataattgctatgtcgaaattggagaatttatgaaagcttaatttacatgacattttgcaagatttacattagtgttacaatctacataaaaacttgtttcattgtagttttatttgcttgcttattttgagtaggtaaagttcagaatttaaaagatgtgaaggctttacaggctgtctctcacaacacccatttcacctccataggggtaaagattaacagttcttatgtatccttccaaaaatactttaaaactcttacttcaataactgtaactggttatttatatatttacacacacacacacatatatcattaaaattaggcttaatttttaaatattccacctttttgttaaaagtttcagagctatagaaaagtaagtacaaaaacggcaatatacagtgaacgtccacatatccttctcccactttcaccagtttttaacattttgccacatttgctttctctagcttaatttttagcatatgtgcttcatgctaagctaatacttaaaaacaaacaaaacttggaaaactgttaaactcagaaatggtgcctcatactttcatataattttgtaactaaatatacatataaaaatatacacatatatactgtgtgttgataacttcatagcatcaggttttgtttcataataaaatgagccctttatttcatttttcagcaattctaatttggggatgcaaacctagatgactcttaaaggttttagagtataaaaatgcccattataaagataacaattctggttatttctagtaagaccccagatatgtttggtttacttaaaaaataacattctatactttgacagagttgagaagaaagaacgagcccgattaaaaacagtgaaattcaattctaaaacgagagataaaggggtgagtatttgaaatctctacatttttgtaattcctgtttgagctacattgttaaaatgaaaaggattttgctatcagaattattcatgatcagttcttgccatggtgctttacaatggtagatacttaagcatttgttaaattcaagcacccatttcacagacccttccaaattatcaaaactatcatttgatatattattagcaacatacttttgggtcaagcttatttttataaatgaaatgtatttgaccttcattcgatttccaattagaaatttgtgttactaggccgggcatggtggctcacgcctgtaatcccagcactttgggaggccaagtcaggcagatcacctgaggttaggagttagagaccggcctggccaacatggcgaaaccccgtctctaccaaaaatataaaagttagccaggcatggtggcgggcatttgtaatcccagctactcgggaggctgaggcacaagaatcacttgaacctggtaggcggaggttgcattgagcccagatcgcacctctgtgctccagactgggcaacagagcgagacccaatctcttaaaaaaaaaaaaaaaaaaaaaaaggtaaaaaattagccaggcgtgatggcttgcacctgtagtcccagctgctccagtggctaaagtgaaaggattgcttaagcccaggaggtccaggcagtagtgagccatgatcatgccactgctctccagcctgggtgacagagtgagaccctgtctcaaaaaaaaaaaaaaaaaaaaaaaaaaaaaggaaatatatcaattctttcatcatatattttagaagtgtatttatttttccttcactttaagtccttctgcttgcatctaaatacttgggctgtcgatagatgagaaagatggtacaggcttcatcccgtattggtggatgtaattcttaataatcctgaactcactgcagtggaatattctagcagtaagcctggagaacaaactgaatacatgttatgttaaataccatttatagcaatgttttatgtttggggttttttttaatactaaacaaaatttttataagtcttctgataatatttgaaatgaatgtggaatgttaactcagcaaataaatttactctgtacatctctggtatcactaagcactcagacttaaagctttaaaatttaaaagatgagaaatatctttggttcaagaagttaaatctgagaaaattatgtgttacattccattttttagaaatgataaattcctttaaaattgtagctttcagaaaaattccaaattatatagtgtgatctgaagcaatattaaaatagaaatttgtattagaggaaaaatcccaggtaaatgctcaggatttgaaaaatgtgaattttttaatgcttgttttatgtatatctttaaaaatgatttagtacaatataccatcaataaattgaaaaagaggttgcatgttgtaactttcctttcatactgtaagaagttaactgaattaacgacgtgtttaaatcttagtcttgtttgttgactgtaaccaactttatacagagtcactgtgttctaacacagcaccaaaactatgcatgatactgagtggggtgaaaatacgcttgccattgatcagaactgcatttctttctatagtaccatttcctacttctcctcctttccttacatagtgattatggactttatttttactacagacttacaacattttagtttctcattaacatgtctaacattcatttggctattttgaaatacatgtggaaattatgtatttagatatttaatatatgtatcatgaatttatgatattttatcaattcttacactgtctctcttgcgatatagcattaatgacagtaagtattaaatgtagtacttctgattgaaaatacagagaaactggaggtagcaagtcttcagttttgtgttttccctacacatttttgtcttggttgcttgtgctatttttttcacttttaataagttcttcacctggaggatattaaatgtgatacaactaatactttcttaactaacaagcatttctctctgtcctatattatgatatctttatgatatctcattttggctaactgcaaagataataagaatcagacattttaaacttcatgtttcttttggttgtttgctgtgaaactgactctgaccactatagatgcagtaagagggatgaataaacttttataaaaaacacatcagttgtatcagatataaaaattattgctaaattcaaaaccattgattcttatgaacgaaaagatttagtttttccctaaattagattaccataatttttttcactaaaacactttctcgtctatctcctttctaaaatttggatttgaacaaagatttttattcaaataatgctacttgacagtttataaaatagttataagcccagatttctccataatactttttctgtccattgaatttttaacttctacttagagttctcttttatctagttcctcagagccttcaaactttaagattgaaatcaagacagtctgcttggctaatgaactgtgaacttattaatcctgaattaattatatgaaaaggtaaaaatgaaagtttaaccttgtttttataaagatctttatcaaaataagtcttctcaagtcatagaatttgagctaaaagtcactttaatctacttcacttttttttttttttaatttaaagaaaaggtctcactctatcacccaggttggaatgcaatggtatgatcatagctaatcattgcagcctcaaactcctgggttcaagtgattctcctgcctcagcctcccaagtagctgagactacagtcgcacaccactgctcccagctaatttttttttttttttttttgagatggggtttcgccatgttgcctaggctgattttgaactcctggcctcaagcgatcctcctgcctcagcctaccaaagggctggggttacagatgtgagccaccacacctggctgcttcaccttaattacctggcatcacatgcttaaaataagggcatgccaaaaacacactgttcttgtcaatatacttcaaaataatgaataatacagcatcttaagatgtgtataaactcataaaaatcagaacaaaaaaatctattctttatatttttcccttccccctccaaaaaataataattcttagtgtcactggtaggtaagcccgtttccttcaaaacatgaatgcctatgacagagaaatgacaaaagaagctatttctgtttaatagcctcatcgttcttgtgctacatgctcttaaatctatgaatgcacaaatgagacattcaaggaaaaacttgtttccaacatgtgcaataagagacatcaaatcaactgctcaactccacgttacaattatgtataaactgttagaatcttaattgccttgtggctttggtggacaccaaactttttattccctatgaaggacgtggtgccaatgattggatgtggttctacattatttatgtgtacttttttttaataagtagagtagaacttaagaataaataagtcagtactgatagcattcacgttggtcaggagacttcagtactgaagcattcacgttggtcaggagacttctgactcttcttgcttggctaagagatggcattgataagtctcttgctggactctgtgtgcttgatggaccttttagttttcttcccattttctggctcataagcatttagttaccttttatcctcttccaagaatatgtatatgtgtatatataaatatatatatatttgttttttaaatattcagcattagcaactttctcataatcattttggtttactttttaaataatgacttttctgttagctcatcgtagccacaaaaaaagagataaaggaataactgtggtcaggccaaaataaaatgaagataatgaataaaatgtaattgagcagcaaagtaacattaaataacttttgctgtagagcacttaatacttgaaaatttttctggaaaaacatggattagtataaacaaatgttagcttggtttgtactgtagtagtaactgatttgcctttttttgtcaagtagcatttttatttttaggtataaatgaactatgctgtctgaaattcttaagtattttcagttgcaaaatgttagaatttatacaaaagtagaaattcactttatatgagattaaagtaaaaatcatatacaaactgcacactgtggtcataggagtcagcttccacagagctgctaggctgggcctttgtacacacagacagtagacatccctttgttttgcccctccttctcttcttcagcagtcattcaatgacaagcgtaaaaagaacctcttttcccgaaaattccccttctacaagaacaaggaccagagtgagcaggaaacaagtgatgctgaccgtaagtatgtggatccagtggtcaactgaaaataaaatggagagggacctactgccctgcagttggttgttaccatggagacagtttcaagagctgcagcaggttgctaattgtcttcaagggcaacttaacagttataaattaatttgtatgccgatcttaactttttctggcaccttaggaattcttaatttaaagcaaacattatttttcagttatatgtttataacttgaacatataaatatgtataaatgcagttatttgaaggaaagatttttatgaaaaacacattcatacattcaaagaatattttagaggaagaacatgaatacatgagaagctacctgttgatttctaggtataacatggcgagtctgataactggattctctggaatcattacattttaccctatttcttcattatatgtagacaatctggattttacttttaaaatagcaagaaatggtctaaaattttgcttctgtacctgaatcagccttcatgctagaactttcattcttttggtagattacagttagcagctagctcatttcaaagttctagaaatatgtaaaaatgctctgtaagatatatgtacctgtaatggtcttggaactgtctcttactgtagcaccaattttatgcattactgacaactattttctttgattatctttttattgcttgctctctggggactaccctctacaggagatccctgacgacatgggatcaaaaggcctgagtaagtgatcaaaatactcccaagttattttttaacctccatctgcagacctaccttattcagatacattttgagattcatggtagtgcctttctggcataaggaggtgtatgatttagattgcttttagaattttcatgtttatcacatgcttgggactttatttctgtaatacataactttttgtttttatttttcacatgtcatttgaaaaattctcttgctcgtaactatattttcctttttgtaatttttacgacagttacttttgctaggaacttttaaaatataaaaacttttaagatttttttaaatgtaccctcattattagaatgtagaaatatgcttccttggagttttatgttccccttttttttgttaaaataatttaaaataattttgattatgtgttagaaaagcattactataaaagtataaagcacaatagaatactacgcaagtagcagtttattgaggggataggttgtgtatctcttttttttttttttttttttttttgagaaagttataagttaccacaagagtataagaactattttgtttttcctttagctaagatgttgcctttgtttttggtttttgttgctgctgttcttgtttaattttctagctagttacttaatcttcatgtaaagcttcacacagggtctagtatgtagaagacattcaataaatgttggcatgaatgaatgaagcaagaagccattttagcaaataaaatttttaatttgcatgttttcaaattgcttaactgaaaatttaccaaacattactgagtaactttaggtgacagtgagtgatagaagtaatcttttaatctaatattttctaaatggttctttctatttagattattaaatattttgaaaacttctttgtcattcattgatcattaagcctatagccagtatcttttaactttctaagacctacattaataaacattaaattttacataagacatttttctgatttatgcttttatgctgaaattttaatctaaactgcaggtacttttatttcaaccatagtgatttaagtttgtattagattgaagacagtatgtttatttacaactctttctgttagacacactttgttatttttgcatgtgcctttataggatttagtaagggccacagatttcctatcactagtgacacccttacatttggggaaaattatcaatgaaaacctctaaaattggaccatactaccacagtttatgtatgctatagaatttattttgagattgataacatactttagaggtggtatggatcaacaaatggacccacagatttttcttatatgttaagtgaacagagacataggaaactcatagaaaaagaaactaaatgaagaatttggttcccatattgatgttataatagatgatcattataccttgaccctctttctctggttctgattgaagattgagactttggaagagaaataatatgaaaaatggtaactgattatcagacgacgttattcagaaaaagattttattttctggagagtgacctaagatctcttgaataatagatttctgtgcttcatctcacaggaattaaaagaatttattcacctggtaacttgatcatcagatcaagattttattcacaaaatgttggagaagacagaaaaatatcagtaaaattctaaaactggatatgatggaggttatcacataaaatagatgatataaggcagttgacaaggtgcccatgattatgtagtagtaaatactgggaagaaggatgtgttcaaggacgttacttgtggcctcagttacttacattctgaagttaagaatgtagggaataaactaagcaaaatcttgagagactttaatataagaaaataagtgcaacttaatgtaggtagtcatcaggccttattggaacaaaactcaaaaagaacccaaaaaagaaggttaagttattccagagaaccgaacctattgaagagaaatggaataacactgaatatcaagaaaaaaaaaatgtatatctgctgtaaattcacacaacctatgaaaaatggggtatttaattgaagagcagacagagaaacagaagtgataccatagaacgctttgtgtagacctgaattcatttgttctttattctgagaagaagagagtcaaataaattattgatttccctgttaacagtagagaaaacagtgagagaaatcgtcttatcaaacctaattttgctaaacagaactaatgagagtacaatggaagtttgggagaatgcagctaagtcatcatttgcgaaaagctagaaataaaaacccgtgccgctttcatgctttaagggaggtaattttgaaaaagctcaagggactaaaactaggtaagattcctttaacagagactgaaaggaaacataactcaataaaagatacataaggtgctcagaagtaaaattatgacataagatttgagacaaggtttgttcttattacatgtaggctttccatttttacaactttccatgttgtacaacacctcaaaaatttcctcaggcacgtaggtttcctgttacatatgtcttttctttcttctcactttaaagacgtacgcatagttgtgcagagcttctaaatgccaaaaacagacttattttcatttgcattacgaataagatgtaagagtagtttcattgcttcagattgatgatgtagtattagaggagagcagaagagaaacatgatgtactgtatcaggaagaagcatttgagtacaatgataaaacttggttagagagatttgagatagatctgttcatcaaacatcataaacaggctgggcgcggtgactcacgcctgtaatcccagcactttgggaggctgaggccagcagatcacctcaggtcaggaattcgagaccagcctggccaacatggcaaaaccccgtctctactaaaagtacaaaaattagcaaggcatggtggtgcacacctgtaatccaagctactcgggagggaggctgaggcaggagaatcacttgaacccgggaggtgaaggttgcagtaagccgagatcacgccactgctctccagcctgggtgacagagcaagactcaggttttttttttgtttttttgttttttttttttttaagacaatcataaacaaaaataaaaacttgaagaatttatttgtaccatgtatgtcacaaggataatatctttataagtttttaacaggtaataagaaataagctaactctccattagaaaactgggcaagagtgctcagaagataagcaaatgaaataagcatataaaaaatgtttaatttccctagtagtgataagcaaaatgttttacctgtcactttggcagacttttgtttaaaaagaaaacccatgacggagagagtgctgctaaatgcctgcttttaatgtattacaagtaaataatgtattacaagtaaatgtatgggagtgtaaattggcacagccttcctgaaaaagcacatcttttgacccactaaatcctcttcaaagaatttatcctaaggatgtaattagagatggagacaaagccttatatatcagaatgcttattataatattattgagtaataacagcaaaaataaaaaaaaccgtggtaaaatgtcttacagttgggaagtgcctaatgaagtatgatttatccatactatgtaatattacataaccatcaaaaatcatatttaaagataatgacatggggaaatgcttactatctatgaaaaaagtaaaatatgaaactgcatatattgtctcagtcttatatgtttggagctattttaaatagtgttgctttgaacattcttatacatgtcttgtggtaagcatatatatgcctttctgttggggaaatatctaggaaaggaattgctgggtcgtatagatacacatttgtccagccttagtagctattgccaattagttttctagttttaccagtttgcccattcctagcgcatgaactcccattgctgcatatcattatcgatgcttgacatgtctgttttgtgttttcattttagccattctggtggatggcagagacactctttgtggttataatttgcatttccctgacaagtaattaacttgaacacttttctatatgtttattggttatttgactgtcttctttggtaaaatgctttgaagaggaacattttcaattatcagaagaaaaacattttatttttctaataacattccaaacaattatgatgacgctattctaaggaccatactttgagtagtgaggctttattgtagaagagctaagtgaaatgatatttgaaagaacctgcagaatttgattgtggcgtagcttttggcagtcttagagggtttgaggtgagtaggagaaatctcaaaaaaaaaaaaaaaagacagtgaagagattttggtaacttaaactttttattatataaatatcagatatattcaatagtagaaaagtagtaaaaataaaccctgcaggtatttgtttatccagctttcataattgtcaactgaacatttgccaattctgtttcttctgtactcccacttacactcccctcccttcaccccattgcaataactaatttttctttagtttacaaactagagattgcagagggtaataccaatactaatgtaaacagaataactctttttttaatgtggcgtgtttctgggtatgaaatttaaggaaataggacagaaagttaaaaggtatatataaatgaagacattcataattgttgatacttgtgaaaaacagtttaaagcaaataaaaatatctaataaatagcgaggtaaataatgtatcaatctaatagaatattatacaccaattttaaattattgctgtcaagcccatgtggtgacatggaaagaaatattttaatatgagcttttaaaaaacctaccatttggccaggtgcggtggctcacacctgtaatcccagcactttgggaggccaaggcagacagatcacgtgagctcagaggttcaatatcagcctggccaacatggtgaaaccagtctctactaaaaatagaaaaattagttgggcatggtgctatatacctgcagtgccaggtagtcaggtgtctgagacacaagaatagaatcgcttaaacctaggaggcagaggttgcagtgagctgagatcgtgccactgcactccagcctgggcaacaaagggagactatctcaaaaaaaaaaaaaaaaaaaaaatgaaatttccagctgggtgtggtgattcacacctgtaatcccagcactttgggaagctgagatgggaggatcccttgaggccaggagtttgagaccagtgtgggcaacatagttgagacttgtctcttttattaaaaaaaaaaaacaaaattttagcagggcatggtggtacatacctgtagtcccagccactctgggctaagatgggaggatcacagaagcccaggagaggagggcgaggctgcagtgagctatagtcataccacctcactcccacctgagcaacagagtgaggccctgtccctttaattaaaaaaaaaaaaaaaagttaaaataaaaattcagatttccctgtctcattgaaagttttatttttattttttaaaaataaaagtattagtctttgtttaattgaagggagatatttattgagagaaaacttgagatgacatttacatggatgagaagagtgcctatggttttaccaaacaataaagtcgtgaaatggagtcacttttaaggagggccaggcagtttctggctgggtgtgtttgttctcattgtcttttttatgttttgcaaaagccagccagtgccagtcttatcaaagcagagtttctaagaaatattagttggttttaaaatgcaattgccaccatcggtgccttcccttccagctgagacatctgaatttatgacttctaatattagttggttttaaaatgcaattgccaccatcagtgccttcccttccagctgagacatctgaatttatgacctttacaatcctttatctatatgatctcagaaacatggattttcatcttcagaaacaggagcaaagctggattgaaaataagatcatctatttatttttaattacaaagacatcccgtcattaaaatgggcatctatttgtttaaatatagtttgtcccctttgccagttaacgctgtttcaaaaactgaaatagtgccaacagtattttctcctttgagttttatgtctacatttggactaattcagggtcacttagccctttttgtcatattctacttgctatttataatagatttgttcataaactgtgttgtacaaaaataaggcattgtccttaattacaggagttttcctttgctaatatatatttattatttgaaaaacttaaacgtttcaaagaaaaagaaaatgcttttaaaaaattattttgttatatatggcttatatctcaacatttcattttgattatttgctttttaaactcatgacactgttttattttttttcattgtcctgcaatttcagagcatgtaacttctaatgccagcgatagtgaaagtagttaccgtaagtgttttaagttacttgttcttttgtaatctcgagtaatacatcctctgcaggggtggagggattctgagtgatatgttataaaaacctgaagttatatgatcgttattttaaaatcagggagagacaagtaaaattctgtacttgaaaaataaaatcatactatatatgtagaggttaatttataaaattttaataaaataaaaatattatttgtgtacatgatacatatgtatatgtatatgtattttttgtaagaagtaaatatctagttaaatgggggaaaacttgtattttgaccttctgtttagtaattggttttaacatgagcactaaaataatatttttcagtaatgctaaattatcattagctttatttccatttttattctttgtcaccaatactgatctgggtcatgtcattgtttatcaccagcacttggtgaacggaagaaataaggaaacattttcaatgatcacctgaaaaataatactaatttttcttttgctgttttatattacattcttggttttattaagtgaactgcacaagcatgtgatgttttaaaacagacttgggcatgggagaaggggagggtacataatatcagttgtagcaccttaaaaattaaaattacttttctaactttctttttttactgctgtctaatatgaaagtaatcttgattacagatgagtatggctgctcaaaaggtccatcctgttaatatcagtccctaatactttttcatgttgacagtatatacttttaaccgtcattcatttggttgattatttttctacacaatagttacttaatgattttttttttggtgtggaaatgatttcctgtatttcagcattttattaattataaccagaacccactatagggtagttgagtggctttctaggctaaaaagaggtaatgaaagtatatactgtctctcaccatttgcatgaattattaaggtgtgaaatattcaaattgcatgtgtttgctagtatgtaagccatgtttcacatccagtactttaaaaaacagcttataaaatattggtcttatgtactttgataataaaattgaaaacaaagaaatacttctaaaacagaaaagaatgtttatgccaatgtatggatttaaaagacctacagctacatacatataatataaaccaattgcaaaattcatggtaaaattgttataggatcttgataattaaagagaaagtcttcaaatacattatccaatattgattgctttcattgaaccacttgggttaacacagtcttttctaattttaggcgtgggggtgaggggggatgtgtgtgtgttagtttaaaactcctagagtttttggccgggcgcggcggctcacgcctgtaatcccagcactttgggaggccgaggcgggcagatcacctgaggtcaggagttcgagaccagcctgaccaacgtggagaaaccctatctttactaaaaatacaaaattagctgggcatgatggcacatgcctgtaatcccagctacttgggaggctgaggcaggagaaccgcttgaacccgggagttggaggctgcagtgagctgagatcatgccattgcactccagactaggcaacaagagcgaaactccgtctcaaaaaaaaaaaaaaaaaaaaaaactctcagagtttttaactatttatttcttttcactggattcagatattcagatataatttgtagactcttttatttagagtatttcctaagctccgaacctttaatttaacctttagaagctttaacttcttgtgtttttaaggtcaaagcaaatatatttatctcctttactatcactgttgtttattttcttggaaggatttagttttatctaaagctctttttgactcacattaaatttattatttttttacaaagttgagttagtgaatttttcatcagtgaaatagtaacagtagttttacctttgcatttataatttttaattttaagatgtaattattttaaaaataaaatatactgtattcagtattgtagttggtggaacaaaaaaagtagcatgtttttaatagtaacaaattacctaatacgtagatagatgatagacagatctgctcattaaagcattaatctttaacagatttaataattcttagattctaaataaaggagtagcacatagcatcacaaatgaagatttttagatttgattatctataaaatataatattgattatatagcccatttgtattttgttttacatttagcaaactcacttttaagactttataatttgacacttttttttaactaaatcttgccataaagtacctctttccatatctttgccattttctcaggaaagttctagtaatgtatatgttgtttatgaagaattagattagcatcaattatctttacacatttttcatctgtgccttcactttctaataggtggtcaagaagaatacgtcttatcttatgaaccagtgaatcaacaagaaggtttgtgaagcctattgatgttttataaccttctagaagaatatactttttaatttgggggaaaaaaattctcataccccaaaaaatgttgtattaaaatttttttttactacatatacatgtagaaatttactacatgtgttttatgaaacatagtttactccacagaatattagaatctagtcatttcatactgacttttatatttgtgttttatttcccaagcaactttgttccagtgttcttgttagcatcactatcttccaaataacccttttttgaaaatcttggaagtatctttgagccttctctgttcctcctcctcctcctcatccagttaggttccaggcactgtttatcccacttctttcttatttatgaccttcttttcatcccttctatcacaatgttagttctcagtctcactaccaatctccattattccagcatgatcccagaccacccagagtttacacttctgttagatcatctttctagaatgctactactgggattatatcacttcctacatccagtttctgttctgcccttctttgctctgcttccttacaatttctacttcaaagccatctgtaaaacactagactttattctgtcatttgcaatgtaaagaaacattatctgcgaaaacaccaaatttaacttgattgaattatcaatatgacttctagcagaagactaagtaaagtttaagatctgagtcaagattataaaagagcaagttacgcatctttggttgatggtagagtgagatggagagggaagaaaaaaattagtcataacagttaaggatatttttgttcgctggtgaaataaaatacattgatatttgttgaatgtttattccttttaacatgcagtttatctttatagttaattatactcgaccagtgatcatattgggacctatgaaagacaggataaatgatgacttgatctcagaatttcctgacaaatttggatcctgtgttcctcgtaagtaaaccaaacaaaaacatttaattgttactcttaacatttcctgtcactgtgtgtgggaaaaatagatataaccattttttaatggtttgtacttattttatcagttactcttccatcctccatattattgtcctttctcagatttaaattaatctgttctgttgaactttacaaaacgatgtaagtagaaaatggatttattgtggttttttttttaatattaaacactttcccaagtttttttctgttaaagatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaaggtaagcatcagactaatcccagaatatagcttctaatcagatatgcctttgacagtatgcaagactggtaggatagatacagcactaattagttttgttaatgtgatgaatttgcttacctaaataattaattttccatggcttaggaaagtgcatacaagataaaacaggtaaataaggtaaacaaagaaagtgaaaatagaaatgataacatgaatgtaagagaagttattttcaggtcatttgctagagatagaccttttgtttaggcctagctctccagcatatattaaaaggagataagggccgggtgtggcagtgcacccttacagtcctagctactgagaaggctgagttgagagaatcactgaagcctgggagtttgaggctgcagtgagctatgagcatgccactgaactccagcctgggcaacagaacaagaccctggctcttaaaaaaagaaaaaaaaagaaagatcaataaatctaaccacttaaaatttttaaaaaactttttttatggccaaagactttttccaaaaactattggaaaacaccattaacaatgtcaaaagacaactgacagaaaaaatttgcaagaaaagggctaatattcccaatatataaagaactcataaaaacagggaacagagaccagaaacccaatagaaaaaaacagtggacaaaagatcagaatatatagttcacacaaaaataagatataaaatggcctttgtacataggaaatgacgttcaactgtagtcattattaaagaaatgtaaaggccgggtgcggtggctcacgcctgtaatcccagcgctttgggaggccaaggcaggcggatcacctgaggttaggagttcaagaccagcctggccaacatggtgaaaccccgtctctactaaacatacaaaaattagccaggcttggcagtgcatgccttaatcccagcttctcaggaggctgaggcaggagaattgcttgtacctgggaggtggaggttgcagtgagccgaggtcgtgccgttgcactccaacctgggtgacaagagtgaaactctgcctcaaaaaaaaaaaaaaataaggccaggcacagtggaaggctgaggtgggtagatcacctgaggtcaggagttcaagaccagcctggccaacatggcaaaaccccatctctaccaaaaatacaaaaattaacttggcgtggtggtgcatgcctgtaatcctggctaaggaggctgaggcaggagaatcgcttgaacccaggagattgcagtgagccaaaaccatgccactgcactccagcctgagcaacagagcaagactccatctcaaaaaaaaaaaaaaaaaatgtaaattaagaagactactctaaattcaatttctcccctatcagattcagggagaaatatgaagacattttcttggtgagactgagagaaaacagttgtgcattgctggtggaaatgcaaactggtactgccttttggaagggtatttggcaatatctagcagctttccttcaacccagcatcccacttctaggaatttattccaaagatataccccaacagtatgaaaatacatgggcaaaagggtatttattcattgtagcattgtttataattgtgaaatactgaaaatcatctaaatgcccagataaaagtgattgaattaattttacattcacaaaatgaagttctctaaaactgttaataaggtatttgaactgatacacaacatgcaaaagaatatctacggtataaaataagagaaaatgggaaaatacaaatctctgctcagttgtgtgaaaataagcacaggaaaggtaaatcagaacttaatgaggttggttacctacagagggagtgatgtagagagggaatttggaatgggatggaaaggatgaggggtatgacatttctctgagtatacatttttgtattattttaacttttagaaagtatgttagtattttacatatttaaaaaaatcaaaaataaaagcaacaaagaaagatgggggaaaagcaaaatgatacataagtagaaactaaataaacctgactgtatttctttttttttttttatactttaagttttagggtacaataaacctgcctgtatttcaaatgaataacttaactacattgaagaggggagaagtcttaatcccagagattctttaacacaagctgaagacagatctgtaaacaaaataaaactctaattagtaggtttgttgggtggagtgtatgggcttacagttctgaaactaatatatattctagggttgagcaaataaactaatacaatggcagtagtgggagtgaggtttgactgtcagaaaaagggagagggtaaaatgaactctgtgataattggattggagatattagataattagagcgatgaatatgaacccatggattgttaagagtagatatagaaatagatgtgtatttatgtatacacacacgtatgtttatttgctttatccactaagaagacctaaaaataacactgaataagccatgagaatatctggggcccggatctgggcttctaaatataattcgttaattaaaagatccaggactccttagagaaatggctgattctggggccaggactggaaaagtgtgagataagcctgtaacattttgctgccagaaaaataaggaagcactcaaagaatgatgaagatgtgtaaaaaggcaaaggaaccaagctgtagggtcccccactggccaagtctgagataatttgaatatcaagataaatgataataacatattataatacatagagtaaaataaaaatcgtagagtccataatgatataaacaaacacagatggccctcaacttagaatggttcaacttttcagaggcgcaaaagtgatgcatattcagtcgcagccatacttcaagtacccatacagctattctgtttttcacttgtagaacagtattcaatgaattacatgaaaaattcaacacttaattataaaacaggcatgttggatgattttgtccgactgtagagtaagtgttctgagcacatttaaggtaatctgggctaaggtatgatgttcagtagggtaggtatattaaatgcattttcaatttacagtattttcaacttgtgatgggtttattgggacgtaactcccatcataaggagcatctgtatgtgagtaagtaagtggatagaagggaacgctttggactgtctactaatcaaggtagaagaaatgattaaattagaaaatcttttgaaaaccgcatggtggtaattgtttccggcagaaaccatcagtgtattctaaaattagtgaacatttgatgaaaaaagggatatttatatagtctcaaagtgtcctcccccaaaatacttatcagttacaaaggtaaaaatgataattttacagtggagaaacctagcagataaaaccttaaacaagtgatcaaaattaggatcactaataatgggacaaatagatataatatcgcctcccagatatgatggactaagaaggacacacattatgtctgtagtattcctgccaaaaatgtgtaacctgccatccgagagtgagtaaacacacaaacccataaacccatagaatgaggcatattctatgatataaatattttatactcttcaaaaacatcaagaaagacaaaagactgaggaactgtgtcagattgacggagactaaggagactttacaactaaatacaatgtgtgatcctatgatcctgaattcgatccttgaccaggacatttttttactcttttccaataaggaacattagatggccacttggaatcatattgtgattatgtaagagatgccattgtttttaagaaatacgaggtgaaggagcattatgcagtttattctcaaactattatgtacatatatagaaagagttaaagcaaacctagaatattaatatttcagtatcaagttattaaaatgtttaagcgatcatgtaaaatatttatgtctgatgaaagtagataatgggtacatggtgtctattatttacttttctatatgtttggagtattttacagtattaaattttttattttaaatgtgcccaccaaattgaaattatcatgtattgacttggactcaagtccttgggttagaagttgcattatggggctgagcatggtggctcacgcctataatcccagcactttgggaggccaaggtgggtggatcacttgaggtcaggaatttgagaccagcctcaccaacatggtgaaaccccatctgtacaaaaaacacaaaaatcagctgggtgtggtggcgcacacctgttgtcctagctactggggaggctgaagcaggcggaagttgcagtaagccgagatcatgccactgcactcaagtctgggtgacagagcaagtcttcgtctcaaaaacaaacaaacaaaaaactgaagttgcattatcggggagggcctgatttcaaatgtattagaagaaaatctgtcataaataataaatactatgcttaacatggaaatgctcatctgtattaaaaacctaagtatcctttgtcagtgagtttaagcttgtcagaaaagttgtcatttaaatccagaactggggtcccatatgctagtttatgagtttttgtcagtccctaataaaatgagaaatagaaggattgagtagtggcaatgaggtttcacaaatttgtttatttaaaaggtttgcccttactctagggttttttatcttttatgaaatgatagctatggggagatggtagtttggagtcttaatgaataacttttcttggcagaatgaaaaataggaacctgggcctggcacagtggctcatgcctatcatcccagcacttcgggaggctaaggtgggaggatcacttgagccccaggagttcaagaccagcctggtcaacagaacaagaccccgtcccttaaattttaaaaaaagggaacggcgggggagctctatttttcaccattttgagaaataactgatccgtgaaaactaggaactgtattttcattcctttttaaatataacatttgtttgaaaatggcaaattaattatgcatattcagccatttcatttcctatctaaagtttgctgagagaaatgacaagtttactaaaagtgaacaaggatcgaaacagatcatgatttagactgtggacctgtaggaaaagtacctttgatattattgagaatatttggctcacttgttttttttctttgttccctttattttagggcaaacactgtatccttgatgtgtctggaaatgccataaagagattacagattgcacagctttaccctatctccatttttattaaacccaaatccatggaaaatatcatgtaagtgtaaatgcctaaggcatagcctctgtgtacaaattcagtcactgtagggtaatttatttactctccctgcatctcagtttatctataaaattgagataatagtagtatgtttattcacctcagattatgtggtgaggattaaataagcactatgggttataaattgtcattgtaatcatcatcattaatattactaaagtataaggtaacatgtgttagaactttaaatagccccacgtgtgactagtggctactgaagtacgcagcacagctctcaggtaaccattaagagaataaaagaatgtataaccattacctaatactttcaggggacaaaaaaatagaatctaagtaaaaattaagaaagaacaaatagaaacacagaatgtgaggcagaaccatataaatagtgagatggtataaactaaagcaaataatagactactagactaaatgttccaattaaaagacaaggggtgaagaaaaaagtaaattatatgtggctttcatcagacacaccttaaaaattaggctatgggaaggttgaaagtaagagaataggaaaagatataccatgctaaactaggctgatttttatatggctgacgaatatactttaaggcaagaagtattacttagcttcagagtgacatttcatggctgggcacagtggctcacgtctgtaatcccaccactttgggaggctgaggcgggcagatcacgaggtcaggagatcgagaccatcctggccaacacggtgaaaccccgtctctactaaaaatacagaaaattagccgggcgtggtcgcgggcacctgtagtcccagctactcgggatgctgaggcaggagaatggcgtgaacccaggaggcggagcttgcagtgagccgagatctcgccactgcactccagcctgggcggcagagcgagatccatctcaaaaaactaaaaagagtgacatttcataaaagtaaaatattcactccaacaggaagatctgttcgtacatttgtttgcacttcatagcattctcaaaacaaaaaataaaaattgacagctgcataggggcgaaaagtaattccaacatcatcgagagggacagaagcaattaaataagaaaacaaatataaaaatcagtgaaggtatggaataacacaaatttaaaactttacctatttgacatctgttaaacactgcactcatcatctgcaagagacacatggatttccagtgtacatgaaacagttactaaaactgatcatttgctagattacaaatttcaaaggatagaaaacaaatactctccgaccataatgcaatttaaatggaaaccaataattaaaagataactagaaaatcctcatgtatttggaaattaagcattatgcttctgagtgagtcaaagaagaaatcacagaataaattgatgttttgaactaaatagtagtgaattgccaagtagagtttggaggctttcatagctttgttgaaggaatacacacagctttgaaggaatacacacagctttaaatgttaggaaagaatgttgaaaatcaaatattaggaaagttgaaaatctaagattttgagaaactgaaaaagaaggcggggcacaacggccggcccctataatcccaacacttcaggaggcctaggtgggcggattgtttgagttcaggagttcaagaccagcctgggcaacatggtgagactctgtctctactaaaaatacaaagaaatagccaggcatggtggtgtgcgcctgtggtctcagctacttgggatgctgagatggggggattgcttgagcacagggagcagaggttgcagtgagccaagatcttgccactgcactccagcctggtgacagagcgagaccctgtcccaaggaaaaaaaaaagaaaacaatatttaaaaatttaaaaataaaaaatatggcagagcagaaattaatgaaatagaaaaaacaaacatatgataaagaggatcaacaaagccaaaagtgttctctttgaaaataaaatacaataaaccattaggagtgatcaagaaaagaaagaaggcatatcaatgtgaatatcaggcaagacaaagaggatatgactacacatgcagcagacaccaaagagatcaacagaggcagcctgacaggaaaagggacaaagggcttggacacatcacaaaagagaatctccaaagaataagcctgtgagatagtgcccaactaatcatggaaatacaggttaaaaaaatgaaaaagacaaaatatttaatgctggcaaagatgtggaacaactgaaactcgtaacagtgttaggggtgcagattggtgcatcttcattggtaaactgttgatagtatcatagtgtctcctaaagctgaacatgcacgagttatgacccagaagtcatattcttagacgcacactccacagaaacgcttacctgtgtttacaaagacaggtacaagcgtgatgacagtactgttcaaatagtcaacgactgtcaggtgcggcggctcacacctgtagtcctgacactttgggagcccaagacagaaggattgcttgaggtcaggagttgggagaccagcctgagcaacatggcacaatcctgtctctacagaaaactttaaaaggtagctggatgtggtggtgcattcctgtaatcccagctacttaggaggccgaagcaggaggatcccttgagcccaggagttctgtccaagctgtagtgagctatgcttgcaccactgcactccagccttggtgacagagtgaggccgtgtctctaaaaaaaaacaaagagtcagtaactaaaaactagaaactacccaaatactatcaggagtagaatatgtaaataaattatgacatgttcacaatgaaacattctgtgataatgtgagcaatctccagccacatacagaagtatagaagaatctcacaagtacaatttgagttaaaaacaaaaacccagacctaaagatatacatactctgtgactccaaatttaataattgctcatagaagtcaaatagaggttaccctgtaagaatgggttggtgactagagtgagcacacccagattctggggtcctagtcatgctctgtgtcttgacctaagtatacaggtacatgtaagtttgtgaaaatgtaacaagctgtatgatacgatttttctaatattgctcatctgtgtttgaaacatatacttcagaaaatgttaaggaaaaaatagaaaaggaaaagaaaaatagaaaacctaaataatctagtacttattaaagacttgaacccgtcataaaaagcctttccacaaattaaatactaagccaagcagacttactaaattctaccaaaagctaagaagctatgtcaattttatacaaacttttcaactaatttatgagcattaatttgatacccaaacctggaagggactatataggaaaggaaaatgataaagtcagtcttaattatgactatagattgcaagaacccttaccaaaataggagcaaattgaatcaaacaatttttttaataaggcaaaatgtaacaaccaagttgggtatattcctggtatgcaacactgctgcagcatttaaaaactaatcagttatggagctagagggaagatggcagagtaggaagctctgggaatctgtctccccacccagacgacaactgcactggcagaatctgtctgatgttactatttcggatctctgttcaccatttttatcaggttgggaactctgaagtctattgaaggcttatgacttccaggggaaggtttgaaaggttaatttcagctcttaacatggtagcaactacctgttcgtctaccctcagtcccatagcatgtagccatgtacacattttcaagcagctttgcatagggtttgtgggagccagtgtggacaataaggattctgtcctccaaatagcaggaatctttgctctgatagctaattactgcttctgatcatggaggtgcagccatacagtgagccattgttgcaaaccccactgccactgttacaagcccctccacttgaggctgaagtgacttaaagatttaaagggccattgccttcagtggtgattagtgaggagaaagaaaaaatattaagtaaaaacaaagggctagtgcttccctcttccccccacaccacagacacacacacacaccttttttccccctccccttttgggggccagaccaggacattcaaaagtatatgaggggaggttttcatatccatggaaaatcacaggcttagaaaatacctgaaaagaccctaagtttacacctcaggctgattcctggtacagaaacaccttgcaacagtaaacaataaaattaaattttaaataaaacagcaaaccctgggaaaggaagagaattcgttctccagagttacttacattgtaagatttaaatgtgtagtttcccacaaaaaaatcacaagacatacgaagaaacaggaaaatatagcccattcaaaggaaaaataaacaaactatccctgagaaagactatacttgagaaagagttagacttaataaagactgtaaaacaagatactaaatgagctaaaagacatggacaaagtctcaagaaagtgataggcccagcgcagtggctcatgcctataatcctggcacttagaaggctgagacgagaggatcacttgaactccgtggttcaagactagcctgggcaacatagtgagaccttgcctctataaaaggtaagcaaaaattggccagacgcagtggctcacgcctgtaaccccagcactttgggaggccgaggcaggcagaacacctgagttcggtagttcgagaccagcctgggcaacatagcaaaaccccatctctactaaaaatacaaaattagctgggcgtggtggcgggcatctgtaatcccagctacttgggaggctgaggcacgagaatcgcttgaacccaggaggcggaggttgcagtgagtagagaccataccattgcaccccagcctaggcaacaagagcaaaactccgtctcaaaaaaaaaaataaacaaaaattagctggccatggtggcacgagcctgtggtcccagctacatgcaaagctgaggtgggaggatctcttgagcctgggaggtcaaggctgcagtgagccgagatcacaccactgcactccagcctgagcaacagagggagaccttgtctccaaaaagataaaggaaaaaaaagatgaaaaagatacatgaacaaaatggaaatatcaacaaagaaataaaaaacctaaaaataaaccaaaaggaaattctggaggtaaaaataactgaaatggaaaattcactacagggattcagggagatttgagcagacagaagaaagaatcaacaagttttaacttaaagatacaacaatggaaattatttagtctgcgaaacagagaaatgactgaagaaaagtgaacagagcctaagggacctataagacaccatcaagcagtcaacgtacacattgtggaggtccttgaaggagaatagagagaaggcagagagattgtttgaagaaataatggccaaaaacatcccaaatgtgatgaaagacgtgaatataatccaagaaagtcaatgaactcaaagcaggataaacttagatacccacactgcggcacattataatcaaagtgtcagaatacagagagaatcttgaaagcagcaacttaccacacacaagggatttcccaataagattatcagtcactgtttttgtttgtttgttttttgagacaaggtctcgctttgtcacccaggctggagtgcagtggctcgctgcttacccaggttactgctgtcttaacttcctgggctcaagcagcctctcacctcggcctcccaagcagctagggctacagacatgcaccgccacgcctggctaatttttgtattttttagagagacaggattttgccatgtttcccaggctggtctcgaactctgagctcaagtgatccacccacctcagccttccaaagtgctgggattccaggtgtaaataaatacccaccttgcccagcaatcagcagattttttttttttttttttttatgagacagggtctactctgtctcccaggctggagtgcagtggctcattctcagctcactgcaacctctctgcctcccgggttcaagtgattctcttgcctcagcctccctagtagctgggattacagggactcaccactgtgccctgctaatttttgtattcttagtggagacgggatttcaccatgttggccaggctggtcccgaagtcctgacctcaggtgatccgcctgcctcggcctcccaaagtgctgggattacaggcttgagccaccatgccctgccagcagatattttatcagaaactctggaggccagaaaacagtgggttcaaaacactgaaggaaaaaaaaaaaatttaactgtcaacaaagaatcctatatctggcaaatctattcttcaaaaatgagggagaaattaacacatgcccagataaattaaaactgaaagagtttattacctgtagtcctcccttacgagaaatgctgcagagaattttgtagggtgggatgaaagagtactagacagtaactctacaaaatatcaaagcaaacgtcataattaatggcaaaatattgaaggctttcctttaagttgggaacgaactctatactcatcatccagctgcagcaataattatccacttatgaccaatcttgtttctctccactcacacccacctccttacaccttcattccagattattttgaaacaagtctcagacattcctatcattttgtctgtgtacatcactgtgtatttgaaagataatttcttacaaaaagtcactgattatcatacttaaaataataattatttgataaagttcaaatgttgctggttatttcataagttttgtttgtgtttcttcagtttgttggaataaaatttttagtaagatctattcatggcagttggttaagttgtttaacctatagattctctctccacatctctcttttatgcccccaccccgccacacctcccatttatttgtgatagaaaccaggtcatttcttctgcagatgtttccccagactgtattttctgattaccttctcatggtgttatttatatggttgtttgtccccttattttctgtaaactgataggtagatctctaagtcactttaatatgaaattttcatcaaagtcaaaagtatcataaattaatgaataggttttttggctacactgagctgatgcagaatttgttaaaaccctctgtcattccaagtatacagcaacatattcagtgactaaatctagtttttatttttttatttttgtttatttatttatttattttgttgttgtggagacagagtctcgctctgtcacccagactggagtgcagtggcacgatctcggctcactgcaacctctgcctcctgggttcaagcgattctcctgccttagcctcccaggtagctaggattacaggcatgcgccaccacacccagctaatttttatatttttagtagagtcggggtttcgtcttgttggccaggctggccctgaactccttacctcaagtgatccacctgccttggcctcccaaaatgctgggattacaggtattagccaccatgtccagcctattatttttatttttaaaaatcccagaaacaggctgggctcggtggctcacatctgtaatcccagcactttgggaggccaaggcgagcagattacctggggtcaggagttcgggaccagcctgcccaacttggtgaaaccccatctctactaaaaatataaaaattagccaggcgtggtggcgcatgcctgtaatccagctacttgagagatgggggcaggagaatcacttgaacccaggaggcggaggttgcagtgagctgagatcgtgccactgcactccagcctgggtgacagtgtcagacactgtctcaaaaaaaaaaaaaaaaaaaaaaaaaattcccagaaatgaccagaatgactcaagtttttaatgacattcatattttcagcagagttcaacttttcatgattttctattttatgtgtcatctctcctttgccatcttttttttaaaagtattataatttggtaattatcaatttctacatttattttcgtagggaaatgaataagcgtctaacagaagaacaagccagaaaaacatttgagagagccatgaaactggaacaggagtttactgaacatttcacaggttggaaccgtgttgtaacagtcctctttaagatagaattttgctttgaagccatgtgaaccgacccgttcaggtggattttgaactatgcctacatctacccgtagtaactagtatcatccagcctaggcagtggtgctggggaaccttttttttgagacggagtttcgctctgtcacccaagcggagtgcaatggtatgactcggctcaccgcaacctccgcctccctggctcaagcgattctcctgcctcagcctcccgagtagctggggcctccctggctcaagcgattctcctgcctcagcctcccgagtggctgggattacaggcacctgccaccacgcccagctaattttgtatttttagtagagatggggtttcgccgtgttggtcaggctggtctcgaactcctgacctcaggtgatccacctgcctcagcctgtcaaaatgctaggattacagcggtgagccaccctgcccagccaggaatcttgaaatttaatgtttcttaggttattgattagaacaacaaaaacaggaataattcatacttgaccagagaaaaatagatttagatttcatttcttctatgaaactctgatttttctcttatcctttataaattttgatccattttctctagccatgttgaggtataattgacaaaattcgtatatattcaaggcatataatgtgatttgataaatgtgtacattgtaagttgattaacacaatcaaattaacatgtctttaaccacacagttaccattttgtgtgtgtagggaagactcttaagatctactctttattaacaatagtcactactgctgtatattagatccccagaatttactcatgttaaaactgaaagtttgtgccctttcactaacatctccccatctcttctactctgcagtccctggaaaccacctctctgtttctatgagttctacttttttagattccacgtataaatgaaatacagtatttgcttttctgtgtctggcttatttcatatagcataaggtcctccacattcactcatgttggttgttgcagatgataggattttcatttttatggcctaataaaatattccattgttgtatatataccatatgcatgcatacatacatacatatatatatatatttgttgttgtttgttgttgggtttttttgggggttttttttgttgttgtttttttttgaaatggagtctggctctgtcgcccaggctggagtgcagtggcgcaatctcggctcactgcaacctccgccttccgtgttcacgccattctcctgcctcagcctcccgagtagctgggactacaggcagctgccaccacgcccagctaattttttgtatttttagtagagatggggtttcaccatgttagccaggacggtcttgatctcctgacctcgtgatccacccgactcggcctcccaaattgctgggattacaggcgtgagccaccgtgcccggcctgtttttggttttgtttgtttgtttttgaggcagggttttgttcttgcccaggctggagtacagtgtcatgatcatggctcactgcagcctcaacctcctgggctcaagcaattctctctcttcagcttccttagtagctgggactacaggcgtgcaacaccacacctggctaattttttatttttgtagagacagggtctcgctatgttgcctaggctggtctcaaactcctaggctcaagcaatcgttcttcctcggcctcccagagtgcttggattataggtgcactgcacctggcctacaatattctctttattcattcatcttttttgtttttggagatggagttttgctcttgctgcccaggctggagtgcaatggcatgatctcagctcaccacaacctcccgggttcaagcgattctcctgcctcagcctcctgagtagctgggattacaggcatgtgccaccatgcccagctaattttgtatttttagtagagatggggtttccccatgttggtcaggctagtcgaactcttgacctcaggtgatccgcccgccttggcctcccaaagtgccgggactacaggcgtgagccatcgggcccggctcattcatcttttgacagactcttaggtgattttcatatctgggctattgttgattatgttgcagtgaacataggagtgcagatttcaacatactgatttattttcctttggttttctttttgttgttgttggctttttgttttttattgttttgttttgagacagagtctcactctgttgtccaggctggaatgcgggtgtgatctcagcttgctgcaaccatcgcctcctgggttctgttgattctcctgccttagcctcccaagtagcagggactagaggcacatgccaccacacccagctaatttttgtatttttagtagagacagggttacagggttggccgtgctggtctcaaactcctgacctcaagtgatccgcctgcttcagcctcccagagtgctggaattacaggtgtgagccaccacgcctggcccaatttcctttcctttgtatatatatcgagtagtgggattgctagatcatataataactcagtttttaattttttgaggtggctgggcacagtggttcatgcctgtaatcccagcatttttggaggcccaggtgggcaggtcccctgaggtcaggagtccgagaccagcctgaccaacatggcgaaaccccttttctctactaaaaatacaaaattagccgggcgtggtggtgcatgcctgtaatcccaactacttggaaggttgaggcaggagaattgcttgaacctgggaagcggaggttgcagtgagccaagatcgcacaattgcactccagcctgggcaacaagagtgaaactctgtctcaaaaataataatagtaataataatttcttgaggaatgtccacactattttctgtgatggctttactcatttacattcccaccaacagtgtacagggttcccttttcttcataccattgcctacttgttatctcttatctttttgataacagccatccacacaggtctaaggtgatatttcattatggtttgcgtgtgtgtttgtgacagagtcttgctctgtcacccaggctggagtacagtggcatgatctcagctcactgcaacctctgcctcctgggttcaagcgattctcatgcctcagcctcctgaatagctgggattacaggcacatgccaccacacccggctaatttttgtatttttagtagagacagggttttgccatgttggtcagactggtctcaaactcctggcctcaagtgatctgcccgtctcagcctcccaaagtgttaggatggcaggcgtgagccactgcacccagcctcattatggttttggtttctgttgctctgattaatgaggttgagcacttttactgatacctgctggccatctgtatgtcttctttggaaaaatgtcgattccagtcctttgcccattttttaaatggattatttggtattttgctaatgattttcttatatattttggatattaaccccttaccaattgcatgtttggaaatattttctcctcttccataggttgccttttcattttgttgattgttcctttgctgtgtagattttttatttaatatcccacttgatgattttttattttgctgcctgtgctttccaaaaaatcatccaagaccagtgtgaaggcgcttttttccctgtgttttcttctaggagttttatggttctggttttacatttaagtctttagtctatttcaagttaattttgtataagataagggtttagtttcgttctcttgcatgtggatatccagattttccagcaccatttatttaagacactagcctttccctattgtgtagtcttggcccctttttaatgattagttgccctttgatccgttttgaaatactatttgtttaaaaaaaaaaaaagtaggtagcaactccccaatattcttattttactcgccttgtcctttaacttcctcctcaagtctttggacatttttgttgttgttacttgtttgtttgaaataatatcagcctaaatttgacattcacactgagtatcagtaagggtcatggtttttaaaccttgtgctttcttatttttttcaaactaatttcagacttaaatagaagttacaagaatagtacagggagtttcatgtacccttcacccaaattcctcaagtgttaacattttaccacatttataggtttttttctgatacacttgagagtaagtttcaggtagatgtccctttacttctaaatatttcagtgtgtattttctaaaaaacagggatattcccttatagaatcatagttttattatcaaaatcaggaaatttaataattatatgtctcatctaactatagatcttattagtatttcactattcttctaatctctttagagcaaaatggaaaaaaatggtttttctgttctggtgcaggatccagcggaggctcacgtgctgtattggattatcacatccttaatgttctttaatctgaaatcgttcccaagtcttgttattcatgaccctgactgacattttttaagagtaaaaacactaggggggattttttgttgttttttgtttcgttttgttttttgtttcgttttgttttttgtcttttgtttttttttgagccagggtctcactctgtcacccaggctggagtgcaatggtgcgatctcagttcactggaacctccacctcccaggctcaagtgatcctcccacctcagcctcccaaggagctgggactacaggctacagccaacatgcccagctaatttttgtattttttgtagagacaggatttcgccatgttgcccaggctggtctcaaactcatccaatccgcccaccttcaccttgacctcccaaagtggtgggactacaggcgtgagccactgcacccggccaaagacccattcttttataaaatgtccctccctcaatttggatttatctgatgttttctcataattcgatttaggttctgcatttggggcaggaatagcaatgaagtaatgatgtgtcctctgtgtatcatgcaaggaggtttacaaagtctacttgtgccgttacttatgatgctaattttaatcacatggttaaggtgtctgcagccttatgctttcccagtttccctggtttactaaccattccattaatgaatttacaaagtaagcaaaatgtatatttcccaagtcagttcctgactgttttctcctaaaataaatccttgcgtgctgttgtcaacctaaactatgaaatgctctaaaataaatccttgcgtgctgttgtcaacctaaactatgaaatgctctgggattctgtcctgtgctgttggggtgcatcaagatgccaaacccacgaaccaagtattttgtcaaatgaactgagtcttcagggacattgaggcatgtctgcatttagctcaaaaggtagaagtctcacaaaactgatactagcgaatatcatgttactgaaaattcttggttattcaggcgttcctagctatgtataagtgcttcctacctacatacaacgtctttcttctatgcacatcatctcaggtaccaaatagacagtattatttaaaatccccctttgacattttatgctcagtttttcagaccatggaaatctacacctatgatgctcttccaagatcactgggcatttttttgtagtttagtaagtgacttatttaatttgcaattctcaattatttcatttatatgtaaacttttttacgagacacaaggttccactctgtcacccaggcaaatggtacaatccaatggtacgatcatagctcactgcagttgtgaactcctgggctcaagagatcatcctcctgtctcagcctcccaagtagccaggattacagacacacaccaccatgcccagctatttttttttttttttaaatacacagggtctcactatgttccccaggctgatctcaaactcctagcctcaagcaaccctcccacttcagcctcccaaagtgctaggattgcaggcatgagccaccatgcccaaccataaacattttctttctttcttaaaaagttagttactcatgcttagtgctgtctagcgatactttgtttttgtttgtttgtttgctttattaactaatccctcacagacctcaggggcttcagctattcccaaagaattagttgttagtaattgttactctttttttcacacattatttcagacagcaaataaacattgattgttaagtctctaaccactaacaagctagcttaggtatctctcaattcacctacactacagtacctgacatgctagcttaactgaaaaaagtagtatcaatctgtaatcagctcttttcccccaagatcctaccccaaaaaaaaaaaaaattatccttacatcatcctgtctatgggattgtacccagtttccttttttctacatatgtttatggagaaatcaggaaagttaagaaaataatttgttttaaaataataaagctaatatatgctcagatggtaaaagaacaaaagaaaagatctccaagtcttactttttgatccatttttaagataaaaattttatactatataaataggaaaattaatgaagtgagccttttttcctaagtgaacagtgtgtaaatggtgattcttcctggatgagtaactttttcaaagatactagcttctactatttcatcaataattgtaatggcaaaaatagacaattaatggagatttctgattttgtttctatcattacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctgg

SEQ ID NO: 36185 - DNA, 57359 bp, Homo sapiens
attggctgaaggcacttccgttgagcatctagacgtttccttggctcttctggcgccaaaatgtcgttcgtggcaggggttattcggcggctggacgagacagtggtgaaccgcatcgcggcgggggaagttatccagcggccagctaatgctatcaaagagatgattgagaactggtacggagggagtcgagccgggctcacttaagggctacgacttaacgggccgcgtcactcaatggcgcggacacgcctctttgcccgggcagaggcatgtacagcgcatgcccacaacggcggaggccgccgggttccctgacgtgccagtcaggccttctccttttccgcagaccgtgtgtttctttaccgctctcccccgagaccttttaagggttgtttggagtgtaagtggaggaatatacgtagtgttgtcttaatggtaccgttaactaagtaaggaagccacttaatttaaaattatgtatgcagaacatgcgaagttaaaagatgtataaaagcttaagatggggagaaaaaccttttttcagagggtactgtgttactgttttcttgcttttcattcattccagaaatcatctgttcacatccaaaggcacaattcattttgagtttctttcaaaacaaatcgtttgtagttttaggacaggctgatgcactttgggcttgacttctgattaccctattgttaaattagtgacccctcttagtgttttcctgtcctttatttcggaggacgcacttcgaagataccagattttatgggtcatccttggattttgaagcttataactgtgacaaaaaatgtgaagggaagagatttgaaacatgtggaaggaaaagtgagtgcagactataaacttccaaaaagacaagcccaaaatacacctaaacgttatgtcagattattttgttaaaatcagttgttagtgacgtccgtacgttaatagaaaaaagaatgcttcagtttggagtggtaggtttctagagggatttattgtgaaagtataaactattcagggcaatgggactgagagaacagtgggtagaaaggaccactgaaggaaaggaagagaattggaaggtagatgaaagaaggagcaagaacctggggatgttttttccttttcacttgtaatagtagtaacagaagcaatggcagactggcttttgtttctactgtgttagaatgaattgacaggacaactgggcctattattgtactgtgccagaatactgtaaaacaaaactaaacatactagcttggtggcttgtaattaattacttaagtggagatttttattttttttttattttttttttagacggagtctcactttgtcacccaggctggagtgcagtggcgcgatctcagctgactgcaacctcctcctcacaggttcaagggagattctcctgcctcagcctcccgagtagctaggactataggcatgtgccaccacacctggctaattttgtatttttagtagagatgggatttctccatgttggtcaggctggtgtcaaaactctcgatctcaggtgaaccgcctgcctcagccttccaaagtgctgggattacaggcgtgagccaccgcgccctgcagttttttgtatttttaatagagacagggtttcaccatgttagccaggatggtctcgatttcctgacctcaggtgatctgcccgctttggcctcccaaagtgctgggattacaagcatgagccaccgcgcccggctcaagtggagatttttatatggagtccagttatactctttttaatatataagttgagatgactaatacaacttcaatacaggggctcatgagaaatgtctgtaatatttaagtaacttattgtcttctttcttttttttttaagatgaagtcttactctgttgcccaggcggaagtgcagtggcgtgatcttggctcagggcaacctctgcctcctggtttcaagcgatcttcctgcctcagcctcccgagtagctgggagtacaggcgtgcatgaccacacccggctaatttttttatttttagtagagacggggtttctccatgttggccgggctggtcttgaactcctgacctcaggtgatccgcccacctcagcctccccaagtgttgggattacaggtgtgagcccccgtgcccagcctattatcttatttctgaataaagaattgtctgtgtggggaatagataactctttctcatgcagcccctgctagaaaatttgttttctctagcagttggtctgtgcttataggctactctttgaaagcacaaaaaatttattgacttcttttttttgggtttttttttttttttgagacagagttttgcccttgttgcccaggttggagtgcaatggcgcgatctcagctcaccgcaacctccacctcctgggttcaagtgattctcctgccttagcctcctgagtagctgggattacaggcatgcgtcaccatgcctggctaattttgtatttttagtacaaatggggtttctccatgttggtcaggctggtctcaaactcctgacctcaggtgatccacccgccttggcctcccaaagtgctgggattatgggtgtgagccattgcgcctggccagaaaattcattgacttcctaaagatttattaactttctgcattacttttttttttcccctccatcgtaaatataaaagggaatagtagagaaaatcattcagaattttattttttagtgacattatttagtgacattttattagagtcacttaggaacctgaggctgaataaagttcaggtaaaagtaaaattagttgagaagagacatctgccaaaagaaatctatttttaacttcacttgctgtctttcctagaggaacagaaatagtgctgaatgtcctattagaaatgatggttgctctgcccgtctcttccctctctctcacacaatatgtaaactcatacagtgtatgagcctgtaagacaaaggaaaaacacgttaatgaggcactattgtttgtatttggagtttgttatcattgcttggctcatattaaaatatgtacattagagtagttgcagactgataaattattttctgtttgatttgccagtttagatgcaaaatccacaagtattcaagtgattgttaaagagggaggcctgaagttgattcagatccaagacaatggcaccgggatcagggtaagtaaaacctcaaagtagcaggatgtttgtgcgcttcatggaagagtcaggacctttctctgttctggaaactaggcttttgcagatgggattttttcactgaaaaattcaacaccaacaataaatatttattgagtacctattatttgctgggcactgttcaggggatgtgtcagtgaataaaatagattaaaatctattctcttctgatgcttacattatagtggtgggagacaaaatgggtataataaatattatattagatagcattaagtgctgtggagaaaactaaagcagggaggaagataggagtgtgcaagccagaaaggttgcaattaaattgagtagttcaggaaggcttcaatatggatgtgatatttgagagaccggtggaagtcaaggagcaagttgtgaggctatttaaaggtattcttggcttacagaacaatatacgcaaagactattaaatggaagcatacctgacatgttaaaggactatcaaggaggccagtttgtctagaggctgaaaaggaaagagtaataggagatgaggtctgagtgaaaacacgtaaatccttgtgggccaaggtaaaatctttagctttttttctgaatatggtgggatactgttagagggttttaagcagaggttacgtggtgtggtgagttttttttttttaatcctttgtctttctgtgtggaaaatagcaggacagggcagaagcagtctgtcctgcagactgcttggtcgcagtagagatgtaagaagcagtgagattctgggttaattatggaggcaaagttctcagaatttgctgatatagggtatgagagaaagaggaatcaggaatgatttcaaggttttggtctgctaaatggaaggagttgccatttactaagatgggaaagactatgaaagaagcagattttcagagagatcagaagttcattttggggcatgttcaatttaagatgcctgttagttggatgtttatgtgagtttggaatgcagggtagagatttagggatgaatatttggtagttgtctgcattttaatggtattaaaagccacgagaaggatgggcatggtggctcacacctgtaatcccagcactttgggaggccaaggcgggcagatcacctgaggtcgggagttcgagaccagcctgaccaacatggagaaaccccatctctactaaaaatatataattagccgggcgtggtggcacatgcctgtaatcccagctactcgggaggctgaggcaggagaatcgcttgaacctgggaggtggaggttgcgatgagccgagatcgcaccgttgcactccagcttgggcaacaagagcaaaactccatcaaaaaaaaaaaaaaaaaaaaaaaaaagccttgagactcacctgaaaagatgctcaacattattggtcattaggaaaatgaatgaaaaccacaatgagataccacttcacacctattaggatggctattatcaaaaacaaaaacaagtgtttgcaaggatgtagagattggaattcttgtgtattgctagagggaatgtaaaatagtgcagggtgctgtggaaaatgctgtggtgattcctcaaaaaattaaacataattatataatccagtaattccacttctgagttattcccaaaagaagggatgcaagcagatatttgtacactcatattcatggcagcattatttacagtagccaaaaggtgaaagcaacctaagtgtccgtcagtggatgaatggataaacaaaatggaataatttcagccttaaatagaaataaaatgttgacacatgttgcaacatatacgaaccttgaagacatcatgttaagttaaataagttggtcactaaaggacaaatattgtatgattccccttatgaggttcctagagtagtcacattcatagagacagtagagtggtggttgcccagggccggggggagcgaggagaatggaaattattgtttattgggtacagagtttctgtttggggaagatgaaaaaattctggagatggatcatgatgatagttaacacagcagtgtgaatatagttaatggcacagaactgtacatttaaaaatggttaagatggaaaattttctgttacatatattttactgcaatttttttaaattttattattatactttaagttttagggtacatgtgcacaacatgcaggtttgttacatatgtatacatgtgccatgttggtgtgctgcacccattaagtcatcatttagcattaggtatatctcctaatgctatccctcccccctcccccaccccacaacagtccccagtgtgtgatgttcccctttctgtgtccatgtgttctcattgttcaattcccacctatgagtgagcacatgcagtgtttggttttttgtccttgtgatagtttgctgagaatgatggtttccagcttcatccatgtccctgcaaaggacatgaactcatcattttttgtggctgcatagtattccatggtgtatatgtgccaccttttcttaatccagtctatcattgttggacatttgggttggttccaagtctttgctgttgcgaatagtgctgcagtaaacatacgtgtgcatgtgtctttatagcagcatgatttataatcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaagatcgccattctaactggtgtgagatggtatctcattgtggttttgatttgcatttctctgatggccagtgatgatgagcatttcttcatgtgttttttggctgcataaatgtcttctttcgagaagtgtctgttcatatccttcactcactttttgatggggttgtttgtttttttcttgtaaatttgagttcattgaaaaattagaatttttttttttttcccttttttagaggcaaggtctcactctgtcgcccacactggagtgcagtagtgtaagcatagctcactgtaaccttgaactcctgggctcaagcaattctgtcatctcagccagctgaagtagtaactgtaggttcacaccaccatgcctatttttgtttttgtagaaatagggccttgctttgttgccaaggctggtcttgaactcctgacctcaagcagtcctcctgtctcagcctcccaaagtgctgggattataggtgtgagccactgcacccagccttggagatttttaataaagaagcttgtcaattaaacaaacaacaaaaagccctgagactgaatgagataatcaagagagtatgtgtagatagagaagaggtccaaggaaggagtcttgggtgactctgatgtcaagtgaggacatgaggcagaaacagcagtgactgagaaggagccacctagtaagaaaggaggaacaccaggacagtgtggtattctggattccaaacaaggaagttactgctaattttaaagctcttctcaggctgggcatggtggctcacacctgtagtcccagcacttcgggaggctgaggtaggtaaatcacttgagctcatgtgtttgagaccagcttgggcaacatggtgaaacctcatctctactaaaaatataagaaattaaggccaggtgtggtagttcatgcctgtaatcccagtgctttgggaggtcaaggcagccagatcatttgagatcaggagttcgagaccagcatggccagcatagtgaagccccatctctactaaaaatacaagaaaaaattaaccaagcatggtggcgcatacctgtaatcccagccactctggaggctgagacatgaaaattgcttgaacccgggaggcggaggttgcagtgagctgagatctcgccactgcacttcagcctgggtgacagagcaagactctgtctcaaaggaggttgcagtgagctgagatctcgccactgcacttcagcctgggtgacagagcaagactctgtctcaaaaaaaaaaaaaacaaaaaccaagaaaagaaaaaaaaactcttctaagaggatttttttttcctggattaaatcaagaaaatgggaattcaaagagatttggaaaaatgagtaacatgattatttactcatctttttggtatctaacagaaagaagatctggatattgtatgtgaaaggttcactactagtaaactgcagtcctttgaggatttagccagtatttctacctatggctttcgaggtgaggtaagctaaagattcaagaaatgtgtaaaatatcctcctgtgatgacattgtctgtcatttgttagtatgtatttctcaacatagataaataaggtttggtaccttttacttgttaaatgtatgcaaatctgagcaaacttaatgaactttaactttcaaagactgagaattgttcataaataaactattttacctgcagagacctctgatatatgtttcttgatggaagtacccagtaccacctatgaagttttcttgtcaaaaaatcaaatgtgaatctgatcattacttagatctaagtaccaatatatgaaaaatataggagacaaggaagcatggtaaatgatactgagattgggagactacatggaaaaagacttgttcccttcaacagatagacagcagggaaaaaagaatagagaaaggagtaaagaacctgtagattaaaagacatttaagggacatatgaaccaggtccagtgtatagatcttacctaaatcctgatggagcaaactataaaaaaatttttttgagacaaatgtttgaatacaggttgactatttgatggcattaaggagaaattatgaattatcttggtataagaatattgtcatgggtttttttttttgagtccttacctgttaagatacatactaaaatatttgtgggtaaaattatatgacgtataggagtatatgatttagaaaacggattaaaatataaaaggataaaataggatcttatattttgtgactcacttcctgttggatatctttctacccagtaaatatagtcctatctaggttttaatggctacatgtatgtactgtagtttgtttaaatggtttcctattgaacatttatgctctttgccattttttcctgtttaacgttctgtttttttttttgtttttttttttttttgagacagtcttgctctgttatccagactggagtgcagtgacatgatctcagctcactgcaacctctgccttctgggttcaagctattctcctgcctcagcctcctgaatagctgtgattacaggcgtgcaccactatgcccagctaatttttgtattttgggtagagacagggtttggccatgttggccaggctggtcttgaactcctgaccttgaatgatctgcccgccttggccttgcaaagtgctggggttacaggcatgagccaccacgtctggccttgtttaaggtcctgatgagtattcttataggtacactgtgtttcgtttaattatttccttaggataaatttatagaaataacattccttggtaaaagaatacatattttaaaaactgtattagtttcctgttgctgtcaaaaaatttccagaaacttagtggcattaaacaatacaaattaattattctacagttctggagatcagaagatacgggtcttactaggcctcactaggctaaaatcaaggttttggcagggctgtgttcctctatggaggttccaagggaccagagaaactactttacagtagttattttaagggaatgaaagtgaagatggggttgggcagtcaaagaggctgttacttttcatttttggcctttcagtagtttgaatttttttatcatatacatgtattactttaatttttaaaaagtaaaaagcagctgtgattcagtctctgtaatttagatcaatttacatcaaactagggtggtctcatgtgttgtcttgctcacagtgaccactagattattccaagaagggacaatttccaagacttggtttacactgagacggctcctgattttaaggataccttagatcaaactctaggaaggcagtttcattttggccttgcagttccctgggtcattttccaagcccatggcctcctggagtcttcgcctagctgtaggttatctttgtggctattatttcactgtaattatacaggaagatttattgagggatttctgtgtaccagccgtggttctcagcactttgtatactttgtattaactctgactcctgacagtaactctacagaggttctgctgttacccagttttacatagaaacatggccagcggacgcagttagaaaatggcaaagtggggattagaaactaggcagtttgactccagagtctgtgcccctgtccacttggctccactgctggggaagaggcctctgaagcagcaggaccatctgctgtgccgtgtgtagtggtactctatcttcctggtgtgatgttgtgttctactttgcattttcatgtctttccttatacaggtctcaaaatcatttacttttttttttttttttttgagacggagtctcactctgttgcccaggctagagtgtagtggcatagtctcactcactgcaacctccgcctccgaggttcaagtaattctcctgcctcagcctcccaagtagctcggattacaggcacatgccaccacagctagcaaatttttgtatttttagtagagattggtgtttcaccatgttggccaggctgttcttgaactcctgacctcaggtgatccacccacctaggcctcccaaagtgctgggattacaggcgtgagccaccccacccagccttatattttttaatgatgcacattagctcaattacataaaccagggaaatccagctaggacctggtgatttctgagcctgacccatgtgactttcaatgaactgaacttgccacagctgtatttactgtctactgagatgctgtcacacagaccccgtcatagcacagttcctgagttacatctttacatactgtagtatccttcttgtgaaaaaagatacagattccaaaggtctgagaaaccaatcttggttataaaggggaaaaatggtcatgggtttttaaaatttgttttgtcttaattgcatttcaaatttacatttctaaatgaataattgcttatataaagcagttttgattaacaatataaaacactatctatttggagtgattcctttacccatttctgaaggcaagttttaaaaattactagaagacacttcattgagaatattattaaacatgcctatagttctaccacctcaacacaattgcttattaacacattaatgttttggtgtgttttggactttttaatatgtatttttcacttgttctagtaattatgctacagattgatcatttctttttcaacatgtcatcaaagcaagtgagcaaagtgctcatcgttgccacatattaatacaaaatggaagcagcagttcagataacctttccctttggtgaggtgacagtgggtgacccagcagtgagtttttctttcagtctattttcttttcttccttaggctttggccagcataagccatgtggctcatgttactattacaacgaaaacagctgatggaaagtgtgcatacaggtatagtgctgacttcttttactcatatatattcattctgaaatgtattttttgcctaggtctcagagtaatcctgtctcaacaccagtgttatcttttttggcagagatcttgagtacgttttcttttctccttattgataaattgataatcctcaaggatgattattaggtgatactcttacttcatggattcttaaaagatatgatttaacatattacaagtgcctagcaaggtgtctgttacacgtaggtattttaagtaaatggtagctgctgatgtaatttctgcccctttgcccttcagttggggtattgctttggaccgattagagggctgtggctgggatgctaaaggttcatgtttccttagctggctcctgagccaccagctcccaccacctgtgtatacctgtgctagtttgccttcccacaagtagctgctggctatctgttatgctggtacagttttcagaaactgatgaatggcctttgaacagaacaaaaatgagattcagaataacaaaattgcacctttgtttttataagcactggccattcactagttgaagactggtaggaatacctaattcatgccaaaagaaagataatttttaaaaatcacacaggttgtttgtagattaaaagggaaaataggctaggtatagtggctttgcctgtgagtttgggaggctgaagtgggaggattgcttgaagtcaggagtttgagaccagcctgggaaacagagcaagaccccgtctctacagaaaatttttaaaaaattagctgggcatggtgatgcatatctgtagtcttagctactccggaggtgggaagattgcttgagcccagcagtttgaggctgcagtgagctgtgattacaccactgtactccaaccttaaaataaataaataaataagggaaaatatcttcaacaaaggatagttctgtctgtttctcagtcttcctcaacagataaatgtgtgaagtaatggaaggtggagatttcagattacacaacattaatgctaagggcgtttgactctgtgtgaattctaattgccctagatctagacgggctgatactattagaatcccctgtcactaactgaagacagagttgtaagttaatgccttcctagatagcctagattgtggtatgctgctgcatgctaaaatggctccccttccatagcaggatgaaatagagtcattatcttggcaaccagcccctgccaatgtgctctcagtctgcctttccagccccttctctctacctattcccagctgccatgtattctaaagcctctatgctttcatttttgtttttgccttcctggatggtctttcctgctgtctccacctgaaactattcctctctaaagaacagatgaattgccatctctctgggatgcttttacccaccctcactcccacctcaggctgaatggacccttctctagatcgcttagcatattgttctacagttaggtaaaaagtctacctatcactagatcaagagctttgtttttttttattaatttaattttcttttttttttttcttttttttttgagacagagtctcgctctgtcgcccaggctggagtgcagtgcacaatcttggctcactgcaagctccgcctcccaggttcacaccattctcctgcctcagcctcccgagtagccgggactacaggcgcccaccaccacgcccagctaattttttgtatttttagtagagacggggtttcaccatgttagttagccaggatggtctcgatctcctgacctcgtgatccacccacctcggcctcccaaagcactgggattacaggcatgagccaccgcgccgagccccaagacctttctttattaccagggcttccacagacctgacacatggtagttcctcaataaataattgcagaattactgaaaaattttactgttaacttaggcagtggtaaaaccattgtttggtagctcagaactcagcaagtaaatagcaacatttgctggaagaacagatagtttttcaaatccaattcaaggactgggtatggtggctcatgcctgtaatcccagcactttgggaggccgaggcaggcgtatccaggagttcgagactagcctgaccaacatggtgaaactccgtctctactaaaaatacaaaattagccaggtgtggtggtgggcacctgtaatctcagctacttgggaggctgaggcaggagaatcgcttgaacctggtaggcggaggttgtagtgagctgagattgtgccattgctctccagcctgggaaacaagagcaaaactccgtctcaaaaaaaaaaaaaatccaattcaaatgattatggaagtagtggagaaataaacaggaaaatgataaataattaagataatatataatatggctatattttaatctattgttgatatgattttctcttttccccttgggattagtatctatctctctactggatattaatttgttatattttctcattagagcaagttactcagatggaaaactgaaagcccctcctaaaccatgtgctggcaatcaagggacccagatcacggtaagaatggtacatgggagagtaaattgttgaagctttgtttgtataaatattggaataaaaaataaaattgcttctaagttttcagggtaataataaaatgaatttgcactagttaatggaggtcccaagatatcctctaagcaagataaatgactattggcttttgtggcatggcagcctgccacgtccttgtcttttttaagggctaggagattctttattgggatggcaaaagtcaatggcagggtagttgtcattgaaagaagattaagcttgaccccagaaggcatgggttagagcccagccttgtcactcaatggttgtatgtccagaggcaagtcacttaacatcccttaaccccagttttctcatctgtcaaatgaagcaaagaatacttgccctcttgacttaaagggtgtctgatgagacatatgactgtatcattagctgggagaaagtccatcgtgctgcctatgtatagtgcctcaagttggtctctttcccttctatgattacacaaagcactccgctgtcatgttatccatcccgcccctccattccaagtcccatctagagcacatcttcttgaagtccactgtaacctgcctaatcctggatgtgacgagccaggcaggaggcagaaaagaatgtgtgttttgcaatacatgttaagagacatcttgggctgggcacggtggctcacacctgtaatctcagcactttgggaggctgaggagggcggatcatctgaggttgggagttcgagaccagcctgaccaacatggagaaaccccatctctactaaaaatacaaaattagccaggcgtgatggcgcatgcctgtaatcccagctactcaggaaggctgaggcaggagaattgcttgaacccgggaggcagaggttgtggtgagttgagatcatgccactgcactccagcctgggcaacaagagtgaaacagggtctcaaaaacaaaaacaaacaaacaaaaaaaatcttttaccacggtgaccaccatgtgatttccaagaacttcaaatgatctaagaaattttgtgattattactagtttgaaaaatactttttttttttttgagacaaagtctcactctgttgcccaggctgaagtgcagtggtgtgatctcagctcactgcaatcactacctcttgagttcaagcagttgtcctgcctcagcctcttgagtacctgggattacaggcatgcgtcaccatgcccggctaatttttgtatttttagtagagacagggtttcaccatgttggccaggctggtctcgaactcctgacctcaggtgacccacccaccttggcctcccaaagttctgggattacagacgtgagccactgcacccagcctgaaaaatatctttgaatgccatgtgatactatacttgtcagtttacatgtgtgtcccactaaatcatgtactctcctgagcaggatcatgctttgtcttcatattttctgtacaaagcaaagactctgacacaaagctagcccccagtgcatagttgagaaatcagtgaatgaatgtgggaggcaggaaaaatgtcctttaattcttctgttaatgctgtcttatccctggccccagtcagtgcttagaactgtgctgttggtaaatataattggattcactatcttaagacctcgcttttgccaggacatcttgggttttattttcaagtacttctatgaatttacaagaaaaatcaatcttctgttcaggtggaggaccttttttacaacatagccacgaggagaaaagctttaaaaaatccaagtgaagaatatgggaaaattttggaagttgttggcaggtacagtccaaaatctgggagtgggtctctgagatttgtcatcaaagtaatgtgttctagtgctcatacattgaacagttgctgagctagatggtgaaaagtaaaactagcttacagatagtttctggtcaaggtttagccaccaattttgcagtttctctcatctccccaggaaagagcagttggtctttagatcaatgagagctcttttatggcagacaaaacaaagtgactctagccaacttgagctaaaaagaaatttagtggaaggctaggagttaccacatgaagtgtgtgcagctgccccttggagagaataagaaccagggtgcctctgggacttaacatcattactgtactccagttgttttcattcttttcctgactttgctctagagtcagtttcctaacagagtacattcgatgatcatgtgcccatatctgtggggagaagatttcttgattggcagtcttactaagggtgcatatcaagtagaatggaatagaggtagtttcctaaaggaagatgagaggctgttaccaggaggaggagaagggattcaggacagatgaaaacaacgttatatccatgatagacttacgctgctggtacagatggtacaggtggcttcagtataggctctccgaacccacatatcattgattatgatagggatatgttaactatttttcagtgtatatatgtatatgtgtgtgtgtatatatatgtatatgtatatatatatgtatgtgtatatatgtatatgtatatatttatatatgtatatgtatatatttatatatgtatatgtatatatttatatatgtatatgtatatatatttatatatgtatatgtgtgtatatatatatttatatatatgtatatgtgtgtatatatatatatttttttttgaaacggaatttcgctcttgttgcccaggctggagtgcaatggtgcgatctcagctcactgcaacctctgcctcctgggttcaagcgattctcctgtctcagcctcccgagtagctgggattacaggcacttgccaccatgcccggcaattttttttttgtttttttttagtagagagggggtttaatcattttggccaggctggtcttgaactcctgacctcaggtgatctgcctgccttggcctcctaaagtgctgggattacaggcgtgagccaccatgcctggccatttttcagtatttcttttttttttttttttttttttttttttgagacagagtttcactcttgttgcacaggctggagtacaatggtgtgatctcggctcaccgcaacctctacttcccaggttcaagcaattcgcctgcctcagccttctcaagtagctgggattacaggcatatgccaccatgcccggctaattttgtgtttttagtagagatggggtttctccatgttggtcaggctagtctcaaactcccgacctcagatgatcctcccgccttggcctcccagagtgctgggattactggcatgagccagcgctcctggcccatttttcagtatttctaaaaaaaatctaaagtgggtcaaacatttcaccttaatagaatgacaggtttgtacatcaagtttctttgctttttcttggaattttatactttttttttttttttggagacagagtcttgctgtgttacccaggctggagtgcagtggtgcgatctcagctcaccacaacctccacctccaggttgaagcaattctcctacctcagcctcctgagtagctgggattacaggcacatgccaccacacccggctaattttttttttttttttgtatttttagtagagacagggtttcaccatgttgtccaggctggtctcgaactcctgacctcaggtgatccgcccatctcggcccaccaaagtgctgggattacaggcgtgagccactgcacccggcctttttcttggaattttatcaatcagtgtcagaatattcattacctcctaaaaataaaggagttctagttggctgttttgattctaggtgtggtaaagtgaaatattgttacttaataaatgcattttgctagacacaatccttcggttcacgagctctgtagagaaaagagaaataaccgccaaccaagaaaagattgggagatactagaataagacccaggggcaggaagaagccagtgagaaggagggcatgttgagagctctgagagagaataaaagcaggggttgttggagctagcttctcaagatgtccttgaggcaaaccagacctttgggacactctgaaaataaaactgaaagtgaagagattgtgggccgaatgtggtggctcacgcctgtaatcccagcactttgggaggtcgaggcgggtggatcacctgagatcaggagttcgataccagcctggccaacatggcgaaacgccatctctactaaaaatacaaaaaaaattagctgggcctggtggcaggcgcctataatcccagctactcgggaggctgaggcgggagaatcgcttgagtccaggaggcggaggttgcagtgagctgagatcgtgccattgcactccagcctgggcaacaagagcaaaactctgtctcaaaaataaataaaaataaataaaaaagagatagtggcgtgatatccttgattctatcagcaacctataaaagtagagaggagtctgtgttttgattcagtcacctttagcatttttatttccatgaagtttctgctggtttatttttctgtgggtaaaatattaataggctgtatggagatatttttctttatatgtacctttgtttagattactcaactccactaatttatttaactaaaagggggctctgacatctagtgtgtgtttttggcaactcttttcttactcttttgtttttcttttccaggtattcagtacacaatgcaggcattagtttctcagttaaaaaagtaagttcttggtttatgggggatggttttgttttatgaaaagaaaaaaggggatttttaatagtttgctggtggagataaggttatgatgtttcagtctcagccatgagacaataaatccttgtgtcttctgctgtttgtttatcagcaaggagagacagtagctgatgttaggacactacccaatgcctcaaccgtggacaatattcgctccatctttggaaatgctgttagtcggtatgtcgataacctatataaaaaaatcttttacatttattatcttggtttatcattccatcacattattttggaacctttcaagatattatgtgtgttaagagtttgctttagtcaaatacacaggcttgttttatgcttcagatttgttaatggagttcttatttcacgtaatcaacactttctaggtgtatgtaatctcctagattctgtggcgtgaatcatgtgttctttcaaggtcttagtcttgaaaatatttatagtgtagtagaactattttatcctccaatgctccttcttttccttgtatttccattatcatcactttaggatttcacttatttatcattcaacatttattaattgcctctcatattccaggctttgtgctagaagttagggatataaagacaaataagatatttcctgcccttaaagactagattcgtgttgctaagtcttcattatcaagaaaagcataagtggggaaaagtgcttgcattatggattcctcatagttgctcccctctgcatgtaaaaatcaccatttccatcatagattcctagcggtctcaggactttataaagcccaaagtgcctatgtcataatatgaggaaaaatactgagacccttccatatatgggaggtatatggatgagacagctcctgacttcacttttcccagaaatctgaaaagcagcagcagtcattccagagcccagtttctactttgaagggcagattatttattctttgagctaacctgactgaggaacaattagtttgcttttaatttactattttctttttcttttcttttcttttttgagacagagtctcactctgttgcctaggctggagtgcagtggctcaaacttggctcactgcaagctccgcctcccgggttcacgccattctcctgcctcagcctcccgagtagctgggactacaggcgcctgtcaccacacccagctaattttttgtattttttagtagagacggggtttcatcgtgttagccaggatgatctcgatctccagacctcgtgatccacccacctcggcctcccaaagtgctgggattacaggcgtgagccaccgtgcccagccactattttctttctaattgttaatgaattaattttttaaaactgtgctcctagagcgaagggagagctctgtttacagtgtaacttttcagagcttctttaactagattttaagatcagaattagttgttgtgaaatcttagggactgtacaagattagaaatcctctatagcagcatttcccaaagcaggcttccagaacactagcctcatgaggcattttgggaaaaaagagtttgctggttcagtgtgtatgggcagtgccacaagccgtaccctccgttgaagacactcattccacacattactgcataaaaagcttccaccagccattcggcaaacttattgagtgtctgctatttcctgggtattgtgctatatggtagggttatagtagtgaacaaagaagaaatgatgcctgctctcagctgactttgcagttggaaagacacatgaaataattacgccattcattagcagattgtgctagatgcctcactggaaaaataaaggacatgatggaaaactctgtagggtcagagaaagggatcattagagaaggttctttgaagaaatattttttgaaatatgaaggataaataggaattaactaggtaccaataggttaggagtagagctttccagacagagggactagttcttgggaaggtctccagacagaaataagtgtggcttgtctgaggacctcttattcgcctattaaccttccctccccagtaaacactcctgggaacaacacacattgtagaaccacgttgtggtgctgttcagtatagcaagtaattcagcagagataagttcttggaatctcatctttgggatttagttactaagatacattcaagtttgagcaaaataaggtctcagagcttggattcattgttctgttccagcaattagagcagtacctggcacatagcacaagtgcttgaaaacactgactgagtagggtaggtgggtgagtgggtgggtgggtgggtgggtggatggatggatgggaggatgggtgggtgaatgggtgaacagacaaatggatggatgaatggacaggcacaggaggacctcaaatggaccaagtcttcggggccctcatttcacaaagttagtttatgggaaggaaccttgtgtttttaaattctgattcttttgtaatgtttgagttttgagtattttcaaaagcttcagaatctcttttctaatagagaactgatagaaattggatgtgaggataaaaccctagccttcaaaatgaatggttacatatccaatgcaaactactcagtgaagaagtgcatcttcttactcttcatcaaccgtaagttaaaaagaaccacatgggaaatccactcacaggaaacacccacagggaattttatgggaccatggaaaaatttctgatccataggtttgattaaacatggagaaacctcatggcaaagtttggttttattgggaagcatgtataatttttgtcctaagtctgtgctcagccctcccacatgtgctcattgctggttgactgttggagtctggttcttacctctaagaggaagcccaggagagggcataaagccagcacactgtcctcacctgatggtgtcagagtccttacgagtaagccctagccagaacattgctggaagagatcaagggccactgtttgaaattgcacagcaggatacggaaaaggggtaccttaggtataggcattgtcattaaagaaattgctaagatacttgagattttcctgtttaaggaatgagctttatgatacaaagagcagttctaaaaattagggagggaattaactaaattaattaggatatttctcaaattcctttacagtttttgtctctctgctgatatagtgtttacatgattgttatttactaaacaaatgctattttgtattgtgctccttataacttaattgtttattacaaggttttgatggtgacctaccaacaacaagtaatcccaaacacagtctgaattttttgttttccatccagaaataagatgaatctttccatttccgtgttttcagttttcatcatttttatcctataggttacttatctttattttaaagcatttcataataattttatagtttttgttttgtttgcttgtttgctgttggaaatggaatattccctccttccatttagactgctaaccagctgtaaatgtttcaaaatatgcatgttttacagcagttgttcaaagcaatacaggaacagtaaggacagagccagtcattttacaaccacattctgttaaactgatgtctattagcagggtttttcctattttattaggaaggacttacacctgatatataacaaagcttgttttaatcaaggctcagaaaatgtttttcattagtttttttcctaaccatgaagaataactgctttgtaacacacatgctggctataaagcagacaaaaaattcactgtaggtgctgcctgactggcctctgtccgtgtttctgttggggctgcttaccacagcctctgcattatcattagctagtgtgttcacaataccaagttcccagtagcaaagaaaggtcaagctcttacgcatgccattcatttatctacactgtgcaggcgcactcaggtggcagggacaaagaccactcctttggcgcatctcaagttcagaattctcagtagaggggctccagctgtccttttgtcaggtgcccatgcctgctccaggcctgtgtggtcaggacacgtgttacagagtacagtgacattaatgatggggccatggatatggtcagcactcagaggatgttagtctcttcattgataaagtcacaaccacttttcctgttggaaataaaaagatttgacgtatccttgtctacagcaacacaggacaacagataatcagcaggtcatctaaatctgttcagagagaaaggagagctgtttcctgaaaatacatcttcccctgattttagtcttatttttttctgcctttattgctttctaccctcttcaaaccagcctcatttcctaaattaccttgaatatgcattgacacttgtactgcctgaaattctggaaaactcagtatggctactccaccgtcagaacttcctgagcaaagttagttgctctctcggctcactgttttgttttgttttgttttcctgcctcaggtttatttgtacaaatagcacaggaggaccagccccatgcagatggtagcccaggggcgggggtagggggtcacaccagtccttctgtcctcatgttggcagagatatctactctgaagcctttgtaggggcctgggcacctttgggagcctgagctggaactgaaggtggagctgcagcctgggccttggtttgatccttggccttggcctttggccggcacagcctgagccccttggcaatacgggcacgagcacgcttcccaagcttgggatgggcaatgtaggcaagtcgatcgagcttgcggctgacaccctttgggatcttgggcttaacctccttgggctttacgagggccttgatagcctcggcacgtgcactcatggccttggcattgttggcctgcatcttctttaggcccttcttgttgtgcttcttggcaaagtgcatgttcctcaggaacttggggtccacccccttaagagattcgtatctttgtgatcggggtttcttgataccatttctgtgccattttcgggactggttgtgtgtggtgtggttcttggacttcgccatgtctacaccttaagccgcggctcccgaagcacctagaaccggaagagttggctcactatttagcacacacacacgtctataatagtgctggccacttggggttggaattagtttatttatcagcatgttgtctcccagcacttggtgtgtgtgatatgcagtatgtatttgcagaatgaaaagtctgagggctgacatcatatttcccactgtgcccagaaagagcacagttagtccacatgagctaatgggggcaaagggaagtgaggagggagaatgtactgccttatcatgttttctattacttggctgaagtaaaacagtcccaagccgatagtaagatagtgggctggaaagtggcgacaggtaaaggtgcacctttcttcctggggatgtgatgtgcatatcactacagaaatgtctttcctgaggtgatttcatgactttgtgtgaatgtacacctgtgacctcacccctcaggacagttttgaactggttgctttctttttattgtttagatcgtctggtagaatcaacttccttgagaaaagccatagaaacagtgtatgcagcctatttgcccaaaaacacacacccattcctgtacctcaggtaatgtagcaccaaactcctcaaccaagactcacaaggaacagatgttctatcaggctctcctctttgaaagagatgagcatgctaatagtacaatcagagtgaatcccatacaccactggcaaaaggatgttctgtcccttcttacaggtacaaggcacagttttccttcatttattcactaatttagcagaacctcactaagagcctcctatatgccaggctctgcgttagcaataaaaggaatgccatgcctcaccccatcaggaggtgctgatagcttgtaggcggagtggaaacagatgtgctctagaggctctaaatattacttctgctggggtcagttgggaagccacaacagctactgttcatcttccataaaagacaatcagccgggcacagtggctcacacctgtaaatcccagcactttgggaggctgaggtgggtggatcacaaggtcaggtgtttgagaccagcctggccaacgtggcgaaaccctgtctctactaaaaatacaaaaattagccaggcatggtggcgggcgcctgtagtcccagctactcgggaggctgaggcaggagaatcgcttgaacctaggaggtggaggttgcagtgagctgagactgtaccactgcactccagcctgggcgacagagcgagactccatctcaaaaaaaaaaaaaaaaagactgggttctgttctgtggaggttcttgtcttaacatatccactgttgattgcccagatgttgatgtaattaatttagcagtcgtaaatagtttagcacttgcattaaatagaccaaaccccatagtaggtatttgaaatacagaataaatgtgaggtacccctgctctaaaggagtttatagtccagagctgacttatggaggatttctttctattatttctgggtctgctactaatttgtctatttcatatcctaattatccttgttttcattttgattgaaagggggagagcatagaaattgtggtaaaaggtagttttattttttatttgagatggagtcttgctctgtcacccaggctggagtgcagtggcacaatctcatctcattgcaacctccacctcccgcgttcaagcaattctcctgcctcagcctcccgagtagctgggattacaggtgtgcaccaccacgcccagctaatttttgtatttttagtagagatggattttaccatgttggccagtctggtcttgaactcccgacctcaggtgatcctctcactttggcctcccaaagtgttaggattacaggcctcagccactgcacccagcctaaagttagttttagattaagtgttttcatgttttcccttgcaaagtaataaactggtcaagttatcaccttgttccatctccatattaatcagggtccaaacaggagatagaaaccatgcaacaatttgagtagttgaataaagaattataaacaggagattagagtaataggggattagatagtaagaggtgaagagataggaacagcagatataaagaacaaccatttcctcctatggctgagataccatcccctcaccacactcccccacctactcactgagatgcagaccttattgaagagaatgtaactggcttgctgcgaggtaaagtcaatgaggcgctccccagtaccactctgaggggatgctggggaaaactgcccatgagaagagggcacatgctgctggccacttgtgctaaagaacttgaagtctgataggagtgcaccctaacctggcatagaaaccctttcttcctgctgagtccctctagcaccttatactggcaaagctttacattgcaaacctccattatcacagagcaagcaatgaaagatggactcagagctgaggcgataaattgatagctagcatagcctctaaactgacttttatgactacattttatggatagaaagtgttcttatatatattgtttctttacataataggggacttattcatggctgcagatgagaaaacagatcctaagaagttaagtgacttgcccaaggtcacacaaagaattccactagttctaaaatgacagtaattacagttaacatacattgtatgtggcagatacatataaagcacatggcattaatttttttttttgagatggagtcttgctctgtcgccaagctggagtgcagtggcacgatctcggcttactgcaacctctgactccctggttgaagggattctcctccctcagcctcccgagtacctgggattacaggcatgcgccaccacgcccagctaatttttgtatttttagtagagacgtggtttcatcatgttggccaggatggtctcgatctcctgaccttgtgatccacccgcctcggcctccccaaatgctgggattacaggcgtgagccaccacgcccggccacttggcatgaatttaattcccgccataaacctgtgagataggtaattctgttatatccactttacaaatgaagagactgaggcaaagaaagatgatgtaacttacgcaaagctacacagctcttaagtagcagtgccaatatttgaacacactcagactcgatcctgaggttttgaccactgtgtcatctggcctcaaatcttctggccaccacatacaccatatgtgggctttttctccccctcccactatctaaggtaattgttctctcttattttcctgacagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccaggtcagggcgcttctcatccagctacttctctggggcctttgaaatgtgcccggccagacgtgagagcccagatttttgcctgttatttaggaactttctttgcaagtattacctggatagttttaacattttcttctttgaacctagttataaaggtattgtgctgttgttcctaggcttagagtcataaggcctgagctcacttcctcactttgcctccatctggaaccttagaccaacttcctaggaaaacgagctgtctgaaaacagaatagggtgcctcttcaatgtgctcttcactggagatgttcaggaggaggctactcccacctacacagggtgcagtggagggtctgggccccagggaggcagcaggaagagtggaaagagcggaggctctactgttggacagacctgggttaccagccgtgtgactagccttccctggcctccatatccccctcagtaatgaaggaatgtgtcatccccaaatccagggacagttacaagcagtcagtgaacagaaagtgtctggtacaggttctaagtgcttattattctaagtcacttcacttacctgagttctcagttttcctatctataagataagcaggttggataaaatgttctccaatatactcctggtcctgagatgatgtgattgtgggcagccctttaatcatggtgaagatgttcatcataagcacactgaaactacaaaataggaatataaatattttctccattaaattatgctggatcctagaagcaaaaactggaactgtgaaaccctacttcacagaaaacttaaaattcccaagcagatgaatgcttctcggaaggacactgacagttacctacctggaaagaatctagatggaggtggcatgggcactaagcggtgagattaaacccagttagggcagccccaccagccttggaacccacacatctggagattgttgatgcagagagaaaggttcctactggtgagacctgaaagggatatgtggcaggtgggaggaagaagttctgtctggaaaccaacccttgttcctccgttattgattgactcctggtaccaacatgagccctaggtcttatagaggccataagtccctatgccttatagtgcccatggatgagatgaggccacacatgcccccagtgggttaacatgtctagcgtgggtaaggctcttggagcactatgatacacaggaaatgcccagtaactcttagttggtttgatatctgttcccattgctcacttaagctcagtgcccctttactgatccttttattctgcctccctctgcacatgtgcattgagactcctatctgagacacacactgtgttgggtgcccagggatgcagcatagatgttgctgccttccacagaagcgctcatggtctgctagagaatatatcccatgggagagaaaaacagactcgggagaatatagcaggggcccttgtcctggactttggcagttaggaaagggagggaagagacatggaggctgggacccaaaggctaaataggaatttgctgggccaaaggggagggggaatgaaaagagtgtttctggcagaggaaatggcaaggataaaggcctggaggcgcaagagaatatgtgtttgaggatctgaaagttgagtgcagtgggtccagtgttctctaccctggctgccattagaattacctgggaaacttttagaaaattccagtgtctgggccctccctaaaacaataaatcattcttgggtggtggggtctgggcatcaggattgtttaaaaccctccccaggtactgtcatgtgcagctggggttaagctgtgctggggtctgagtatggatctgttagggcaagtggcggtgatggagttgaggctgcagaattcaggccaaatagagaggttttcatcaggatattaaagagtttagatttcaatttggtgggaatggatgggatcttatttgcattttatgaagagctccctggttgcaatatcagaatggattggagaggagcaagatggaagcctacagtgatttgggagaagtggtgagggacttgagacacaggaagtagccccattcactaatagttgagtatgtagatttgctaggacctggaaatggtttggctggtggggagtgggaagaaaggcccaaagtgtgaaatgaagatggagagcacattgcctagcccagagtgattgccatttgctctgtcccagttgaggtccaaggggttggccagagatcatggagtctgtggctccatggggagaagaacctctcagcatgcctccttgtcttatcctgggttagtcagattcattttgttagattacattttttttccagtggaactctgcttaagtcctgaccagtatgttttcagaaggatcagagggcctgcccttgtccattggtgcatgacaccagcttggtgggttccttgctgctccctgttttcatagggttatcagaataccttctctccctgccaccagcaggtcacactggctcctgactttttggcccatggaaccaccatctttctgcttcttagattgtgccttgtactccactgatcatggccagtacatcagaagccctggtttgcagtgaatgcatttgatatggaaatcaggaaccctggggataccactcatcatatttggttgctgtgtttttcctccaatctttcaccataacaacaatcaactcaaaagatttctataaccacttgtgtgggggtttctccccacacactaaacaagcagtcagttccagagtggacagcagctggtctcctccaatttaattccaacactgtctacttggagatagcattagatcccacaggttgagggtgcagtcccctagactgcccccagtctcctgcttcagacaccagtcacaagtccaggactctagaagttctgaccagtttcaagttggggttcccacaaccccccactttatttttgattaatttgctggagtggctcatagaactcagggaaacacttagttttctggacttattacaaagatttaaaaagataccaataaatagccaaataaagagatatacagggctagatctggaagggtctggagcgcaggagcttctgtccccatctacttggctcccagcagatggatgagttcttattcattttcttgtcagcttcgacatgttcagctctctggaagcccgcaaactcttgtcttcttgggccttttatggagacgtcgttaggcaggcatgattgaaacatggacaactgtgtcgaaatatgattggacataaaggggtctaaactcagtgaggcctgtttgttcagattcttcttggcctctctgtggccattctttcctccaggatatggggcaggacccctatggaatgagggtcttatgacccacaatcaaattagagtcctgccttgggcaagtgaaaggaaagcaggagaaggtaagagaaattctgttgcctaagaccttctgaggcctaaagcaccccaacattataacagaagacgataacaggactatgggagttatgagctgggaaccttggacaaaaatatatacatattaaataaatattaagtgtatatatatacttacgtatattaagtgtatgtgtgtgtgtgtatatatatatttttttaatttactggttggttttgggaagcagaaattaccataactactcttaaaaatcttttaagtctctttgaagttagaaaagtcactgtacctttttgtttccattggccctgtacttcttattataccccagcaggaggagcataatgtgttgttatatcattctggtgataagattcataagtgggttcagctggtgacagcctgattccctcattgtaaacttatccatcaacatgtagcttaatcgtttcaccttttgtgatgaccattacctgaatcagttatttcattagattgcaagattatgcttttctgattttatcatttcttctgtattgactgtaattctttggtatagaagaactttcccttgttaatagctatttggttgtcctgaagtacagttcttactagaaagtaagaccaaatgctgaattatatccctctagctatcaattttcgaaggaatgaatggtgtcctagtaatttccagtggtgtttaattacgttttcccttctctttctccttctcttattccctccctctccatctcctccctcctcactttcagttttttgctctttcagtattttgtcatagctgttaacagagcaacatattttaatcaattgtagtcatttttctttttggtgctcaaattatcccgtcttagtcccatggaagcaagcccttggagctagggccctctaccttttgatggatttccatttgtcttgataatttccttgtttctgacaagacaagatgttgcaggcacattttatactttcccagcccaaaccctggaataggccttttctccgaggagctctagttcattttagtgggaaatggtatttagagactataatctgggatctgggagtcctcattgctactgagtagtcattacttttaggcttttccagtggtcagagctaggaaatatgtatatttaaaaatggacagttgaatggttgttgccaggagctgggaggaaggggaagtgagaaattgtttaatgggcacagagtttcagtttggggaagatgaaaaagttctagagatagctggtggtgatggttgcgcaacaatgtaaatgccactgagctctcatttaaaaatggttaaaatggtaaattttatatatattttaccacaataaaaaaaagtcttcttctgggagcacccccccaagacaaaaatatgaaaattttacactgatacttccatttcaagataattttaagattataaggattttgcttaattcttgaattttatacctgtaaaccttttatacttcaaatttcgggcagaattgcttctataacaatgataattatacctcatactagcttctttcttagtactgctccatttggggacctgtatatctatacttcttattctgagtctctccactatatatatatatatatatatatatttttttttttttttttttttaatacagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccaggtatggccttttgggaaaagtacagcctacctcctttattctgtaataaaactgccttctaactttggcttttcatgaatcacttgcatcttctctctgcctgacttgccctctggaatggtgctggaatggtcctgtggccttgtccactgtctgcctttgaccataacttgaaagtcacccaccatagtgtcctttgaaataacttaaatgtccacagttccaagcatgagttaaaaacacttcagaatgtagagtagttgttcaattgaataaacacacacaccagaaaaaaaagcaagtttatcttttatttttagtaaagaattttgatagagcctcaacaccagaaatggctagagagagaagcctaacatatctggaggattatttttcatcctacttaaagctgctttcacttttttcaggaaaaaacacacgttctgaatctaatttataaaactccctggccgggtgctgtggctcacacctataatcccagcactttgggaggctgaggcaggtggatcacctgaaatcaagagttcaagaccagcctgaccaacatggtgaaaccccatctctactaaaaatacaaaattagccagacgtggtggcgcatgcctgtaatccccgctactcgggaggctgagacaggagaatgacttgaacccgggaggcggaggttgcagtgagccgagatcgcgccattgcactccagcctgggcaacaagagcgaaactccgtctcaaaacaaacgaacaaacaaaaaccccaaaaatccctgaagtacgtgagctagtggtgaaagaaagctggagaaaaggagcaggaataataataataataataataataataaagattgtcatttaattttgagtacttccagtgtacactttgcaggtactctaagacattacctcactgaaatctctaaggtagatattctttatttaaagtgtacttgtatgaaacctggagctcaaggtgaaggaatttgcccaaggctgcacttgcactatcgtggcactaattagccgtgtgaactgggacacgttacttcagtttgctcatttctgagtcagcctagcaagatgacttctaagaattttttccagccgggtacattggcctgtaatcccagcacttcgagaggccaaggtggaagggtcacttgagtctaggagttacacacaacacacacacacacacacacacacacactagccaggcatggtggcaaatgcctgtagtctcagctactccggaggctcaggtggaaggatcacttgagcccaggaggttggggctgcagtgagccatgatcacgccactgcactccagcctggctgacagagtgagatcctctgtctcaaaaaaagaaaaaaaaaaagatttttttccagggaataataaaggaagctaatatttatggagcatctacggtgtgccaaatactttgcatacgttatctcatttaatgctcttatccctgcagggaaagtattaacatttgtttatcacttgcagaactaagtgatatttaccacagagtagacaaatattttcaagcccaaaatcaagtggtatcacttttctgctgagaatgtttcagtggtttcctttgctcttgggataaaacttaaatccctcaccctacccttgctccaaccctccactttccttctcccatgtggtgatttggccatacagctcttgtggctgatctgaactgactgagctttttacccttttgctcttgctgttcttacagcctgggaaccccctggttacctcttggcttggtgtggtggcttacatctgtaatcccagcactctgggaggccaaggcggacggatcacctgaggttgggagtatgagaccagcaagtcacctcttgccagtggcctttgtccattgagtctgaagttctttctcctctcatttccccatcattctattatgctaccttgttttattttcttcattgtgtttattgatacttaaaatgatctcttttctgttgctgtttgactctcccactagaaagtaagcattgtagatcgggcactgtggctcacacctgtaatcccagcactttgtggggcagaggcgggtggatcacctgaggtcaggagttcgagaccagcctggccaacacggtgaaaccccatctctactaaaaatacaaaaaatagctgggtatggtggctcgtacctgtaatcccagctactcaggaggctgagacatgagactcacttgaacctgggaggcagaggctgcagtgagctgagatcacaccacagcactccagcctggaagacatagtgagactctctctcaaaaaaaaaaaaaaaaaaaaaggaagtaagcattgtgagggcaggtaccttctctgttttgttcattgctggatgtagttagtatacagcagtatctgatggatggatagatggaggaatgaatgaatgagacttcacaaattcagctcacttgctcaaggccctgcagctctacgggatgaagctatactccagagtcctgctacattggctgtgtggccagctgctgggatctgagggttgtcagataagcagtctaccagagaacagactgatcttgttggccttctgccagcacaggggttcattcacagctctgtagaaccagcacagagaagttgcttgctcctccaaaatgcaacccacaaaatttggctaagtttaaaaacaagaataataatgatctgcacttccttttcttcattgcagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgagggtacgtaaacgctgtggcctgcctgggatgcatagggcctcaactgccaaggttttggaaatggagaaagcagtcatgttgtcagagtggccactacagttttgctgggcaagctcctcttcctttactaacccacaatagcatcagcttaaagacaatttttgattgggagaaaagggagaaaaataatctctgtttattttaattagcattaattggtattcttgttaaaccataggagtcagagtaaatcagccatttcaccaattttcagtttgtttctgtcttagctaacagcagtgtaatggtcagcaaaattcttatcttgtgtactgaatggcatgtcctgttgctgaaagtgcacaggcttgggaggtagccatgagctcaaatcctggcactaccacctctcttgtgtgaccttagactcctgacctttctatgcctcagttctttcttacctataaaatgaaattaattttacccttaaagatcatcgtgctgattagagataaaatataaataataacacttgttacagagcaaggagttgacacttttatattctgaagacaaagtggtaaatcattatcatctatgtcagaaatagcttttgagaatacctgagtatagaactatcttgatccctgttacttcaaaactaaaataatggttttaggaattaaaaggtgaggctagtcacctccaagggatgaactgactcagggattgaggtatataacagtgaactggtccaaacaacagtcctgaccccactttatgagtgagactatgagtaatggtctaagtgtagacatcattgtccagggctccagtaggcagctctgtacttgagaatttagcagtgacccttctatttttcatctattatacctttttttttttttttttttgacacagggtctcactttgtcacccagctggagtgtggtggtgcaatcatggcccactgcagcctcaacctccctgggcttaggtgatcctcccacctcagcttcctgagtagctgtaattacaggcatgtgccatcatgcccagctaatttttcttttcttagaggtggggttttgccatgtttcccaggctggtcttgaactcctaggctctcacctctgtcttccaaagtgctgggattacaggtgtgagccaccacacctggcctattacacatttcttaattaaagtagtcaaatttgaaaactgttacaaagtgtatcttaaaatacgacgatctggtttaatttttaaaagatatgagtagccaaggagcaattctgtgcctttcccactagtccctaaccttttaaagcagctgcttcttggctgggctcagtggttcacccctgtaatcccagcactttgggaggccaaggcgggtggatcatgagtcgagatcatcctggctaacacagtgaaaccctgtctctactaaaaatagaaaaaaatagctgggcggggtggcggatgcctatagtcccagctactcgggaggctgaggcaggagaatggcatgaacacgggaggcagaggttgcagtgagtcgagattgtggcactgcactccagcctgggcgacagagcgagactccatctcaaaaggaaaaaaaaaaaaaaaacccatctgcttttgattcagtggcttctttaattttgtcggtctcagtcaccatttgtctaagcaaattcaggcaggcttcaccttgcctttctacatttgttcccttttcttagcattttgggcctttgtttacacgtgggaaaagacccacaggtcgtctctccctttgggcaggatacaggcttcctgtgactgaggttttgctagctgtagaagtggctgccaattggcttctggtttttatttccatgatttgctccagtggctcttcccttccatcattgttagctttcaagctaggaacttttaaaatgcttttaaataaaagtgagctgttacttgatgcatttagcagtcttcctcacagtggttttgatagacagactccctcagtttggaatttatgagttttctttaagggtttgtctccctcatgtatagcaggctgttgaaagttacaatgtcaataactttctgaatagtatcaaactgttttcagtgcagtgtattaacaaaactaacctgcctcaagtttggtcagctttggagtcttactgaggctaaaatgataaatctaaatgatttaaaattgtgtattcctacacagtatctcacttaattatgtaatagtcttgtgagtgaggcagagcagatgccgttttctctattttaaagatgaggaaaatggaatggaaaatggaaaggacagactaattgcaacatcctcgcaatcaaaaacaggcccaggttcatgccttgttggcagtgggttgctactggctgtggccttcatgcaggaaggctagatgcataaccaggtcaacagcccgtgcaggacaagcacgccatgtaattctgattccatcgactgaggctggtgttttcaaacgtgctggtgtagggtcttacagacagagtcatctgtgctatggggaatggaatgtgctcttgctttggagccagaactcctctgaagctcccaccacctacaccattcagaggccagacagaaatttgttcaccattttgggcatgattttcgtgcttttgtaaaatgtgcttcactgcagcccttactgggctgtggtgatgaacacttaagatactgtgtgtgtgctttataatctgtaaggcactgttcaaggggagggacctctgccatgagcccctacccactggtatctggttgacatccaaagccccagcctgggagaagctgattctctagttgaatgctgtatagggatttgactgaggctcagatttggtgaggaagaccactaaccttaacagaccaacaggctggctactccctgatgaagttccccaggccatgaaagaagtaagagatacattccttgtaacagctttcttagttgcacctgtatgattatttgatcagtgtgttgtctgtgcagggatcatgtctgtggagctcaccacctcgtcctcggtgctgagcagagtgcctggcatgtgtactcagtagatatttgctaagggagcgagtcagtgattgagaggagcagcctgggaggtaaagccctagaatctttattttaaagggatatcaaagttgaacattcagttagacagttctcttgagtccagggatttacccatccatggtggacacactttcagttaaaaagtaaggttaattttgacaggttgcagtatccaggcaagcattctatggaataaggctcatctcagggattagtaatgactgaattaacttactgctagtcccataattttgacgttaattaatggggttaagaaatgtcataagctatttggtaccatttaaagtgaaaatacccttaacgttttttgcctccagatatccacacttaatttcattttcttgctctttggtgaacagtcctgggtctgaatgtatatatccatggtttgtcactaggtgacaggtttttttggaacaagaaatcagttcagtgaacatttgtcaagtatcttctctgtaaaaagtgtaatgtgccaagctcagaagtaggaagtgaaatggataaactatgacccctgccttaaagaacaccatggtgttgtatgggaattgtttaggtagaatgaaagaaatcctctaatagagatatgaggccagttcagcagaaagccagggtgagatctcctgagagggatggaagggtgtcttgatcatctctggtagcagcaaaggcactggcatacagtggccactggaagacaaccagcaggggatgggggcgtttacccttgcaagtgagcattaggaactagaggactgattgccctttcttcagctttggtttcccttgctgcagaaaaagatgctgagactcatggcctcggttatgaactcagatatgtggtttggctttgaagcacagatggattttgtccgattttggcagggaaatgcctacagacagcactatgggcatatttaggttagggacgaaatgcaagttgattaagtcctgataagaggctgtgaagaggtccaagaagcctcacaatgcccaatgaagaaaagccctgtgcttggtgctgccgcctcccttccccgtcctgctggcagggctgcgcttcagtagctctggatgcgtcagagcagtccatgaacattctgtgtggaaaatctctgactgttttagtggattacactgctctccctttcctccagtgcctcgttattcagtattatttgatgttctccagcttttaaaataatcattttccgcctacgcagaacatcctgtagagacgttgaggttccagtgggaacagagaggaatacttattctaaaaatgaagaaaataaacctttttttatggagtgggtgatagtattgcagaacttctataatagtatgagaattcacttgtggtgccaaagcttaaaaaaaaagtatagtaaaaacataatgtataggcttattgctgtgctatgacccatgccccgttttctccaacctctcttgtcctcactcttcctttttgctggtgatatttttacttatttcatgaaaaaaaagataacatatacacacacatagatatatgcacaagtatatgtatatatgtgtgcataacacacataaacatatacattggtaaatttaaaaacatatttatgaaatatatgtagcatctacagaaaaacatgaacacttgtgagaatagcatctgcctaaaaaataggacatcaccatcacctttgaggctcttatgtgctgctcccctgtgccattcccttcccttcttccttagaggtgattactattctaaattttgggattattatttcctttttttattatagtgttttaattacagttttattacctgtatttgtattcctaaaaatttgtttacttttgcaagctttagattttataaaagtagaattacactgtaagtttaatttttctgtaatttatatatagctacacatatattcctaagattcatccatcttgttacatatagctctggtttaccttttctgtataatatagattctgcttcgtgaatttacagttcattcattcttctgttaaaggacagttggaggactcatatggcctcagtctctgtgtccccacatgccaccctgcttcccagcctcatatgagttgattggtggcctggcatactggatgagaagctctaggtcatatatttaagagagttattgctgggtcataaaatgacagattgttttccagaggggtcatattgatttaaattatcaccaacaattatattgtcagatttttaccagtttggtgattgtgaaacagtgtctgatggtagtttttatttgcattttcttggttgaaataaagttgtgtatttcagccaggtgcgttggctcatgcctataatcccagcactttaggaggccaaggtgggcagatcacttgaggccaggagttcaagaccagcccagccaacgtggcaaaaccccatctctactaaaaatacaaaaattagatgggtatggtgtcacatgcctgtaatcccagctactcaggaggctgaggcacaagacttacttgaacccgggagatagatgttgcagtgagccgagattgtaccactgcactccagcctgggcaacagagcaataactaaataaataagtaatcaattaataaataagtatatttcctcagctgttaagtacctgttcaagttttttacccaatatttgatgggctctttttttgtcttttctaattaatttttggagtttttgatatattctagatagtaatgagttacatgaaaatatccctagtttagggatcctctagtaactttttaaaatgaatacttgttttaggaacagaaattcttagatttaatgtaggcagattttatcaattgttctttacagattggctttgtagcttaagaaatccttcctaactttgcaataattaaagatatgctcttagattgtttcctaaaagactgatacttaagcctctagcccacctggaattgattttcacagatactacattttttactagttatagattggccccttcgtagagcaagtccgatagctgccatttttatggcagcatgtgctcacttagtgtctctgtcaaattttggtaattctcacaatatttccaactttttcattattactatatctgttatggtgatctgtgatcactgatctttggcattactattgtaattgtttggggcaccattaagctcactgtcttatgtgggcataaaccatgcccacataagacagtgagcttaattaataaatgtgtgtgctcagacccctccactgactgggtgttcacatgtcttccttactctcctcaggcctccttattccttgagacgcaataatatggaaactaggcaaattaataaccccacagcgtccacaagtgtttaagtgaaaggaagaggctgggcgcaatggctcacatttgagctcacaaatgagcccatgctcatttgccattccaaaaatcccagggcccttaagaattatgctaactctactctgcctctgctctataaatggaacaacaaagcctagatgacagcacatctttttagaacatgatttactgaatattttaagcccattgtggagacctactgctcagaaaaaaagattcctttcaaaagcctgtaatcccagcactttgggaggccaatgcaggtcgatcacctgaggtcaagagttcgagaccagcctggccaacatggtgaaacacgtctttattaaaaatacaaaaattagccaggcctggtggtagatgcctgtagtcctggctattcaggaggctgaggcatgagaatcacctgaacccaggaggtggaggttgcagtgagccgatatcatgccattgcactccagcctgggcaccagagtgagactacgtctcaaaaacaaaacaaaaaaaaaaaactgaaaggaagagcttaatgagaaaggcatattaaaagccagtataggttgaaagctaggcctcttgtgcaagttagccaagttatacatgaatggtaaagcaaaacagctttattgctgtaataaagaaagttttagtggtctggatagaagatcaaatcagtcacagcattcccttaagccaaagcctaatccagggtaaagccctaacttgcttcaattctttgaagactgagaggggtgaggaagctacagaagaaaacttggaagccagcagagattgatgaggtttaagggaagaagccacaagtgctgatgtagaagctgtagcaagttatccaaaagatctaattgatgaaggtggcttacactaaacaacagattttcaatgtagacaaaacaatcttctattagaaggtgtcatctatgacttacatagttaaagaggaaaagtcactgcctggcttcaaagcttcaaaagacaggttgactctaataggtactaatgcatctggtgactttaagttgaagccagtgctcatttgctattccaaaaatcccagggcccttaagaattatgctaactctactctgcctgtgctctataaatggaacaacaaagcctagatgacagcatctttttagaacatgatttactgaatattttaagcccattgttgagacctactgttcagaaaaaaagattcctttcaaaatattactgctcattaacaatgtacctggccaccctagatctgtaatggagatatataaggacatgaacactaacacagcatccattctgcaacccatggatcaaggagtgatactgactttcaagtcttatttaagaaatacatttcatagggctctagctgccatagatagtgattcttctgatggatctgagccaagtaaattgaaaacctctggaaagaattcatcattttagatgtcctgagaaacattcgagattcctgggaagaagtcaaaatatcaacattaacaggagtttggaagaaattgcatccagccctcatggataactttgaggggttcaagacttcagtggaggaagtagctgcagatgtggtggaaatcacaagaaaattagaattagaagtggagcctgaggatatgactgaattgctgcaatcccatgataaaatttgaacagatgaggagttgcttcttatggatgagcatagaaagtagtttcttgagaaagaacttaattctggtgaagatgctgttaatattgttgaaatggcaacaaaggatttagaatattatataaacttggtaaagcagcagcagggtttgagtggattgacactagttttggaagaatttctactgtgagtaaaatgctatcaaacaacatgacaagctacagagaaatctttcatgaaaggaaaaatcaattgatgcagcaaacttcactgttgtcttatttcaagaaattgcaacagcttcctcagccttcagcaatcaccaccctgatcagtcaacagccatcatcagggctagatcctccaccagcaaaaagataacaattcgccgacagctcagatgactgttaccattttttagcaaaaacctttttaattttatttatttatttattggagacagagattcactctgtcgcccaggctggagtgcagtggcacaatctcagctcactgcaaccaccacctcccaggttcaagtgactcttgtgcctcagcctcccaagtagctgggattataagcatgtgccaccacgcctggccaatttttgtatttttagtagaggcaggattttactatgttggccaggcttgtctcgaactcatgatctctggtgatctgcccacctcgggttcccaaagtgctggtattattggcatgagccactgcgcccggccagcaaaaaagtgtttttaaattaagctacctacgttgattttagacataatgctatttgcacacttaatagattacagtgtggtgtaaacataagttttatatgcactgaaaaacaaaaaatttcacatgacttgctttattgtgatattgactttattcctgtagtctggaactgaacctgcaatatctcagaggtatgcctgtatctacttgttctgtgatacttgttattgtcagtttgtttggatttaccacatattatttgatcataattctttcctgtagatgttttatggtctgcctaaacctttagtggggcctttgatggcttagtcctttcaggcttaagacaatagaagtttatttctcagagttctaaaagctgggaagtccaagatcaaggcaccgacagatttagtgtctagtgaaggcccgcttcctcatacatggcaccttctagctgtatccttacatagtggaagggaatagctagctctctggagtttctttcataagggctaatcccactaatcccaattatgagggaagacctaatcacctcccaaaggccccacctcctaatagtatcaccttgggggttaggatttaacatatgaattttgtggggacacagacattcaaacaatagccatggcaaacttttttgctttgtctaattcactcttattttgaaaagtatttgtgttgggtttaaaactccagattggtaattattttttcttagtgcattgaaggtaatagtgtatcattttctgatttctactcttgctcttgaaaattcagctatcaatcttaaaatttattacctgttgaaaatccagctaccagtcttatattttatttacttagtgggtaatctctcttctgagtacctttaagatctcctttcagaaataccatgtagtaaccctgtgtgtcacgtgtggattttgttgggcttgctagctgagacttgacagttttcatcacttctgggatattctcaggtattttgtcttcaaagtcttcagatattgtcctcttcctgccctctctccgactccttctggaacatgagttatgtatttattatctcccatgtgcataagttatctttacatattttcaatttctttatctttctgtgctacattctggataattttgttgatctaccttccagttaattagcttgttaactttgtcaaatctctttttaagtctatcttgatttttcttttcaattattgtatttttcatttttaaaaactttatgtgctcttttggaaatcttgatcccaggagatagtggatagtgtcctgctgcttactcatggttttaatagttcttgagcatgctgaacatacttattttatgttatttgctaatctttccaattcctgaaacctttacagatctcattctgtggattcttctggattctaattcatggggcattttttttgttttttgttaattcctcatactttatctgtggggaattacttgaagcctgggttgacaatgaaattctgcagagagaatttgcatttgattctactggaggaacagtcagccccgatatcagtttaaattaaaatctctgcttaaggttttcaggcaacctgcttagcatgaatcctggctggaaaagcatgtgaggaccagtttatgattacacattcacagggtgtcatgttttcttccaacaccaatgctagaggtggcagttttgcttactgcccttggagggacaggggagtgggcatgggcatagtagtatggttttccttttcactgggggtgcagcccttggagtctcagcttaatgtgttggggaagtggtctcctattagactctccatttcaaaccattccatgattttgtcctccttttgccaccttccgagcctgtaaaaactaatgtttgtgattcctgaggtttctctaatgtcttttaataaagttgacctcagagatctcgttacctctctgagttcctgctttgtcttagattttgatccttgagtgttctttaatcttttagcaattccttgttgcatgttaaaagattagttatattttattcctcatttgtgttcgttttcaccaggaggctcaattcaggcttctttgcttacttggtgtctctagttctggtgcctggtgctttggtcaatgaagtggggttggtaggattctattacttacctgttttttggttttattttttgttttgcagttctccgggagatgttgcataaccactccttcgtgggctgtgtgaatcctcagtgggccttggcacagcatcaaaccaagttataccttctcaacaccaccaagcttaggtaaatcagctgagtgtgtgaacaagcagagctactacaacaatggtccagggagcacaggcacaaaagctaaggagagcagcatgaggtagttgggagggcacaggctttggagtcagacacatgtggtttcaaatccaagttcgaccatttcccatttatttgactgtagacaagttacattcctaaactatgtctcagatttctcatctgtaagttgtggtattactagttaacatgcaggggttttgtttgtttgtttgtttgtttgtttgtgagggtaagaaataacccaagaagcctagtccttggtagttgctcagtgccctataaatgttgtgaaccaggtggtgagggtttggtgctgctagagaattctggtatctgctctgtgcaacagagtactgtaggtgatgcaagagaaagaagacctgatgccttctttcctcccagctttgagaatggagcaaaggcctaccccagccaccaagtgagccagtgggcttgatcagcacaggaaaggtgaccccggcagtttcatttgactattgcatggctggcaacatttctattgattgtttccagggaccttggcggatgagctcctgttgagtctagcatctctgttaaatctgttctcaaataggtaatgcatatgggaggatgctgccaccttgcatctactagacatcacctatctactgtgagactctccctctaagccctgctgtggcctcagagtgcttattggccctgtgagtggggcagccactatacattgcatggagttggtacatgagatagaaacctattcgccatcccttgaaactgccccagtccagaagcttcctgttagcacatgtacctccttgtatgtattcagaactcattccatttaggcttggaaacccgtttggtgcaactctgttcaagttccattgtctgctttgagaatgcttgggcttgtatagtgagctgtcactttttaatttgttaggaattctactcgccttgctttttcttttccagcatgtttaagggaatgacctccaaggccccaaatcacagttgtattcatgttctttcatttcacagatacaatccaggccagtcccagatttgcagctgttaataaatgtgaatggttttccagtaagggggtagaaaaacatagggagagaaccgggttcagagttcaatatctggattcaagtccttcctttagcactttactaactgatgtagaataagtcagctactcaataggtgcctcagtttccccaccaaaatgcagacatagaaggtgctttgtctgctttgatgagaagtctttaagcaagtctatggggttcaatgtgttttaagaactataaagtaccatataaatgtggcctttattcccattgtgttcttggaagtaattcaatatagtgtgtacttcatagctgcttttggactattgccagccagtgtatcatcctaaactacatgtcagcatagtataatcctgccttaggtctacttttgattatttaggaagactccctgcccttcctatacatttcacataatttttaataagttgtaaaaaagtgatttataggattctttgtaagtgggggaagttaagcagacaaaaagtttttaaatcttactgcagagtgtcaggaaccttttatagcaccagacaggtagggacagaacatgagtggcagcaagccagacttggtcttagtgctctaacctgtctgttagaggctggccagtcagacccctggttgaagacgttgggaatcccagctctttggaggggtaagagattttgttagactgttaaccagattccacagccaggcagaactatttctgtctcatccatgtttcagggattacttctcccattttgtcccaactggttgtatctcaagcatgaattcagcttttccttaaagtcacttcatttttattttcagtgaagaactgttctaccagatactcatttatgattttgccaattttggtgttctcaggttatcggtaagtttagatccttttcacttctgaaatttcaactgatcgtttctgaaaatagtagctctccactaatatcttatttgtagtatgttaaatttttctaaaacttctaaggatagttgctgtattgtatgatttgcatatggaggtatctataagaagttttatactttttagcaaaatagtcatttggtagccaacttaaacaaatgtttattaatatagaagttaataatatctactgatactcggccgggtgcggtggctcatgcctgtaatcccaccactttgggaggctgaggcgggcagatcatttgaggtcaggagttcaagaccagcctgaccaatatgatgaaaccctgtctctactaaattacaaatattagcagggtatggtggtgggcgcctgtaatcccagctactcaggaggctaaggcaggagaatcatttgaacccaggaggcagaggttgcaatgagctgagatcacgccactgcactccagcctgggcaacagagcaagattccctcaaaaaaataaatatctactgacacttaatacttggaaagggataaaaataaacattgtctaaagccgtggtccaaacacaacccctgccaacaattttagtccatttcttccaagacttttttttttctatgccttttgtgaaaactgtcaaaaactttttcaatgctgaattttagttctgagttaaaaatcatactacctgtttatatggtttcatatccacttttttcatgtgatatactctacaaaaagcctgctgagattttgattgggattatgttgaatctagatcaatttagggtgaaaaacttttgttagataaatcccttagtatttcacatttttaaatgctaaatggcatttttcaaaaattttcttttttcttttcttttttgagacagagtcttgctctgttgcccaggctggagtgcaatggcaaaatcttggttcactgcaacctccgcctcctgggttcaagcgattctcaaactgcctcagcctcccaagtagctgggattacaggcatgtgccaccatgcccggctaattttttaaactatttatagtagagagggggtttcaccatgttggccaggctggtcttgaactcctgacctcaggtgatctgcccaccttggcttcccaaagtgctgggattacaggtgtgagccactgcacctggcctcaaattttttttttttttttttttaagagacaggggtctcactcttgcctaggctggagtgcagtggcgtgatcataggtcactgaagctttgaactcctaggctcaagtagctaggaatacaagtgtgtaccactacacctggctaatttttttaaaaaaatttttttcgtagaaacgggagtcttgtgttaccaaggctaatctcaaactcatggcctcaagtgatactcttgcctcagcctcccagagtgctaggattgtaggcatgagttacttcacccagccaaaaaacttcaatttcctattgtttatttgctagtatatagaaatacatatagttttgtaccttgatgctgtatcttgcaaccttgttaaactcacttactagttctagtatattttttgtagattctatcagattttctatatatgtatcatgtcttctgagaataaagaaacttttacttcttgctgtgcaaactgaacaccttttctttctttctttctttttttaagacggagttttgctcttgtcacccaggctggagtgcagtggctggatctcggcttactgcaacctccacctcctgggttcaggcaattctcctgcctcagcctcctgagtagctgggattacaggcgctcgccaccacgcccggctaatttttttgtatttttagtagagatggggtttcaccatgtggccgagctggtcttgaactcctgacctcaggtaatctgcttgtctcggcctcccaaagtgctgggattacaggcgtgaattactgcgcccggctgccttttatttctttctcttgactgactgcactggctagagcctccaatacaatgttgaatagaagtggtaagaatgggccaggcatggtggctcatgcctctaatcctagcactttgggagagtatggtgggcaggttacttgaggccaggagtttgagatcagcctggcgaacatggtgaaactctgtctctattaaaaatacaaaatatagttgggtgtggcagttcacgtctgtaatcccagctacttgggtggctgaggcatgagaatcacttgaacccaggaggcggaggttgcagtgagccaagaatgcaccactgcactccagcctgggcaacacacacacacacgaaaaacgaagtggtaaggatggaaatccttctcttcttcctgatctaagggggaaaggggaaagttacaaaacattcagtatgctgttagccatataggtttttttgtagatgcccattatgaggttgaggaagttccctctgttccttatttgctacagattttatttaggattggatgttgaatttttttcaaatgctttttttgcatctactgagataatcatatgatttttcttttatagtttgttaatatagtgaattacattgattttcttatgttaaaccaatctttgcattcctgggatgaactctgcttggttataatatataatcctttttatttattatgggatttgatttgctaaaatttttattataattattttatctgtgctcatgattgttactagtttatagttttcttttagtctttggtttttgtatcagggtaatgctggcctcatagaatgagttggtaagtatcccctccttttccattttctgaaagagttttgtgtagaattgatgttaaaattattgcttaatgtttggcagaactcaacagtgaagccatctgggcttggagattttcttcatgggaaggtttttaactgcaaattctatttctttaatagtatagagctattcaggttatctgtttcttcttaggtaagctttggtattttgtttctttgaagaaatttgtcgcatttaatctaaatttttaaatttactgacataaagttatttataatatttcttattcttttattatctatggatctcttggtgacataacctctctcattcctaatattggtaatttcaggcttttctttttaacttggtcagtctggctagaggtttatcaattttattgatcttctcaaagaactaacttttggtttcatagatttttctattttctatttcattgatatctgctctgacttttaatctttcttatacctattttggtttaatttgtcttctgtttcacatttctttttttttttttttttttttttttgagacagagtcttgctctgtcgcccaggctggagtgcagtacagtggtgcgatcttggctcactgtaacctcagccttccaggttcaagcgattcctgtttctaagcctcccaagtagctgagattacaggcatgcaccaccagctaatttttgtatttttagtagagatggggtttcactgtgttggccaggctggtctcaaactcctgacctcaggtgatccacctgccttggcctcccagagtgctgggattacaggtgtgagccactgtggctggcctgtttcacatttcttaaggtagaagctgaggtcacggatttgagacctttcttcttttctaatacaggtgttaagtgctacaaatatcccttaagcactgcttcaacagcatcccacaaattttgatagtttgttttcattttcattcagttcaaaataccttctaatttcccttttgatttcgtctttgacctacaggttttttagaactgtgttatttagtttccaatctcttgaggatttttaaaacaatatgttattgatttctaatttatttccatctcagtcaaagaacatacttgcctttttttatacatttattgaaactttttttatggcccagaatatggtctgtgttggtaaatgttccatgtgtacttgaaaataatttgtattctgatctcattgagttgaatgttctaggtatatcaagttgatagtgatgcccaagtctcctgtatctttactgattttctgcctgttctgttattgagaaaggggtattgaaacttccaactataattatgatttgtctgttctctttgcagttctcttagtttttgccttcatatatatatacatatatatgtatatatatatatatttttttttttttgagatggagtcttgctctgttgcccaggctggagtgcagtggtgtgatcttggctcactgcaagctccgcctcccaggttcacgccattctcctgcctcagcctcccgaatagctgggactacaggcgcccaccaccacgcccagctaattttttgtatttttagtagagacagggtttcaccatgttagcaaggatggtctcgatctgacctcgtgatccgcccagcttagcctcccaaagtgctgggattacaggcatgagccactgcacccagcccatatattttaaagctctgttattgggtacataaacatttaggattgttatatccttttgataatggactcttctattatgaaaagataatatactgtgggtttataacatatgtaaaagtatgagtaacatattatcagaaggggagaaatggaagataacttaggcatcttatttttaagcatagttttccctttgtttctgcattagatgatttacctgaaatgtcattcaatttaacttactctccatcctcacccgcccagctttggttatgaggcagtagaaagaaatgatctgcctgtggttttctagaaatacgaaagttgagtccttaaggctacacagaaagaaagtacctccccagggcttcacccttcccatcctttcagcaggctttttgtctgtcgtatcttctctgttgaaatggccattgacaagaggaggaaaggggttttgttgtggattgttcaggcacttcctttggggtatatgggggatgagtgttacatttatggtttctcacctgccattctgatagtggattcttgggaattcaggcttcatttggatgctccgttaaagcttgctccttcatgttcttgcttcttcctaggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggtgtgacagccattcttatacttctgttgtattcttcaaataaaatttccagccgggtgcggtggctcatggctgtaatcccagcactttgggaggctgaggtgggcagataacttggggtcaggagttcaaaaccagctggccaacatgatgaaaccccgtctctactaaaaaaatagaaaaattagccaggcgtggtggcgggtacctgtaatccaagctgctcaggaggctgaggcagaagaatcacttaaacccaagaggtagaagttgcagtgagccgagattgcaccactgcactctagcctaggcgacagcgagactgcgtctcaaaaaaaaaaaaaaagaacgttccaaggtcaggactaggcctcccctcagaagcagcaagtgacatatgtgacatcctctccactccctatttgcatttctaggttatataactgtactactatccatgcatgcctactcttgttcccagggtgaaggacccagacatggagagccgaatccctgcaggccattataaatgagattatgccatttgctcccatttcttcttattctttcatttttggggctctccatcttgatgtgttctttggatcgtgaacagatccaaagaaaaggttgttctgccgtgctgtttgtcaggatgaaaaactcttttttaagtgtttaggtctgcccccagtgcccagcccaatcaagtaacgtggtcacccagagtggcagataggagcacaaggcctgggaaagcactggagaaatgggatttgtttaaactatgacagcattatttcttgttcccttgtcctttttcctgcaagcaggaagggaacctgattggattaccccttctgattgacaactatgtgccccctttggagggactgcctatcttcattcttcgactagccactgaggtcagtgatcaagcagatactaagcatttcggtacatgcatgtgtgctggagggaaagggcaaatgaccaccctttgatctggaatgataaagatgataagggtgggatagctgaaggcctgctctcatccccactaatattcattcccagcaatattcagcagtcccatttacagttttaacgcctaaagtatcacatttcgttttttagctttaagtagtctgtgatctccgtttagaatgagaatgtttaaattcgtacctattttgaggtattgaatttctttggaccaggtgaattgggacgaagaaaaggaatgttttgaaagcctcagtaaagaatgcgctatgttctattccatccggaagcagtacatatctgaggagtcgaccctctcaggccagcaggtacagtggtgatgcacactggcaccccaggactaggacaggacctcatacaatctttaggagatgaaacttgcccatctctaaaatttcgggatttctttgtacccaacaaggttcaaacacaacagtcagcttttattcatgatttttacttccatctgctgatgtagaacatacctccagagtgacctcagaaattgtcaaatgtgaaaacacaagccatcacagtgagaaatgggaggttgagttagattgtctaaggctggagagtccatatactcccactgttagctctgaagtgtgtagccagtcttcagattctgggtcagttgcctcagtctctcttagcttttgccttactctttatccgaccactgccctgccaggaaaacaaggctctataactcctcttacaggtcagcttgacacaaaaagggtgcctggattcctaatgtttcattgtcacttttcccagtcagatgataatgcttttcaaatcaacatatattttgggggaggttggaagggagagttgaaatattctaagaatcaaagagtagcccactttaatcagagtatgacccctgattgctcacagtcatctcctgagcagtgtgagcgagtttcagatgaggaggctgaaggccagtcaggcatgctcgaggattccaagtctgtaggtgggagggcagagatttagtcctgttggccaaagcctctagggaatttctcactccagtggagaaggcaacacacttaccaaactgtgtggaaactatctcatttgattagaaattttacctcaagaagaggaaggacagttgagaaagaacattttcttacacatgagacagctaaggcttacaagaaggagaggaataatgaggcaaaataatcctcattaatattttcattcctcccctggggattagaactactttcagacccgattttaatggtaagttaggtacttcctacagttgccatccaaatatcagtcaggatcagacatgatgttagctcctgctacaataaaaccattttctccctgaatgaaaacaaaggttccacaggagacagtcccacagagcagtggcttcttttcctccctttaaaacctcatgttggctggacacagtggctcacacctgtaatcccagcattttaggaggctgaggtgggaagatggcttaagcccaggagtttgaggctgtagagctatgatcacaccactgcccttcagcctgggtgacagagcaagaccttgtctctaaataaacaaacaaacaaaaaatcctcttgtgttcaggcctgtgggatcccctgagaggctagcccacaagatccacttcaaaagccctagataacaccaagtctttccagacccagtgcacatcccatcagccaggacaccagtgtatgttgggatgcaaacagggaggcttatgacatctaatgtgttttccagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataa

SEQ ID NO: 36186 - DNA, 67598 bp, Homo sapiens
gcgcaggcgctgtgagaggcggtagcggcggcggcggcggtggtatcggcggcagctgtgagggggttccgggaagatggtgctgatcaaggaattgtgagtgggtctgtgggcgcgagcgaggccgtgggacggcagtgatgggagatttgttgatggagaagtggtaggatattcctaaatcggagtcagccctgtgtcagcccctccctgcgggcgccccctccctcccccggccccttcgaagcccctcagcgagtgcgcccctcggccctccaggcattgccgtggtaacacgccctctcccttccccggggcgaaggcggctgggtcccggcccgagcgcatggctcgggaaggcgcggccgggagtttccgctgggacccgccttctccccaaccccccacccccaggctgggtctgggcccacccccaggcccgccggtgggaaggagccgcagtccgagggtgggagagacacgttggttctgactgtgatttgtcgtccggggtggagtcccctggtaaccagcgggagatgggcttgccggttgaaggcagccctcgtgtcaggactcgcggtgggacgctggcgccttgaagttcgtggtggagccgggattccggaaagcctccgctctcctgggcagctccgctgacttgacgggagagccttttctctttttggtttccgcatgttttaagatgaggtgacatcccgggccccacctactttcttagaagttaacacgtgctctgtcaaatggagggatttcgaggtgcatccgactggccaagtgattttgttgaaaagtcacggcttttcctactggcaaggactgtaaacattacggaaatctgcttgcctctgaatgttcgtctgtcacagctggttcgtgtcgtcagcatcctttgggcagctagggaggtcgagtatggcccattcgttggttttcaaattcttcattttaaattcttagaaatatttttggcttaatttagcttttttcagacaccttatttttagtgttcttaaacctcctttaaaaagtcactgatgcacttctctgagacttaatacctcccaaagactccctgtctcacccagaataaaagtcaaagcctctgcaacagctacaaggctttacacttttttttcctgccctgatctcatttactaccttttccttgcccattccatcttcgcaagcttccttgctgttcctctgctactctagaataagttcagttcaagacctttccacctgcttttgttccctttgcttgaagtgttcttcccttggcacactaactcaccttcttccaggtctttgctcagacgtcaccttctcagggaatccctttctgaagacctaattgtagttcccactatttggggtggtatttgtcttccctgctttatcggtctccatagtacttatcaccatccaacatgccaatacaatttattattattatttttctcctactagttgtgttctctttttacatgtaagggccatgagtttgttttgctcactctcatatccccagtttttagaatagtccctcgcatgtaataggtgctcagtaaatatttgttaatgaattgatgaaaaatgataactttggtcagtgacagggattttgagaagagacattttgcctttttttggtagagtgaaaattctcaattaaagcttatttatagtactgaatattgggtttatataaaacttttcttccaagtcgtttatacagtgtatcaaacaagtgttcattactctgacttctagatgatgtgggtagatgggtggcagacactaaaacaaatggagaaaataagaaggaaattgacttggaccaagttacacagcaagtgagttgcagaactgattttaaatagatccagtcatttttctttcattggagtatttcctccctccaaaagtgttacagacacacagtattcagtagatccctttgacagtatgtgagtagtatgaagctaactcttggaaagcagttcctattgggaatttgcgcactgtgctttttgcaaacatttgctttcattatgaagatttaaatgtacccagataatgaatgttgacacgtgcccaaagtctaattatttttcccaaagagttataaattaagtttcttgatgttaactcttcatgtgtatctcccctagattttttttcctcctagactttttgaaggtagaagctgtttcttaagtaatgtcggtatctagcacagcatctaggcctaacatgctctaaagaattcagtgttgttcaatgaaaaattgatacttcttactctcaagtcaactttctaaaattcttgttggttaggagcaatgaatagcttattcctatgtgaagatattggtaactaaaatactttggcaaatgtttgttgtcttataaaattcttttttatttttatgttttttttttgaggcggagtctctgttgcccaggctggagtgcagtggcatgatctctgctcactgcaacctccgcctcccaggttcaagcgattttcctgcctcagcctcccaagtagctgggactacaggcgcacgccaccatgaccggctaaattttttgtatttttagtagagacagggtttcaccctgctggccaggctggtctggaactcatgacctcaggtgatccgcccactaagtgctgggattacaggtgtgagtcaccgcacctggccctctatttatttttttataagaattaaaatgttagaaatgactttcgaggtgggctgtttcccttcaagttattatttaagcagtagatgaagttaccattaatgtaaagtcctggttttaaagaactagttactgattccatttggaaattatttttatgaggattttcagacatttgaacattttcaactggcactgaaagttgaatactgcttttagaataacaacagaaaatcaaagcctgtatgttccttttcccttttacttgttaagcaaatcttgaagaagttacttgactcattgttctgaatgtcttaatcagtcactttaattttttgaaagaatttccttgaaagtgttcttaaataaaaatagggatcttcctgttagtgagtgtaaaattactcagcagtgattctttggttttgtgaaacttaagggaagactaactcttctttctctatcccttccttccattccctctgcagtccatcatcttggttcaggcctttgtgacagttcttgcctagcctcccaaaagatagctttccccacttctcctgcttgtcagtgttttcaaccacctgcagatgacttcttcaggtcagcagtagttgtcacttacctcttggaccaaccttttgggattccttattgcctgatgaatttaatggatttcttaccatagtattccaggtcctgataatctgctcccaacctatagctttctagtcttcctctccctcattttatgctctgggacagtgagcaagttagtgtatactgagaagagaaatgattcggaatttttaggtatagaaggacttacaaaaagtttattcttgatggagagtagaaattagtgaccattgtggatttgagagtgttcattgtttttgaatcaccgttaccagaaagacaaagagtggcgagtaactcagtagtcaaaggggagggagtaacagacttgtgcatgttggagattgaggtaatgtgaacattcagacatagatgtttgaggagagtagggagaaaggagtagatggaaagtgtagctggaatgcaaactagatataatctgggttttattactctcttcatacttacgaataagaaagactattaaaaaagaatgcctaggccaaaaagattgtcactaatacaaacaataagctaaatgactcttactgcaagaaaaaaagaaaaagaaattataagctgaaaagaaattggaatgaggaaaactattgaaaattttccataaaatgacagataagattaggaaagtatgagaaggatcgtatacccccatcccacaaaaaaggaagttgctgtcttggaaccaactataattatgagaccattgatatacagggatgttcttggttttcaggatttatggtggaaataaattaaggactctccttataaaatctagagataagatgcaatattttgataaaacaatataccatgatactgttttggattttatcttttaagactgcttgcaatggagctataatgacatctttttggtatatacaataagaaactcttggacaggatgaaacacatgtcaaccttatattgtatatatgctggaagggattattataaggttcaagtagtttccatagtaaaatttttcttactaattctacacgactccttatttttctcttagtaaacttgaggaataattgaatagtgggggaacagtttctggaagcgtttattcaatgagattcaagacacgtattctgtaagaagcatcataaaaacaaaatgcacagtatataggtggagaatgaaaccatactaaaaatttagtcagggcaacctgaccagacaatctgcaaataatacgttctgtaccctgcaattttcaatgttgagttttctcttttttctttactcacaagaatctctgcagctgctgtttggggtcctgggaacactaaatgcaaatgatcattgagacccaggaatgatagttttagttccccaattatggtgtaggcattgcaaagaccctcttccataaatgacacccttgtatttttttgatttaagagacctgtctctgttatcattggatttaaggtaaaacctcttcagagatctgtgtttaaagctatttcatatgtaatatatatattttttcttttgtctttttagccgtgtggttttgccatgttctgttcaggaggtgagtttttcttgcttctgcatcattttattggtatatgtactgtactttgatatgttactctaaactcacattttcgtagtattgatttaccttttcattccaccttatgtgacaaaattaattatatgaatgataattgcaaagaattgcaaaatgaattaaatgaatgataatgaatttcttgctacactgccttgttttggaagagtctaaagaatgtagtttaacctcctgtctagtgcaggaattctttctccaacatcccagagaaatgaggctccagcctcaacttaagtactttaaggttaagtagcttgctgcttagagaagcagcctactttactgttggacattttaaacatttgtgtttgaaccaaaatctgcttttcctataatgcttgactcttgtttacagtttatcccatttgagcaatgggaaataagcctgttctgtcttgtagtggttaatccttcaggttttctgatggcagctctcccctccagccaaccccatcccccacaagcacttttatttcatcttagaaagtctcaaggttaaacattcccagcacattcacttggcttaatacagcatgatatgtggacttgctaccagctggtcctgttactatatgtgttgtaattgttgatctgaactgaaaacagtattccagacatggtatgaacagcacacaactgtaagagcttattgttttcctcagtctggacatgatacagaaatatatcacctattcagaacttgcatgtcctgcagttatagccatgtgtattgtagacaagaatgaagataagagcagaaacagcttctgagaaatcaagatatatatagcaaaacccataaaaccctctaggctcttctgtaacttgcacacagttcccatttgctcagttatctggttttcctagagctgacagtagattagaagcagtgacttggaagtgggacaaaacaaactgataacctaagaagtgacagctgacagaagacagaaagaaatgcaggaagtgaaaaagagtagctgtctggcactgtttagtgtagacttgaacacagttgtttatatctcaggaggattcactgtattaaaacactccagagaagctaggcaccctgttctctatttgcacaattgattgtttgaagttgaatgtggaaattgacacttgtttctgttagactttttcttttgatttcagctggttgaatcagcttgtcgaaatctttttgagtcttggtattgtcactgaaaatactgttctcggctttttgttatactcccccccccaccttttttttttttttttttttggagatggagtcttgctctatcgcccaggctggagtacagtattgcgatctcagctctctgcaacctccgcctcctgggttcaagcaattctccgtgcctcagcctccctagtagctgggattacaggcacccgccaccgcacctggctaatttttgtatatttattagagaccgggtttcaccatattggtcaggctggtctcgaactcctgacctcaagtgatccacctgcctcagcctcccaaagccttgggattacaagcatgagccactgtgccaggcctgtatgcacatttttaaaacatgccttctgtgtctatttcttattctttttttttttaattttttattcttaaaaaaggagaatgagagaaaactaagtagcatgccatgaaatgtcagtccattaacgtttttttggatacagttcatttgaatattgttattgtgtgttcctgaccaaaatgaaatttatcttttgacctagactcattttagtcctgttttagaatatgatagtgtttaaaagtacatgttgaaggtatttaaggattgtggcattattagactaaccctagtgttgtatcatggaaagccaaaaggagaaatgcagtcctgtctgcaggccctacagaaatttattttgggagcatttaagaaatatgtttggtttcaacttcccaaacacttccaaattgagtaagagtgtgtgtgtgggtgtgtttttaaatttaactaataggcaagatagcatcatatctccatgtgatttgtagatatgaatgtttactgagcttaaactacctgttgttttggtccctcacataaaatgttaattttgaaattacaagttcttagaggtagatttttgtagtttttctttgaaaatatgcttataaagaagaaatacacttcttcaagctgttttcattagaaggaagaaatttagccaaatttgaagtgatggaagatagtgccacagttgggtcactgtaacaaattagaacacgagaactttttccaacatttgttggaactagcgactccagattggcgtagaaaatacagttgacttacaggtattgatggaggcctctgagatttctgattcacgttaaatgaaatagaagctactgtcagcaatttcctaccttttatggtaatatgtatacattcatattactttaaaaacagtttctgtttgttctctttacttgaggactcacaatgaaccatttctgatcttgggcccccaatactgtttctggttagctgaagaaggaccaaattgagtgtatcataaataagtcataagttaaaaatgaccccagaagtctactaagatttggactatctattatgtttctttggatctccaggcttttgttattacagtttacatccctcccctttatcattaagagcaatatgctggttgctcagctttagttggcaaagtgccagttgtatttctgccatacctttcttggaattttgtgaagttaaatgagaaataatagaggtgaaaatgctttgtaaagtacaaatatatattgttcaaaagttaaaccaagtttcgagacattttcttgataaatgggtagtgtaaaggcaccagagtatttgtaactggcaaattttttgaataatgaaagtttataaaatacaggtttttaaaactgtataataatctgtggtttgtcttcctaaacgtattaatttctaatttgagttgtgttttcatattgaacacagttgtgctgaatggtttggatatgcttttctatatcatctatattattaagattttagcatactaaatttctgcagttactactgacttactcagtttctgtattctttgaaatttcagtatcaggttgggcagctttactctgttgcagaagctagtaagaatgagactggtggtggagaaggaattgaagtcttaaagaatgaaccttatgagaaggatggagaaaagggacagtatacgcacaaaatttatcacctaaagaggtaagcggtgttcacatttgacgccttgtaactacctggcttacttatgatgcatgtaactagctaacttaactagtagatgtgaagtacatttttaatttcagtttgataatatattgcattttaattctttggcagaacctcctcctttatttgtaaattagaaaaggattatatctgcttataacaaaaattcagataaaaacttagtccctgctccttgccatcaaatatttgtaacacagagagaaacactagaagcagcttagagtttatctttctagatcattttctgtatatattcaaaggaatttttaaaacatagcgatgtattacttgtatcaattttagttttctacaacaaatggaccatatgaatggttttgcagtttgctttatttctgatgaacatcttccatattgttatttaatatctgtgtgattctttttaaagctaagtaaaatttcttctggacatagtatagtttacttaaccattccctacgttgtaagtccatttaggtattttagaattttctagtttttgtctgttataaataatgtttctggccaggtgtggtggctcacatctgtaatctcagcactttgggagacagaggcaggaggattgcttaagcctaggagttcgacaccagcctgggcaacacaaggagaccccatctctagtacaacaacaacaacagcaaaaaaattggccaggcgcggtggctcacgcttgtaatcccagcactttgggaggctgaggcgggcagattacgaggtcaagagatcgagaccaccctggtcagcatggtgaaaccctgtctctactaaaaatacaaaaattagcctgggtgtggtggcgcacgcctatagtcccagctacttgggaggctgaggcagcaggatcttttgaaccgaggaggtggaggttgcagtgagccgagatcacaccactgcactccagcctggtgacagagcgagactccgtctcaaaaaaaaaaaaaaaaaaagaaattagtggggcatggtggtgtacgcttatggtcccagctacttgggatgctgaggtgggaggatcacttggacccaggagttagaggttgcagtgggctgtgatcactgcacttcagcctgggcgaaagaacaagatggacgctgtctcaaaaaataaacttttatgaacatggttgtacatgtgtctatatgccttaggttactgttcctaagagaagttataaaatgagaaattaataaaaggattgctgggaggacatgcaccttttaaattttgatattactgccaaaattgcccttcaagagtttgatagtatttttccatatttttctttttaatttttgctaatttcgtagacaaaagatagtctcttgttaaaatttgtatttctttattagtgaggttgaatgtctttttatgttaattgaccatttgaatttcttgtatgacttttgactcttcatatgctttcttcattgtttcttttctctttggtttgttgaagtttttttgcacattcccttaagtttggcagtctaatctgtatctttggcataaatattttaaaacaaaaaatgctggccaagtgtggtggctcaggcctataatcccagaacttgggaggctgaggtgggagtattgcttgagctcaggagtttgagaccagtcggggcaatatagtgggacctcatctccacaaaaagaagaaacaagccaaaaaaaaaaaaaaaaaaaaaagtactaccagtatttatctaagggcagaagaccagtaatggcttttaagagtccattttgtcattgtctccctagttaattacaggtgggggatcttttgcctctattctcttcatattgaaatgaatcatactcatgttttgtggaactccttaaagttgtagctgtcatgatcagattttttttatatttcctcagcttaactctgctacttgatttacagtgacccataacctactcatccttggtttatagtgacacataatcttatctctttatagaaccttaaattttatcattattttcgcttagaatacagcatttctttgcttctgttgctggtttgacttaagaaataaggcagtaactctgatcaatcaattatccataaggaaggtcttttcatggtttctattaatttgttagtaccctaagtatatctgaaaaatatgtctattgagagaagattttggcattccagatggtatagtctatatatatttaaagttttgaatttgcttatatatactcagctttctttttctagcatttttgcatttacctgttaattgaagtataccccaccacatataaaagttcctcttaaagacactggactcttcctgggggttctaaaataagccaaaaagtttgatgtataaaattttttattggcctctgatgttctgtttagatcactatcctataagtaaataaatttgaaatagattcaaaatgtcctctggttgaaatctaagagttggaatgttgaggaagtgtttgatacattcttgcatggaaaagaacagtttgaaataatgtgtaatacataatacattacatgtgttttgaaaaaaatcagaaaaaaaaaaagcctaaaagaggtacattaagatgttgagaatatttatcacctggtagtgggatatgggtgatttaaaaaatcccacttaaatcacccatatcccactaccaggtgataaatattctcttctgtattttcatttttatgagaaagaaaaggaatgttaaatatgatttttgaaacagttgatttaggtaacactccagtcatgaataaggagtctcgtaagttgaagagggctagataaatatggttagtgcaagagatattcttattccggagaggttatttggggatgaggttcagaattcctctcaggctttcagtggttaaataaaagaagattttggctctcggtggccaaccttccagcacatttgggcttctagaacaacttctccattcctaggaggagcggagtaccctgtggttttaccctctcatgcactcatttacttgtcattgcaatcctgagaaatagacaatattcatattgtacctaagacactaaggcacgtatttacccaaggtcacagctaataagtgacagaatggtgacagagacctaggtgctctgatttcaaatcccacacccacatcaagtcccagatgcctgatgaatacaaggcactcccatgagaagggagagaggggatctgctgggatggcgagggttgattcccatagaaggttggccttatcacacaaagatggcagctgtgggcaaaagcacagagaggaatgagacaggaaagggaaaaaggcaagagggtggcagtaatgagtctcaggcagcatgggaaataatgactattctgacagtagtgaggaacaaaaacctaaccaataataaataaactgggcaaaacagggcccatttgctgtcctctggaggagggaatggctatggggcagtcagatgtccacaatgacaaatttctcagtgtcaacattgaaagcacatcagccacaggataactatattatggaagggcaaagaatcatttagtagtaagtgctgaggccttcactgttctgcaggaaagacctccatcccaaggcaagcctaaaggtgcagccccatgagactcacagttttctttagggcatcatctcagcatgctgaagacatacccatagtccctagctagttttagagctctccctgaggaagttaaatttgtgtctagtaatatgtttgctttttcaacaacatttactccataaattatcctaagctgggtgcaccgtcactatataacatcaataaaactacaaacttgactaaggccaccaaggccttattttacttttgagatacttgaaattctgagatctactttagccagtataactcaagtctctggattccctgacctgtatgctttcccatttcagcaaaacacttcttggtagcatatatacacttaatctcaaccagaaggttgagaaacagtctttgtgaatattgacaaaatctgaaagttggttactcattgcacgggacatttgaaatgtctggtttccttgaatctcaggtgatacatcatctcatgggataatgagattttgtccatattttgtttgataacttagagtgagtgtttgcccatggtaattctgaacagatctagtacttatgtatttttactgtgtgctggtcactgggttattggaagtgttttaggtgggagtttattcattcctcacagcaactttttatagtgaggaaactgaggtccagaaaggtttaacttaccacatgtctcactgctatttggtagcagagataggacttgaacacagaccaactccagaacctgccctcttaaccactttgctcaactaaccactttgctctacgtctgaatcctgtggaagagttattttccatttcctgaagttaactccttgggagtttagagaaaaattcttccaaaaccacaggtttcaccatctcttactttctctgaagtctttaacgtctaaagtcttcttccaaaataaagctaaacttaacaaggtatttaagattcccaattgtataagtccatccagaacaaaaacccttggctgtaagcaatccagtctctgctgtcttcctaacataaactgttcagcccaccctgagcgtttttttcagccccttatgctggggcctctcataacctgcttggttttctgagtacacctcagaactatcctatgcagaggcattccatggctgattttattcacttcgatccctcttccctaaatccatcatatttgtcatttcgactcattttgatacctagtcatatatttccatatgtgcatgtttgtcttgttgtatcctgttttccactaaagtttgtttctttgataataacttagtagtagatggcagtgaaagaggaaggaatttactgggcagagaattttggagcaagacaaagaaatgtgttgtaactttcagatggtatttcagagaaaagcttgtagctctcctgagacctcactgtacgaacacactgaccagtcctttttgctagtttatttgctcacccttcttgaggaaagtcagctttattatttcttattctgcgtaagtgttacactttcgccatcttcagtcagtcctgattgatggggaatttataaagctttgccaactccagaaccaccttgtttcccaaaggtcgaaacagaagaggtttttattgaaaaatagttattttaaaatttcatgtggttccaaggtaagagttcatttttgtaagcaaaaggagtcatttgccaggaacttaaattatgtttaaaaatgaggaatttaaatcacttgaaaatgaaaggattgattgtaacatacttcttcacattcagagagcatcttgcacatgtaagaaattaataggctgggtgtggtggcttgcctggaatcccagcactttgggaggccaaggcgggtggattatttgaagtcaggagttcgaaaccagcctggccaacatggtgaaaccccgtctctactaaaaatacaaaaaatttagcggaatgtggtggcaggcacctgtaatcccagctacttgggaggctgaggcaggaggattgcttgaacctgggaggtggaggttgcagtgagccaagataatgattgtactccagcctgggagacaagagtgagactccgtctcaaacaaaaaaagtaaaggaaaaatttataaatatcagccaaacataatttgttcttgagtcaagaattagccatcatagacacatgttatttgtcattatatgtagtttagtcctaaagttttcacagttcagagttttccaaatcaagagtgatcctgtttctgaaaaatatcagaagtattttctgaaatatattgtttcctcttgatggtgtatctcatttttcatttattattccccttttattgtgtgaaaaatacttttctctttgttttttgtaattctccaggactttagagtctcttgtctcccagaagttaggcagtttgtgtctggttattttattcccttcccacaaactggggttgtaaatcatttctgtaatttccctcctcttgtatcttcttttctttctttcttccatctccatcattactgttaatcaatcaaagttaccttctctctcttagacttgcctcctggctgatattttgccatccattctttttctgactttaaaattaattgagatataatttatatgccataaaattcattcttttaaaatgcacacttcagtagtttttggtatattcacagagttgggcaactgccattgttacttaatttcagaacattttcaacaatccagaaagaaatctcgtattcattagcagtcactgactattacccactcctcccagtgcctggcaaccactgatctactttctgtctctgtagatatactgtggatattttatataaatggaatcatgtaatatgtggccttccgtgattgacttctttcacttagcgtgttttcaaggcttgtctgtgttaaagcatgtatcactactgctttgattgctgagtaatattccattgtataggcctgccacattttgtttatccattcatcagttgttgaacatttgggttgttttcacttttggctgttacaagtaatgctgctgttaacatttgtgcatacttttttgtgtgtgtgtgaacatgttttcagttctcttggagatatatattgctgtgagtgaaattggctgggtcatatgatcactctgtgtttaaccttttgaggaactgtcaatcagcttcccgaaacaactacaccactttataatgttatcagcagtgtatgaaggttccagtttctccacatcctcattatcttttttattacaagcattctagtgtgtgtgaagtggtatctcattgtggttttggttttgatttgcattttcttggtgattaatgatgttaacatcttttcaagtgctttttggtcatttgtatatcttctttgtttgaagaaatatctgttcaaatcttgtacccccactttctttttagttttttttttttttttttttgggagacagggtctcactatgtcatctaggctggactgcagttgcttgatgatagctcactgtagccttgaactcctgggctcaagcaatccccccacctcagcctctcgagtagctgggaccataggtgtgcaccactgtgctctgctaatttttttttttgtagaggtggggggtctccctgtattgcccaggctggtctccaactcctggtgcttaagctatcctcctgcttcagcctcccaaagtactgggattacaggtgtgagccactggccttggctgcccattcttttttttttttttttttgagacagtttcactcttgttgcccaggctagagtgcaatggcgtgatctcggctcaccacaacctccgccttccgggttcaagagcttctcctgcctcaacctcccgagtagctggtattacaggcatgcaccaccacgcctggctaattttgtatttttagtagagacggggtttctccatgttggtcaggctggtctcgaactcctgacctcaggtgatctaccctcctcggcctcctaaagtgctgggattataggcctgagccaccatgcctggcctctggctgcccattttgaaattgagttttctttgttaagttgtcttatttatatattccgggtactagttccttatcatagaggtgatttgcagatttttcccccattctgtgagttatcttttcactttcttgatagtgtcttttgaagcttaaaaagtttttaattttggtgtttgcctatagtcccagctacctaagaggctgaggtgggaggattgcttgaggccaggatttcaagaccagcccgggcaatatagcaaaacatactgcgaccccatctttacaaaaaaatttaaaaattagcccagtcacagtacagcgtacctgtttgtcatagctactcaggagacgaggtgggagaatcgcttgagcccagaagttagaggtggcagtgatctatgattacaccactgttctccagcctagtgacacagcaagaccctgtctcttaaaaaaccaaagaaaaaaatagtttatgattttgatgaagtccaatttattttttctttttgtagtttatgcttttggtgtcatcaaagaaatcattgcccaatccaagatcataaagatttacatctgtattttcttataagaattttatagttttagtttttatttaagtctttatccattttgagttaatttttgcaattaactcaataattgcatccattctttcccactccaattaatttttcacacaaagccagaatggtcgtaaaactgaaatcaggttgtgccattcccctttttaaagctttcagtggcttcccatcatccaaagaataaaatctaaactctgtgacgtataaggtggggcccatgtggtctttctgccctctctccatgtttggtcactgcagtctagccatgctggaggcctaagagtggctcaagcacgttaagtcttttgctgtcttaggacctgtagtcatgctgttccctctgcttgctgttctgttccctgcctccgtacccttggatcactgctgtaatattatttcctcagagaggccttcccgaatacccttgctccacttactgattgcccagtaccctgttctttaatttcactgcactgcttgttaagtaattctctttgtattttgttgtttactaatctgttttctgcctccatccctggaaataagttctgagtaggagtcgtccctgcgtactcaccattatttacacagcccctggcctggcgcagtggacacaggaaatatttgagtggatgaatgaatgaggtacccagtattttatgtatgtaggtatatatatatttattattattatttttgagacacagtctcactgtgtccccaggctgaagtacagtggtgtgatcttggctcactgcagcgtccacctccctgagtcaagcgactctcctgcctcagcctcccaagtggctgggattgtaggcacccgccaccatgtccagctaatttttgtgtttttagtagacacagggtttcatcatgttggccaggctggtctcgaactcccaacctcaggtgatcctcccaccttgacctctggcaaagtgcttggattacaggtgtgagccaccgcacctggccctttcttttcttttcttgccttctcagctgagcttttcctgactagtgaagagaaggcatcacagtgtatttaggggatatttcagttgattgtaaaatgaaagattaattggtttatttatggtaaattaatctggtcttcaaattcttccctatatttttctgtgttttgatgttcatctgcagtgggaaggagaagggtgggaaaagttgtcttgcttgtgtggtttacagatagacataataatttccagggaaaagtgcatggtattatttatctcaggaataggattaaaaaaggaatgtgcctagatcaggcgttcagtgtaccttatggtcatattttaccctgaagttaaatagtcttaaagtactattcagagtgggagaagcggtatgtattcctgaagagtcttcatggtcctgggcattgtgctatgggtaactcttaactcttcactcttaagcagctgaaatctagccatgtttaccttgaggtaagtgaacgctgttccgagtattggtttatcatgagggagcaccattttgtgaatagtttgggaggacaactgaaggattgtcttttttgcatgtttgtttttgaaggcctatctcccattttgttaattcagttaataattgttccttttctgaggctctctaagcttccaaaacaggaatctgctacattttactaaagggccttactattgttcattcagttaataattgttcttttcggaggctaagcttccaaatgaggaatctgctgcattttactaaagtgccttgctaagtggtaactgtggtggcaaaatgatgtatatgctctcaattatatatacctggcacacttgaactaccatgttaggaatatattaaggttgccattaataaaaatttctaacctttgaagtagaattgaaatttaattttatttactccatgtgcacattttcctcgtttagtcagttacttagattcattgaggagagatgtatttgataatgttctcacgttaaacataaaaaaaaagtaaatttgaaatctagcttatagatttggactttattaactcagtcaaaacataaaatgaattgctggaattcacatggtgggaaaagtatcttagaaataagatagtaggcatttgggagcgagataaagaaatattaaaattttcatgtagatttggctcatgttggcctttaatgataaatgccaatttccttctatttgagtcagcaaattttagaacattttatgaatattaaggttcttcacatatcaggcactataggaataaatggatagttaaaatatgtgtctgagttaatacagaattgtttctcctgcctttttgttttttctttctttttttttttttattttttattttaaagacagagtcttgctatgtcacccatgctggagtgaaatggcatgatctcagctcactgcaccctccacctcccaggttcaagcaattcagcctcagtgtcccgagtagctgggattgcaggcacccaccaccatgcccggctaattttttgtatttttagtagagatgggttttgccatgttggccaggctggtctcgaactcctgacctcaggtgatccacccacctctgcctcccaaagtgctgggattagaggcgtgagccaccacgcctggcctctcctgctttttctaagttgaccagctgaaccattgatagatctgtttgtcatactctcagatgaataggtagtcttgtagcttggcttaaaaaattatcctcatgtgttccattgtaccctgattagacctcacccacacttaaagggattttggttctagttctttagcaatgggataaattttttggacagctagatactctttgacttttaaagtgatgttattttcagttatcctggcttggtgtttctgaagtttgaatgaattgttccaccatttgaaaagaagtgatcaggccgggcgcggtggctcacgcctgtaataccagcactttgggaggccaaggcgggcggatcacgaggtcaggagatgaagaccaccctggctaacacggtgaaaccctgtctctactaaaaatacaaaaaaattagccgggcctagtggcgggcgcctgtacccccagctattcgggagcctgaggcaggagaatggcgtgaacccaaagtggagcttgcagtgagccgagatcctgccactgcacttcagcctgggcaacagagtgagactccgtctcaaaaaagaaaaaagaaataagtgaacaaagaattagctcctttcatttttaaggatgtgaagacattaaggaagatttaaatgaagaaaggcatatgaaaatacccagctccgtatcaacttataattaaaaagcagtaactaccattttttgagctcattgtactgtgcaatgtgctaaacacattccagtatttgatttaattctcttaataaccctgcagagcaggtaataggaattccattcaacacatgaggaatttcagagaagccaagtagcaggcctaaggtcacacagcttccaaatggtgatgttgggatttgaattcgatctgtgtgaaaagtctgtgcaagcaaaactactctttacagtaggctccagtcactatatcagtcacttcatttgcatttatttgaagactgttaagactgattttcccatttgtttgttaacaaataacattttctatttgtaatgggcctgtggatgacttttgcccctttatatgttgggattgtttctgattatcatatgcttgcacaagcttctcatatattaatcatgtattgaacctttctcttcctctgaatatacttaaggcagcaagtgacattcatctcccatacctacaaaattttatacttggatatgctttaatttctcattttctgcatgggtcctttacattgtcatttttcttcaggtctgttctataaaatgtattcagacttttattcagagatatctccttattctggggctttttgcattaagaaacagtataatgtcatctaactcttaagaactacattgtattaatgtgcagattgaatagctgttaactcttaggttttacattggggtagtagatcagaagttcttaagaaataattgcttctatttaaaaaaaaaaaaaccacacacacacacacaaaaccttttatacagttaattttttttttccttgtgagacaaggtcttgctcttttgcccaggctagagtgcagtggtgtgatctcagcttgctgcaacctctatctcccaggttcaagtgatcctcccacctgagcctcctgaatagttggggctacaggcatgtgccaccatgcctggctagttttatattttttgtagagacagggtttcaccatgttgtccaggctagtctcaaactcctgggctcaagtgatcctcctgcctcagcctctcaaaatgctaggattacaggcatgagccaccatacccagctaaatattcttaatcatttttatttaaaatgtaaaaaattatgtgttcatttctactggattactttaggattgaaataaactagttcatcagacttagaacctggtcacctttgattgccatactctttcaagcagttggatagataccaagaaagaattgatggtgctgttaaatatatccagtatctctcttctcccagcaaagtgcctgcattcgtgaggatgattgctcccgagggctccttggtgtttcatgagaaagcctggaatgcgtacccctactgtagaacaagtaagcttggcccccagcagccattgcacccctccaccctgagaatgagagggattcccagtaccagtgtctttgagaaggtttacactgagcaaggtcttccttgggttcttggatagtcactgctagaatgatggcagaggaagggctgcattgggttcctccccctagaactttgtgacaggcataagttcattcccacatggcagccactttggggtcctagctgactatgctggctccaggggtaagccaaaagaaaggtcgtttacactcagaagggtgttttggtgtgtttcaacagtattttacttaaattgctacataatagaggaggaataggacagacttctgaaacagcatcctatcatttgctaaattgaccttataaataatgttttgcttttgtgacattattattctttttagcattatttttaaaattagattattgttcatattttatttgtactccataatctaatgtactgtatagtgtcacttgtgtggaaactgttttgcagacataaattactaaataaatgttctgttttcagatagtttagtctttgtgacattaagtattgggacagattgttttgactccaattaatattctgaaatttttctcctttcattacctacctctccattatgcctcagttgtaacggtgagtaaaactatttttgtgtctcatactttctttatctttaaactttgttttacacagtaattattttcaaccattctttgctaactgcacctcgctgcatggttccttcctgtgtcccaccaaccagccgccacactctaccacatgttcccagtgttcatgggccctttccacccttgtctcaaaatctccctattgattttattttgcttttgttactcccttcaaacgccatatttgtttatcagacctcacagcttctttattagcccgatatgccacgtggcaagtagaattgtttaaattatttaaaagcatgtagcatttggtttgcctgacaagtctataaaaatcggtagccaatgattctttgtcacttgagtatcagtctccttgtagagtcaaagcatggatgcctatactgggaaaagctccctcagacgtgggcaccaaggaacaggtagaagatcactgtcattttcctgttgtgttttctgcagaatgaatatatgaaagatgatttcttcattaaaatcgaaacatggcacaaaccagacttgggaacattagaaaatgtaagtttcaactctgcacttttagtacaaaagtccctggaaacgagaattctatatgtagttcactttgtcatcatcaaagtaatgtcacctgtgtatctgaccgcaccaagctgtgtcaaattgagatgaggcgggcaagcagccagaaaccaaataggctttccctatcagtccgcttgccttgacactttggtaaagttgctgttttgatcagcaactctctttatccgagacaaggagagcatgaataaacaaaattcacagataatccccagcccaattttagccattagttttgctaattagattgcttttatatctgagtgtttgtcagagctgctctgcatagcaggattgattgctttaatttttacctcttgtctgctttgcaagggtatgggctcatgttagagaaatggccaaaaggcaggagggataaagtacttgaataacttacaaaaatgttgaaaagctgttgacttatataagttggttcacatttatctctttaagattcaagaacatctttgagttaggacttaaaaaaatgtaatcattaacttttggtaaggtttgtcgtggaacttgggaagtcctgttgtataggttgatgcccttggtctaggagttctcaaaagtgtggtctttggatgggccagcagcagcacagtatctgaggacttgtttgaaatgcaaatactctgacctcacccaagaactaccgaaccagaatctctaggggtgggactcagcagtttctgttttctgatgcacattcattccaggagagtaggttaatgattgtggcaaattctgtttttactgttctattacggtgctcttacgttattgatgccagttaatagaactttgaattttaatatgtagtattttacttgagttttctttcaagtgatcatttgacattttatgttgtttttctttttgtttttttttttgagacagagtcttactttgttgcccaggctggggtgcaatcacgtgctgtctgctcagtgcaacctctgcctcctgggttcaagcaattctcctgcctcagcctcccaagtagctgggactgcaggcatgcaccaccatgcctggctaacttttgtattttcagtagagatggagtttcaccatgttggccaggctggtcttgaactcctgacctcaggtaatctgcctgcctcagcctcccaaagtgctaggattacaggtgtgagccactgcacccagcctttatgttgtttttcttagtaatcctctataatttataatctagataagattatttggtgtgcattaatctgtatgacttaatctgatattttcagcttttaaatgggcatatctttggcagttttcaaacaattcctaattagttcacagatggcatttcagaaataaatgattgatcaacatgcagtagagaggagttggcatcatactgaaactgaatagctttaggataatcaaattttggagagattttagaccatacagtgcatcatttgaattctacttgtaatgtcaccttatgtttgtataggactttgttggttacaaaggttacaagtactttgttgtgtatcatttggattaagcataggtctcgtatatttagttacataaatcatctgtgaggactgtcagaagataatattgacaggtttctattcatttggcagcatcctcattctctccttccttattatttggggttataagtggtaataaaagacttttagatcctgcaaaatgtcagacagctaatataatgaaataataatttgggtcttttaattccctataatgtcccctgagagactcaagataaagattatatgtgtaagcataatagaataatctacagtttgttttgtttcttttctctttgtcattggtaggtacatggtttagatccaaacacatggaaaactgttgaaattgtccatatagatattgcagatagaagtcaagttgaaccagcagtaagtattactcaatgacatttaatctgttcccttttacagttaaaaattattttctactatcacatttgggattaagttaaaaaaattatttcctttctttcttgtatggcctacatttctatgccgaagtgagcttggagtgaagtctagtacgtctgtgcagcaaagagaccagagtaagagagaaggcgatttgttttctgtgtagattttggctttgtgcaagtgatccctttaagaaatcccagtatacctgggaaatgtaggttgttttcattgaaaaacaaaaaacacattgtttacaaaataattctccctccagctaggtcccttttacttttcaaatgtgattaagaaagcaaaaatttaatttgcatacaagtatttagtaactcagctacagttgttatttgtggaaaatggttggtgtagagtatctttttaaaaatgttcttttagattccagaagtaggtgtagagtattttaatttaatagttgtttagctttctattttgaatcctattaagatgtaaatatttctactcctggcttttgacttaataaaaaaatttctttttcacaagtaaagatgcttattcctcatgccagattaagactcaagataaagattatatatgtaagcataatagaataatcttaggctggacacagtggcttccacttgtaatcccaacactttggaaggccaaggagggaggattgcttgagcacaggagcttgagaccagcctggacaacatagtgagatcctgtctctaaaaagaaaaaaacgattagctgggcatggtggcatgtgcctgtaattccagctacatgaggaggcttagacaggaggattacttgagtccagaaatttgaggttgcagtgagccgtgatcgtaccactgcaccccagccagggtgacagagcgagatcctagctcaaaaaaaaaaaaaaaaaaaaaaaaaggctagacatggtggctcaagcctgtaatcccagcactttgggaggctgaggcaggaagatcacgaggtcaggagatcgagaccatcctggctaacatggtgaaaccccttctctactaaaaatacaaaaaattagccggtatggtggtgggcgcctatagtcccagctactcgggaggctgaggcaggagagtggcatgagcccgggaggcggagcttgcagtgagccgagatcgcgccactgcactccagcctggacaacagagcgagactccgtctcaaaaaaaaaaaaaaaggaaaaaacagacccctgtctcatcttgccaaagtttatgaatattaatgtggttcttactttatagtgtgctaagtgctgctttggttttacacagcatgtgtaaatacaagcactggtcctcttcctctaatctagagagctaaagctttggaataagagtggtaccctttgttttgtcgtggtcaagcacggtatgttcagtaggcgtccctttccatttctatttttggtgcttattccctgaacttgagcagtgttgtaagtgaaacagaaataagtcaaacgctaaatgtctggttttgctgttgaaatttaaaggtaaacttgcctgaacaaaggtccccgaccttttctcagatgtcactggggttgagactgccagcagtgacccagtgccaggctgggccaactctgctagggcccccttcctgcttagaagtgtgagcactgataagggacttttgttctagaagttcttaaattttagttttgctgtgattcgaagttgtttcaattttagggatatttccacctttgacattatatagggagtttttcaatctgtagaaatgaaatgatatatctgttatgcccttttatttctcttggtattgtttacagctaagatttactatatgtgaaagaatgatgggaagagaagtaattgggagtaatgagtgagttagttaatgactaggtcaggacagcttacaagcctggagctgcccatcactaaaataccaagcagcagtatgccacaccaggatcgggtgccctggggaaggcattcccattatgttgttggtgtttgaaaatgctataatgaccaaacaaaatggctcgactgactcagacttatggtccataggtttgcagtctacgttgttcaccagcagagtacaagatacctttggttttgctggaggcataaaaattctttgttcctgtcctcaggcgaaaatgggcagtgtttacaggcatgaatgctggtggaaagagcagagtaagggcagattgcacaagaaccgtggaggccctggttcccatcacctccacctcagcacagacttcagagaggagaggaggcactggatgcatgacagcagcacttgagataggtgctccaggtggaaggcactgcacatgcaaaggctgagtaggtagttctctgtgtgaaaatggtgatgtttggggtggatagctagtgaaaaagactggattgagcccaagtgaggaggatctgtgttgtgaggtatggagctttgactaaaaacatacattctaaaactaggtgggcttcagatttccattctgaggctctgccacctactggctatttaatcttggacaagttggttagcctctctttgcctgtattatcttgtgtaaaatgagagtaattataagattaaatgtgagcacttaagagtatattagtctgtttcatactgctgtaaagatactacccatgactgggtaatttataatggaaagaggtttaattcactcacagttctgcatggctggggaggccttgggaaacttacagtcatggtggaaggggaatcaggcacgttttacatggcggcaggagagagaggaggaggaaggaggaactcctaaacagatcttgtgagaactcactcaccgtcaccagaacaacatgggggaagctgcccccatggtccagtcacctcccttccttgacacatggggatcacaggtccctcccttgacatgtgttaattacaatttgagatgagatttgggtggtaacacagagccagatcttatcatacagccagtgtgtagttcagtaaatgctagctgtaattatcattattattagctccagttgtacaagagttccaagagtctgtgttcacaccaagcattgtctggggactaaacacaacctgcgtatatgtggctttttgatgttcatagctcctaatttcccattacgttttagagattagtaagatataaatttattttaaagtttattgaatttgcaggaactattttttattgggataaaatacacataatctaaattttacccttttagccatttttaaatgtataattcagtggcatttggtacattaacagggtcctgcaaccatcaccactgtttagctgcaaaacgttttcatcaccccaagaggacaccctgtactcatgaacagtcgttccctgattctccttccccctaacctctggcaactgctaacctgttttctgtcttttgggatttgcctattctggatatttcatataaatagaatcacgcaacgcacagcctcctgtggctggcttctttcttatacttcgcattgatttacaagattcatcttcgtagtgtgtgtcagtacttcattcctttctatggctgaataatattccagtgtatggatagaccacattttgttcatgcattcatctgttttttgttttgttttgtttttgagacagagtctcgctctgtcgcccaggctggagtgcagtggcgcgatctcggctcactgcaagctccgcctccggggttcacaccattctcctgcctcagcctcccgagtagctgggactacaggtgcccaccaccatgcccagctaattttttgtatttttagtagagacagggtttcgccatgttagccaggatggtctcgatctcctgaccttgtgatcctcctgcttcagcctcccaaagtgctgggattacaggcatgagccaccgcgcccagcttcatacgttcatctgttgatggacatttgggttttttctacctcttggctgttgtgactagtgctgctgtagacctttgtgtcacaggagcttttcgtctaatgtgctgtcttgggggataattaaagaactgttacgtaaggattatcagaccttttgatgtaaaaaaaaaaaataattccagtatgcatatttctctgttacaaaaagaaagagaagaactttttggtggcaaagttgcccttgacagtttttaagcctggagcagagcattgagcttccagggttgggatggagggtgtgggggtgggcggtgttgaaggcaggtatgggtggtggcaggagagctaggaccagacccccatttcagggaggaggtgactgtgaaatctagtggtgcagggaccctgggtctgctcttttcttctgcacatccttgtctgtccactttcacaggcattgacagctgcccctacactctaaccctttaatttccgccccattgtttgggccttgactagttagtgttttaggattagcttctgtcccaaacacctggaccacctgaaggtcactacttcttaccagatccaatttggttttctgttaagttaattagttcatttcattctgcccttttaggtaattttgtcactcgaatattctagtctacagtgtagagaaaaggcacaacacctttgctattctaaaacggtaatgtcatagcagtcaatagtactgaatgcctgtgcagtgtgtaccagtgctgtgcatgcagcactgtggtagctgtcgaggatttgtatagcacctacaagagacttacagtcttagcaagagaagcccagtacaatgaagtagttaacaagtggcagaggcttacagcgtggtccaaagtgctgtaggatttcagagaagagaacagatgatctgtaagaatgcaaagctgaaaaggctgaaggaaagactcctgacatgaggatgtgtagagttttgatgagtggaacagtcattacactttttcctcttacactcgttgctctgacacattatacgtttatttcttcatttttctctctcccttccaagtagaaattaaacctgagagggaagagtctttgcaaccttagcccatgtctccccagatcctataacactgtctgaaatgtagtgggtactcagtgaattcctgttaataaatgaatcataggcaagcagaatagaaatgaaggtacaggtgtaccatctgacattgaattggagtagtttttcgagctgaagggaaccttagctacctaggcctccttgcatttagactgtgcttcacataatcctaagagtttcttgccccctcctccctcaggttatcaggatggagcaactagaataaggggctgagttccttcctgttccctctcccagcgcagttgtgcttgcttgtcgttagtcttgactgtaagatttactttgaacacacagttctgcagctacagaaattttggtttcagggctaacctcctgaggcccaggtaagctagtatttctcatgatcacttagctaatgcctaaagtggaaatcccaattctcagatcactgactgattcttccctagctcaggccttgccagggcagtcactcttcgagctgccacttgagcattctcttcctctcctcacactgctgtgccacggaccataccctatgctttcctgttccaacacactacttgttctcacctcctttctgggactcctttctctgtccaaagttgacatgtccttcaggatctaggtaggtcggagcttgcctcctccagggagatttctttcaagttgaaatcagtcttcctctctgctgaatttcagaagcttttgctcatttcattggtgtgttttgttctctttgtttagcaacctgttccctttttacagagtaggcccttcataaatatcggtcagatgaacctgatgagcttgagaataatgatgaaactaaacactatgagccaagagtttgtactggaatacaaaatcaatttgatgtccttttgataacacctgggttggcaagggatgaggaagcaggcactcccatacattgtctgtgggaatgtaaattagtggaactgttgctagtctagcagaattacaagtgtacatagcctgttgacccagcaaaattctgcttctaggaattaactctacccactgtaaagtgacaggtgtataaacctaggatcagaagtctaagtgtttctttatcaatcgggaactgattaaaatcattgtggcacactcatgtgatggagttcagtgcaatcattaaaagggagtgagctctatttgtactgatggagaatccttttcaagacaacctggagggagaaagacaaagaagtatgtataatatgcttccatttgttatattaaaagggagaaaaatagtttgcttagttatgtatggactatcaagaagaatgcataagatgccattaatagtgatttcccttaggacaggaatgggatggaagagttgaggtctgacagagatgtgtgcagtggatcaggggataaactcctctcaccaactgtatggtttctgttgctgcataagagatcactacatatttagtggctgggtaatgtgacctgattagtttgattaattaagggaatggcctcccattacctttgccacagtctgtggcttagaagcaggttagcggttctgcttgcacttaacgggagggaattacatgagggtgacttatggcagggaggggtttactttaggatgcatctgccataccagcagtcaatgtttagtgcctaaaacttgctctttaaggattggagtgacactagaatcgagagcttagtaactatgaataggccagtaagtgggtgtgggattgagtgggggtggggctgcaccccatggattgggtcgcctgttagacctggggaggtggggtgggtggggatattggagcagaatctccttcctagatttgctgagtctgtcttgttccggggaccagaggacagcttgtggaggctcaggttggatggttgaatggccagatccagatcctaccccttcagtcagccccagctcttaccctgcagctcagctgggagcctgactctcttgctttgtaaacagggaatgatcccctttcacaagaccaccatcatgtctgggcctgtactaggaggctgtagctagaacctgcgtttttctcaacactatttttatgaccaaagggcagcaccttctgaatgggagatcgtgtgactactgggaattcatgttcctctaatgcgcctgtgtttagtggtaacacctcacatgtagaatctggttacctatgcagttgtgaatatccagaagtcaggtaaatcactgtctatagtcttacccaatttaaaatttcatgatttgaccttttctcccttaaatgaatgtgttggtggtgatttggaaaaagaaaattaggaagaccttctgaaggtatagtgatcctcaaagtttgtacttgtggcaccttgactcctggagatttttgtctcagtctgatttaatcagtgatttttcattctgtatttaatgacttctggtttttcttgagtgagctaattaaaaaaaaagttaaatggttgagtttctttcatattacttgcttttaaaaagaaagaaaacagctgcattattaaatttgagtgaagtcctcagagtcaggacaaacatgaaatagttgggagtgcaagaaaccaagaatttgaaactccacctggtgggggctttctgtcactgcaggtgaatgtaatacaaatgcagccccaaatattttaattcagagtgattgttgattactcttaagatttaactctctcagctaggttgtcaggtggcttgtataccactcttgtagatttgctgtctttggtagtgtttatgaactatacttcaccatgcagagaagagatgggatttgactcatggcataactgaatacttgagtggatgctttgacatgtttacataattggagggtgacatcatcacaataactctaggaacaaggatttgttttaaaaatctgtcagtgtgacctagggtcacagagtagtttgctacaaaaatcatatgtatttaaatatatgggtcattaagactttttgttgatgacttgtgggaagtctgtatatgactattgctttagccactgttctctgtaattttctagaagctacatcacttcctgatgaaagaagccaagtagtctgggatttctgcataatgtcctcacttagtatcttttgtcccttcagaatgtacctaccataggaaacggatttcctgtttcaagagaaagtgacattgtagtgaagtgttattaagttgttatatcctttaagagggaagcgtccttctgctggtcatcccagtggtcacagagtacaccatgctccagcaggacacacctcacgccctctccatcctcagagccccttgttttaaacccaggcatcacttctaaaagtcttcctcagtaagctagatgcctcttggcggtcaggattgtactgtactcatcatttctgtttccaggacctagcaagatgctggatgcatggcgtggcataagctcttccataaaggtttggtagatcagagagaatttgcaaatgttttttctgtctagtattataaaaaagaagaagaaaaggctttttggaggagttgaagtttttattgttcaaatagtaaatgaaaaaataaaatctactttaattccttctttagtaattctggataagatatatattatatgccttaaattctaaaaattttggccagacacagtggctcatgcctgcaattccagcattttgagaggctgaggcaggaggattgcttgagttcaggagttcgaggctgcagtgagctatgatcatgccactgtactccagcctgggcaacagagactgtctgaagaaaataaaatttctgagtgttgtttctaaatgagcaaatacctttttggtcagattaaaaagtgttttggttagatcaaattgtagtaagaaccaggagtatccagcataaaacaccacagtgtaagttttaaagttttttaatttctaaagttgtcactgatacacaaccacagtaaaaagtttaggattccttaaatgtcctgatgaaatgcacatgcatatcttcagcacatttccaaaatatacacaaatgagtcagttgacatctgcttctgcttttttttttttttttttttttttttttttttttttttttaggtataaatttgaatctggctctttttaatcatctccagcactttgtctaagtagctttccatgatttatatacaaaagtcacttcccgggagaggaagactctttaaagtgtaagctgaagtatacacacgattaacatcagagagaccttcgtttttggaagtaatttgaaagaaaatgagcatggtttagaaaaaaaaaaagaaattggaaccacatttttagatatttatgtataacaagaaaggattgtatcagccttcctctatagtacatactatgtgactttatttgtataattttcaaggtactttttaagtagaaacaatgtttaatccaaaattttaaggcttacatacctaaaagtgatgcaccttaacatctgagtgttttttacatgttaataataaggaaataatgatataaaagcattaaattgagagatgtagtttaaaaatcgggatccatttaatattgaaatgaatcaaatttaaagagagaatgaaatttttcccctcgtctttcagcatgtttgagtgtaatgcttcagttcatggtgaaatttttcctaaatgagatggttcaagatcaagcattagcattgtgtgaccacagtgccaagaccatggcttttcagcatcaccaaggatgatgttcttgaaaggaagagacacaagctagaaactcgtgtgccatattcgttttgggtcacagaatgtgcagggtatgccctgattgatagggaacttccctgcagagtaggaggggtccctgttttgtgggctacgcagtaagtttgttgtgctcctaagataaagctcagatttcattcatatcacgttcatctttttgtcctttttaacttcacactagttgttactctcatgtgcctcttccttacctgcccatgaatataatttccactgtcatatttacccaaaatctccatccttttttctggtacctttcctcatttgcagatgtcccccccagggggtaatggggacacaattacgggcttcgagtgctgcagccctcctgcctgccccaggcagccagccttccctccctacactgtgtggtccctgggttgttgctgctgttgagactctggaccagtctgcaacatctctttccagcagaaacacttcgtgcaagcagctttttcagcaccagcttctgcagcaaagctgtgggtccactcactagtcacattttttttcttaataccccagaggacacaggcactcccaagtgggagcatgaggctgctgataatcagctcagcctcctttgcaacacctgaatcacctctgctgagtccagctcactcacacctcccccgtcctgtccccagtttggtctcctttggagaccatggtcattaggcaggtctgtacatgcatgacttccagttgtgggttgggtctgtccactagtccagttctctgaagattgcctggaagttaagaggtggttctttttagagcccctgagggtcgctggggagcatttttagctaacttcagagcttgcctgtcaaagcctttattaggactcaagccaaaaccctgagtccctttgcattcaagtgtggtctgcccgcaggcagcttattagaaatgcaaatttgttgccccttccctgtttagaatctttggagtagggctcagggctctttctggccctccaggccattcctgcgcatgcccacctttgagaagctgcattctagtatacattattaatggtgaagattgtagcataggcacccttctaggattttggaagcagaaggaatctcagttggaggccatggtccaacaatattcccctcaacctttatttttactgttaaaagaatttgtagcccagggaactgctgtaactccccagccatgtaagcagtggaaggggagccaggactctaatgcagagctcctgactttatttttgtcattcgagaacaactttttgctgtatgatgtttcttcctttgcaatatgttgattaagagcattcttaatttatttgaaggaaacaggcagcagctgttcttccatccctcttccctagtcccctgaaaccccagtttttatcagtagtagtcttggtcagctcctcccacaactgctgaactctgatgtattttgaagttcgcatatgtgcaatagagtaaaaggattggacacccaaagatgtgttttggtgtgggtacttacagggaacaccactcatacattttctcatttgttcatttaataaacatttattggaacttactgtttgttttgtgttactgtggataaatctttctccagttaaaggaacaattgtatctgtctaaagagagtgagtttcttaatcgcggacatgctgaagtgtgtataagtgacttacaagttccaactgttggttgtgtagtatgtgagtgctccttcaccagagggttatttttccttacagctgatacagaccagtgctgggcaccaggctgcagccatagtcaaagttcaaagactaatcggagccacgagttttggagttttgcagtttactaaatgaacagacattttaattgcttgtcaaaggactataatgggattgttgggcttatctaaactgtttctgagcagctttgtagaagtctcaggttaatctttttaaggattgtgatgtcaaagaaactgaattggtctttaaagtttgtactttttgcttgttctttatttggtgagtatgtcttggtagtaagaacagtgtcctgttttagttgagggcaggaatatactaagccagtacctgttttttgaaatttcagttgcctttgggaatgaacataaatgatttgcttttccatacatttagttcttttcatttcgaacataccattccattttttgagtttttttagtgagcaatctgacacttcttaattgttttaaaccatgggtgtatattgtttaaaaaaaaggtattttgctctttttaaacatattattttctaaaagttggcaaactgatgaaacttggtttaatttatttggattgaatcttaggggcatgtaagttttggtcacaccttaagcagtgcttgtctcttgtgctctcagaaggatttggtgtatcttttcttttgatcatacattctctgagacaatgcccagatgttacatacttgtgtagatagtcttggtaacacatgctttactaaacttcgtcattgcactctctaaataatctttataatattaaaacttttttcttttcaaaatgaaaaagaatgatggaacatgaccagaaaaagttaaatattggttgaagccatgtgaagttgttagtatttgtaagcttttgagctacagaaatgacgttttcttatgggtcaacctaatatatcctccaaattaatttttggtagatgataccctaaatggtcagcagtccttttggttctctctcacagctttcaagaagctcctgtgttttagatgttacatttgttccaactgctgctgcttatttcctaagaagggctttctgcttcttggagctgtgcagtggctacccggctctttagacctgaaaagagcttttgtttattagaagtctgtggctgagatccagccagtcctagccgggcctatggttgccaaatgctgctttggttgttttcttcagcatgagcagagacacacttgatctcagtagagtaccatgtctttttgctgttaaaatgaacctagacgttcatttctgtcttaaaaatgtgttacttatcactagggtgtgtgatccaaaaactctttattatgtgtgcataataaaaacatgagaattgtgacccagctcctaactcaagatgaatgcatgtgatagtagctttcctgaacttagggagaaagcacctcaaatacacgttttgtggtagcagtgattttgcttatgcttaagaaatttctgtttgccaaacgcctgtctcatcttgcctttactgtgaaacagactgttgtcaaggtcttttgtagtaagttagagatttttcccccatcttcaaagaagatataaataaatgtaggcatgttttctattaaaaagaaatgtgaaaatgtttcctacattattccactgccttacatggtcacacactttcagatcatttccagtagtagatttagagaatgtccactatattcgaaggcatggttggatagtgccctcttgtgggaaaacaacatattgcttatgtcgtgcttgcttaaacattagcaaggattttaaaattttattaactgggtgcagtggctcacgcctgtaatcccagcagtttgggaggctgaggcaggcagatcacctaagttgggagttcgagaccagcctgaccaacatggagaaaccccctctctactaaaaatacaaaattagctgggcatggtggcatgtgcctgtaatcccagctactcgggaagctgaggcagaagaatcgcttgaacctgggaggcggaggttgtagtgagccgagatcgtgccattgcactgtagcctgggcaacaagagcgaaactccatctcaaaaaaaaaaaaatcggtgtgtacaagcatgttttgtacaaaatgctttttcactagaaaccattattaatttaaggtttattcctaatttcttccatgttttaaaagtaaaaaggcggggagggtaatggaggtgatgggggtgtgaataggatttgctctagttccttgggtgggggataaaattctctgagagtcagaaaatgtttttgagcagctcatggcagatatttgtaaagaaataagcataaacagctccaagtcaagtttttacagtgcatttcttataaaagccccttttcagccatgtaaactcttttttaaggaaggctccctaggctgagagggagcaagcgtcccttcaggtacttgagtctaatcaaatggtagaatgtaaatcacattttttcaataaaggatcatggttggctttggtgtcagacagggcagcatctgagtcctggctcttctgctcagtgatggtggactctggcaaagaatttcacttccctgcccctagtggtggtgatagtccagtacctttatttcaagtttttgagcattaactgggagaatgtgggggcctgacacataagtgtgtgcttcaaaatggtagcaggaatgatgttgcttattggattttgttcttactttaaaaaaatgtttaatttttttcatattttaactttttcatgttgaatatttgttaacttaatgctaatggactaaatggaatcttgggacttagaagctaaaggccaaatcatggactaacattcagagtgagagagggctcactctgaatttttactagggtgttttcccccatttcagtttaaggaaattgatataatatgttcagtgatttactgtcatttaaggaaacatgcctttttgtaaataaaacttttctaaatgtatcacttacatttcaggtatatgcagtataattttaaaatatgtaatgtttaacaaacacctttatggaattaacttgttaaaactcatttcattggtagtagagtttgaaatatcttcatttttaagtgttataatatataaacatatactagtaataaatacaatattacaataataaatatattctatatttgtgcatgaactgcccaaagcaggaacccacctccccctgaggagagtgctggggtgtagcccatgggcagctgcttaaggcagctcactagccccagtagctctgggctatacaggaatctcaagagcttgctccattgggcctcactttctcatcttatcctggagcacagctatttggtttccttgctgtgttgtaggatatggagtgtatcacatagccatctgtttgtaaccttttcttggggctgaaattctgatttctttctctttctctattaatttgtatccttccaaaggctttaggagtctgcctccataaacatgacagtgttggggataaggataagatcagaaagaatggaatgaacgattagtttagttgtgctctagcctagcagtgctcccaccacccacatgccaggctcacccccaccatctcaggactctatggagggtctctttgagatcagaaagattaccaaaaaaaaaaagtgttatgttcaggggtgtagatttgactgcatttctcagttctcaatacagttgtttaaaattcagcttttaggattcattggtggaaagccagtaaggtttaatgagaggactgaattatagaatattttttaatgcagttttgtccctctgaggtacattcagtaacagaaactaggccaacaagttattgacaattagtggtcctttgggaatctgctttaatgaatagataagaatgatttgtaattagcataataattatatgcaaatgaatgcttctgaattgctctaaaacacttctgaactgtttaaacagccctcctgagatcttgttactctattaatttgtgtagcaaatctttttttcatagatcatgcaaagataaacttcagcccagcccctgtctgaatgattatgtattccaaggtagtaggacctgaattaatgagatttacttatactatattaatggtactctgtgggaacctgaaaggttgaggagtcactggggagatgtaattaaaaatagaaaagaaagctgcttatttgaaaataactgttgaaatcagtttcttaaacaagttagtaaatgttatttctctttacacctctgttatttgcttttgcaaaatttaatgtaaacttttttttaatgggcttacttactctttggagtctcgcttgaattttgtcagcttgagttagttattcgtttggcattagggtcaacagtgataggatccaggaactcatttaggtgccacaatactggaaaattcagggcagtgctaataaatgatgtttgttatttatcttcatatttaattcagctttattccccatcctgggctttatttttaggatgtgattagaggaaataagccttgctaagttgaactgcaatacccatgcatttaaaacttaatgattatctttgagctattttaatagacacctaattaatcattgtatgctaaaggaaagcattttatataacaggctgcaggatcctaatgtctctctcaagcttttatgtttgcccagtaaaacaccccctctccacaggatagaaaataggggttgatcttttataagcaggtgccaaggagttgctaatgcttgtggtttgggtcctcttttccttagtttacacttagcctcacctctagtaacccatgcatggttatttaagcagtttctggtgtctggagctcatctcaatttttccacaagctgtcaagaaactcctaccagcctgccccccacctcctactcacttccccattcataattaggagttaaatctgggctcagggacatttagtttggctcagcacagacagattttgtactttcatttttgggggcagccactgtactcaaagattcatgaaactaatattctttgtattcgaaatgaatccggtttctattgagagtttctgttgagatctgtagtaacagatgtacacccaagaagtagcacaacttttgtattccagtgacagaaaacagttatttataagaaattaatgagtgtattctgtggctccagtgtggagactcagtaatccatttatttaccatattatattttgttttgttctccgaaggctatcctgcctttttttcttaaataagagttttcaattaaatagagttgtattaacactaatccgaatataccttatgctgatactattgtattttttctttgttcaggcactattattggtggagcaagtagtgtctagggatattacacctaacttgataatgatggttttactaagcccttattctggccaggcctctgggcattatacagataattaaaattgaatcataaaaaattttaaacacagtgcactttagcaataagatttttctacttttaaacatgattttaaaacccattttaaaaatgcatttccttggcctggtgaatttgctctcttttttccccaaggattacagaaagtgcatagcaaattcagccttcagaatacccaggagctgaagactcaagtaggctacagctgtcttcacccacagtattctaaaagaactaatgagatgagaagtctgcagctggtggcaagcacaataaaccatgagccaagggcttctcttcatcagagcctcccctttccccatgggatcccaaaggagacagaatactaacaaagccagcaggctgtctcattccacactattgctcatttgcagctataattggtagctgaggttgcattctgtatgctgaaactgtcatacatgaaggaatatatttgttcattgtgatacggatataaattggccagttttcagatacagcaagaccaaactagatacccaatagtgaaaatgtagcaaagaaaatactgttcaaaaaattaggtgtttgttgtggaaatacaaaactgaggttgttaaaaagctacttcctgcttcttaatatcttgcaacttaattcagctgattaaacatttacgtattcttcatattcaaactaacgtaaaacagaaattcctgggtcttgacaagattcattattctcatctttcaaggttaaagtgctattgttaataattgggttttgttacgttttcaatataatatctttaatattttctgctttgtattcaagaggagaaaaagcagagaggggaagacttcatttcatacatacatatgtatatgtgtatgatattttacatacacacagttgtacttcataggaaaatccactttgatatctctagtgctgcggcttcttggtatttttgaaatgtggtttgattgtctggcatttgttgacaccttttgccatcatcctgtgaggtgtaccagaatgtgcccaggactgaggctaaggaggattgagttgaagtgctggggtaggtgagccctaccacttcctcgtcagactgtggttttagcatctgtcaaatgaaggagcttgggtggtctttaaggttcactttacttctatgattctgtgaatccatagttcacatttttctcctgttaaacatgattttaaaattcattttaaaagtgtgtttcctttgctgcttttgtttggttttgattctgacagtaattgtctccattctctgttggcagttaacaggtacttcctggggtttgagttacctgttctttgcttgcttctttctttatcccaactagactgattctttaggagccagaactgtgttagttctcttttactttatctgtttccttgaattacctcttactaataacgtctggtgtgctaccttctatatggtggctgttcaataactagattttgattgagggaaatgatgctgaaagtgattatttgatacaatgttaaatactttcaatgtttgaaaaagaaaatgagcttgcttttaggttttaattccaagcctctgaccagaagaaaatgttttatggtgttacaggtttatttatgttaatagagtagcttatttctcattgtgaatccaggtcttgaaaccacctgtacacacagttgattcttttgtcaatcagaagtggagttattcatttttaggatgcagttcaaaattgtagtttaagaattcacacttgctgacagtaactgatctttctgctgctttgcccagacataggaagtaagtccagttgtccagctccttgcagactgtccatcccagtttgtcgttcctgggtaatgctgatgcctgtggctatgccacattgcatattgtaaagcattaagacccagtatagccagacctatttgctgtttaatactttgagcttattgttggtcctttttgtagacaacctttagagaggcttcaagttctgggtcacatatttacagacttatctttctttaaagttttgttttctctctgaactgaacatttttccttcctcacataatttgtaactttctctttaggaattactaacatggcatatgcacttactgagtaactgttgagttttgagtggctgcttctcaacgtgttttgttgttgttgttgttgtttgatttgtggaaagttcgtattatactgtggagcatgttcagttcttgcttttgctcatactgcccttatctctagaacagtgatttttagttaaggtttcatatctgactcatctgggcatttttcactaagtatggggtctcttcacgaattctgtgaaggaccccagagtcagaaagtctgctcaagaaggaaaggactctccctgctgtctctttctttgcagtgttttaaactgaccaaccgaccacggtcaagttattgttgcaagtctctcttattgttattaatctgggctctagctcttcaaaagtaattttatctttttttctggagagagagagagtgtgtgtttgtgtaatgacaagagaacttttgtaaagcagatagattttaaaagattttcttttttcatttcctccgttctgtcaggaaaaagatatactaagggaaacagaatttacacacactagaaccctgaataaaaccttcattttagagcctttcccctgtggtatataactgaggcagtcccgtgacacccctccttcgcctcctttgacagtgaggggatgacgtgagtgcagtccttctatgaggaagacaagccatgtgtatcccagggctctcgaacaagggtttggagaagccagtcaagaaactgagatgtccaccacagacccagctgtaggaagaggttgggggtgctgcagaatcgatagttctgattttgttcccagccacagtagttgctctggccagcattaacagtccagtgtcatcatctacctgtagtgtcaaaactgggatgggtatgttttattctttgaatgtgattatccatatatcaaaatgcttaaattatttaaaaaactgttgaaagatttgttattggagacagctgtccagtaaccagtcagaatggattgctagtccaggacttttattatttcttattatgtagttatttagcccaaggtaaaagtttaaagcaaaggaaaccaaactgaaaacagtgtcttaaagaagcatttttctacttttacgcaaaagcacagtgagtctaattgatttctgtcctgtgttttggtagctgcgaagagctattctggcacggttaaagaatattctctggttttcttctctgcctctgactttgttttgctttgcaggactacaaagctgatgaagacccagcattattccagtcagtcaagaccaagagaggccctttgggacccaactggaaggtactggatgctgacctttctgacaggcagagtcttggcaacagaacacttgacaggtcctgagtcttgaagagctggtgacgtttaagtgaaaaatagaaatggcacaaaaatagttttatttgcgataaggacttacagccagttgcagttggccagcaaatctgtgctgcattaacaaacagaacagagccagactgtcactttcagcataatgcagctccaataactcttaaaagagacaagtgatttagtctttggggattctaatgttctcttttgagacctgaagcagtataaaaatccattttaaatgaaggtttatagtttaaatttagtcttattaaaaactgaacaagctcccttcacccaagctcatattcctggacttttaatagttatatttttggaaagcaggacacgagtgagcaatttttgtggcaagcagtttttgtttttgttttgtttttgagacagagtttcactcttgttgcccaggctggggtgcagtggtgcaatctgggctcactgcagcctctgcctcctgggttgaagtgattgtcctgcctcagcctcccgggtaactgggattacaggcatgcgccaccatgcctggctaattttgtatttttagtggagacggggtttctccatgttggtcaggctggtctcgaactcccgacctcaggtgatccacccgccctggcctcccaaagtgttgggattacaggcatgagccactgcgcccagccagtagttgtttttaaataaagtgcacacccttactttattcatggaagtaaggtaatgtcaaggtaataatttaaattgctatagaaatataatgcattttaaagacatctactaaactaaatgacagatccttaaagaagtcttaatgtgttattggcaagttactacagctaatttgacaagagaagagcataaaaacttaaacatgcccagagcagattttccactcccagggtcttacttggtaaccagtctgtctgtgctgaagccagttacaggtcatcgataagtgatgtctaggtactagttgcatgcagataagaggattactgttacagccccacagagaactcattgagtggttctccctgggtgttagactgttttgtggactgtcttgtgcatcaactaaaaggaaaaatgaatttgactttggtttataagaaatgattcataactatattattttcacatttgttctctgggtagagtttagttcagaattctcccagttttaatacttagcatgttaggccaatcttgcattattacaaagaacctgagaatgggtattatatataaagaggcttgggccaggtgcagtggctcacgcctgtaatcccagtactttgggaggctgaggtgggtggatcacttgaggtcaggagttcaataccagcctgggcaacatgttgaaaccccatctctactaaaaatccaaaaattagctgggcacgatggtgcttgcgtgtaatcccagctactcaggaggctgaggcaggagaatcacttgaacccgggaggtagaggttgcagtgagctaagattgcaccattgcactccaacctgggcgacagagtgagactccgtcccaaaaaaaaaaaaaaaaaaaaaaaaaaaaaaccaggcttaattggctcacggttctgcacactgtataggaagcatagtgctggtatctgcttttggggaggcttcagaaagcttacagtcatggtaggcaaaggagaagcaggcgtctcacatggtggaagtggggcaggggaagtgtgccatgcacttttatacagccagatctcgtgtgaactcagagtgagagctcacttatcaccaaggggatggcccaagctattcatgaaggatctgcagtcatgatgcaaacacctgttagaggctttacctctaacattagggattgcatttcaacattggggattacatttcagcatgagatttgagcagggacaaattcccaatctatattacccagaaagtgatatataccacttataaattaacaaattcagcctgcttgatgtaaatttgctttaatggatttagtgtccccagccttttccagatttctagcttcagactttagaactcaatcttagttggaggagaagccctttgagatttcacactggtcttctaaacaaggacaccatgccagagagcagcccagatggtggctacctccactggtgctgtaacttctaaaaaagtacatcttgttccagtgagtagtagctctagctgacaatacttttacagggagtaaaggggcatgaggttgagacccagaggtgaattaaatattgtattttcttgaaattattagcttttcaagtataaacattaaaagacaatgctacattatgtggtgggctttatgtttgggctcagatccttcctataggaactcctgattttataacaggcagcaaaagtagtttgatactatgacttgtactgatttctaactttttaggaacttggaatatataccatgtctggcctgatttgtaactgatattgctttgtcttttattattgactaatgattgaaattctagaataggtttagttcttagaaataatgtgaattttgtatttctgcagattgcagaactgcagtttttttccattttcccccctgtgttaaacagtaacttattaggctgatagggtgctggttgtttctgcccatttgcctgttgattgttcattttatccagatgatggtgtatccagctactcttataaattcagctactgcctgactgaatttctgtgaattactgtgatctcagaaataactagtgcagtcaagaataactgataataattaagccatccacttgctgctgtggagggaaataaagcgtaagaagatagctgataatatggcatacaggaaaataggaacctttggacttgatcttaccagtgtcttctgtaaacatgttcagcaggccctctttgccaattactgtcctggtggaggcactgagggtagcactggggaacgataatagttggaaatttttatacttctgaaatgcaaggaagaaatagggaacaaacatgataattatggctgaaaggaagaagaaatcttattgtggacccacttaaccagggtagtgttgaagaatgttcttatagaagagctgcctggtagttccacagtctctctctcaaaaggcctctgtgaaccatcccacacatacccttcagcagaaacctgccttaccagtacagattccaaagtctattcaaagctaaatgcaaatcctatgatttctttgaaacttttccttacttgtctgatggtggtattttccctctgaattattgcagtatttacttcctgtctgcaccagactgactaggggtaaagaaacttttccttggtaccaggtactatacaaggttacatttaatctttacaaccttcctgtggtgtaagttcagctgctttattttatatagttgagaaacttgggcagagaaacacatgtaatagttgtaggagaaacagcagaatgtctgccatttctggaacacctgattcggtggtagttacagcagtgtgtaaggtatggagatgtagcagattttaactcttaatccagtgactcctagatcaccgttctgtaccttttatgccctgttgcatcattggcaattgtgtgatgccctattcatggtatttgccagaatttgataatttctgttacactagtggtacgttttcaatggtcagggaatctgtaagtgtcggaggcactaagggagatccattaaaaagccactgggaatctacacaagttataacttaaccctcactctgagccttgatttccacatctccaaaatggaaatgattttagtaactacctcagaaggtagttgtaaagactgagtgaaataatgttaagttcccagcacagaagaagtgcacaatcaatgttaaccgttattgttataatgcttttgtctttcgtctcttggggttgctgagatctataaatgtgcccctgtatttatgatgcgtaattcttatctgtctagtattcagagttcccctcattctagaatgtgttcccctcattctggtatctagggattgttaaacacatccgggttcacgtgtctttacccctcgtggttatatatgtttaatgagtgattttatttggtcatgcataaagcagagagccacacagtttagagaggattcactagcaggggatgatgaggttgctaaggaatatattttcatattttccacatttgttaagagtacagacaatttttttagcctatgatgtgatacatatcttttatttttaaaaaactacaaacccagagatgcaggcctcagttgtatatttattttccctctgaagaaagaatttttaaaatctgagtgcagaaattatatttttgttacttagggttcggcacttgatgaagtgactgtgtgcatagtaataggaaagcgatttataacctgattaagatttttgcttcaaggcagaattgtgcatttctgatggatgttaatgtcttgtttctctatagcactgtgtgcacgtgtgtttgtgtgtgtgtgtgtgtgtacctgtttccatttgtttttagcttttcagtttcccttcctgatttgggtgaggaattgttattttaacagattgaaacactacctttgacgattatggtttcatttttatcccatggcaaggcctcatttcttccttcatttaagccagacacctcttgaagatttaagcttctgtgtctacaaatacatgatagttaataattaggcctctaaaggtctttgtaagaggctttgtcaaagcgtctcttccttatagggcttgatgtgtctcggaagtctcagccagagctctgaactttggaatatataaggggatcaggtcaaataaataagttgatccagaaattatggtggtttttaaattatctttatgtacatgttctttctcatcataaaggcatgccccatttgtcttctgtgttaactctagcctgagcaaatgctccagcagtccgagcttggcctttcagtttttcatactgtttagctgctcagtcagctttagactcattctagaacagccgtagaggccattctggatccttcatgccagtggagggaaaccatatttctgcattatagagatgttaatttgtttactgccatgctaccaagatttctttctttgtctaccccatgtctgtgaaaagatgttggtacccttggtgtcagtgacctaagataatgaaactgcaaaatttttttggccagggataggaggagtagaagtgagtgatgagggagaagttgaaattcaggtgtggaaatctcttttgagatagagagtggcaggaaagccacccagagactcaagtggcttatgagcagtgttttttacttgttagccgccctagtagaaacactgggaggtgctctcttgtttcttagcctcgacttgtctgtgaggtccagggaggatacgaagcatttgaaaacatgttccctccctgtaatctcacatttgaaaccccatagtgggtggcataaagaggcttagtaattagtttctggttagaccacattttggattatgtataataaagcagaccttcaagcatggctgatttttttttaatatctagtttgatgactacattttttatttgatttttaaaataaatatatagcacatagtatgtactaattatattaactcctacagaagataccaaaaaaaagctgttccatgtctttaagaagctaagtgcccaaagagtgaaactgattaattctaaccttatcttggctatggaatgtctctgttctcagacagagttgaaggattcaggcacagacgaatgaatgtcttattcaggttcaagaagtaatttggcagtgtgagcttcttgcagattcttccagacacttccagaaacaaagttttcttcatgagtttcatttgaaggtgaacttggggttttacttgaaaatagtgtcactcctggagtaatcacccacaagcatgaagcatttaacatagtcctctttagtaaaatgggtgtgagccatacaaaaaattaagtttggaggaacatggaaaatgtgactgattatcctctcacaggcagtaagctttcctgtctggatcttatttcgcctttttgtgaaattagattaacctacaattagttcagtctttttaaactcacatttaatctcatgtttacttcttccatttaatattttccatttaccccaccagatgggacttccccacctttgaatgccactagagtcttgccgatgaccttctcatggctcccagtgtgtcttgggtcagggtggtggtttatgtattccccctgtcttccttccccccacctcctccatctcctgttgttcacactgaattttaaacggtaggctttgtgtctgacttaccttgatatgggtcagtgccaagcagggaggtttgctcatagtaggggcttgtaagtatttgctagattcaagttaactaccttaaaccaaataaaaatcaaatattggacttcccatgtatttacagaaatataatgtccaatttaggtctgtccaaatggctactaaaataaatggttacctaaataaagtttaggttacctaaatagagagaatagctgagttggggaatggggttctgcttgaaatttcagtacatagacgtcacatatatttcgtaatcttgtgttgatatttactgatgcacacacactggcagcactcccagcagtgcatttatttttaactttcttggtgaaatctgggttggaaacttaacatcacagaatcagcagctgaaattaagcattcacattgcctaaaattgaaaaatgaaaatatgaagacagttatgagccttacagaaactgctgtgtctttgcaaagcgttaactctggttcagtgtagcacatacctattccatcttcatcccaacacagttttaaataggaaaaagtatgtgtaaacttgacaagtctcatgaaactgaagggactgtatttttagaaaatacatttccagaatgcctttggattctttttaaaaaatgttaaatctcttttacgtttgtttatatttgtttgtcacagattcgagaaactagttcttgtggataacatgtactgattgctcactcctccagttaaacacactgtgttttgtttagttacattgtgtgcctctagtatacattactccccctaagacctcatccacataccttagagtaacctaatatgtgttgttaaattaaaaacatgactcaggcttgggagtttcatttacagttagaaacatgaaatgtaaggaattcagtgaatatacaaactatttaaatacaattttggaaacatttcacaactagtgcttactgtattacagatgaaatttaaattacgtagcaatgagtcataatttgaggttcttgttagcccatgacgttcatcttgtagaacttttgattgttctctttgtaatcaaccattctttacctttttaagttgtccttttaaattttcatgctttatgtaaaactcaatttattagcaaaatcattttatttactcgcagattagcaaagagttaactgttttgccttagaggaggaaaatgttaggtttgggctggattggagttatgtgtcaaagatcttaattcagattttggttttatttgctttggggttgttttttagccaatgaagaagaaagaatcagaaaacatttttttaaaacttttattttaggtttgggggtacatgtgaaggtttgttatgtaggtaaacacatgtcacggggatttgttgtacatagtatttctcaccgcccgcccctcccctgcccatacccaatagttatcttttttgttcctctccttcctttcaccctccgcgcaacatttgtatttttttaaagccagagaggaagctttgccttgccacaggctgtgaacctcttgagagctaggcagagacgctggaacttctttgggtcctgtggattctagaacattgctctgagagtggggtcccaaatatttgccccattgagatttttcacattttaaaggttacacatttcttcactagcatgttgctgataacctagaagagttgatcattttattttgcatgtataccttgtgattgctttcaagaaaaattaaatatgggatggactaaagttacgtattaaagatcttaattcagcttttaacttgattttgtttagctttgtttagatttaatttattaaacatcagaaaaaagaagccaaaagccagattgtttatagtgaaagaagaatgaagacttgaaatagtacccagataatttagggtaaagttggtctttgtccgaaaatactctgctgagggcaaaaaaacttctttagagtcaatttgtttttcagtgtattaggtttttttaaatttttaaatgataactttgaaaataattgtacacaaaagaaaaaaattagttgtagtctcatttaattactattatttggtatattttctgattcctgtagtttattttgttaggaatgtttgtaccatacatagatacctatttatattaattctcctttttttctcccacattgttaactgttatttgaatttttttctttttttttcttttttttgagagtttttttttgagttttgctgttgttgcccaggctggagtgcaatggcacgaactcagctcactgcaacctctgcctcctgggtgcaaacaattctcatgcctcagccttccaagtaactgggattataggcacccgccaccatgaccagctaatttttgtatctttagtagagacggggtttcaccatgttggccaggctgatttagaactcctgacatcaggtgatccacctgcctcggcctcccaaagtactgggtttacaggtgtgaaccactgtaccgctggaaaaaaatgttttttaatggctgtatgcataatagcccatcgtatggaaggcctatgaagtatttcacctgtctcctgtagtgggtatttcagttaataattaataagtccagatttttgctgttaacagataaatctgtggtatcatttctttacttgattaataggatatgtttctaaaagtggaattaccaggttacagggtacagggtaggatatgaacagcttttaagactttttattacctagtgtcagatttcactccagagagaagataccaaaaggattcttttaggttaatgtacgacattcagacattttcactattttctgtgccatcataagtatggagactttcaaagccatattcttaacttaatcagtactttaaataactgtagctcacatttaacagatgactcccacaaatcattttgagaattgtatgagaacttttagatatcatgtatacattaataataataatgattgaaaaaaatgtatatagcttgtgtgttctcaactttcttctggtaatgtttatgtttttaggcagcaggctgtttagttgtttgttttttagttgggtacgtgttcttctctgaagggtttttaaaaaaataattacttgtaaattggatggaaaacaaaaatcagattgggactgaatatacattttagatctggaaagatatcttagggaactggttcctttttgtcccgtggcttatagtttctaaaatgaattttatagaacaatgccactttatgaattaccagtattaattgatttgagttgcttgccagagtcactagaaagaatgtgagaaataaacttggttgattgttgaagtcacgtatgtgtactctgttcttggagctcaagtttagtgtaggcatatttgtattacatttagcttactcctttaattagaaccatgcttcatcccactgtttttataaaattgctggagaattctgaagcatcagtgttctaggtacacccaagattttcatttagtagaaagtgtccaatgatttgaagttgtaaaagaaagctttcaggagctcataattaataggaccttctaatgttcaatctggaaagtatcttagagttcatcagcagtttggtggggtactcagtcatagaggaaattcactatgggtgggtgacaggcaggggaatatttcctgaagcccaggcatattacagaataaaacacaaaattgtaggaagttttaggacaagtcattggatgtcaaggatatgtaatgtttaccacctacagccctagaccaatcctggccctcaaggaccttagttcgctcacccctgcttttagtttttcctcagtggagaatgaaaagtcctgatagagtctagttttcctgttacagagggagaaatgaggcccagagagaggttaaggatcctgacctttgttaaacaggaagtttaacaaagtagcactcctagtctagtgctactgtttggcagctatatctcacaattaagtgccatattctacatatacccaagttgtattgcatatgaggattttcagtgacattcattggattaggaagtacttcagcattggctcattgtttattgatcaaatgatctgtgaaagaccaactttgttgtcatttcaataaagctgggcacttagaagctagctgtgtcttatggaaggcttgttgactgcttctgcatccaggagcccagcttaagtgccaggggcctgcagagcaaggggagtagtatgtaaatatttgattttagcccaagccagcatccacaacaggaggatgtttccggggtgagaatattgacaccaagggcagcattatttacataattatcctcttctctattagctacatttatgtcccctgacagcacctagcacagagtaaagggtaaatggtacccacttcatacctgctgaattatattactaaaatatgggtttgtatgtgtgtatacatatacacatacacatacatcctgaattttcacattggtactctgttttaagggggaaacgtcatggaaaaatagagctaagctagccaagatattttgttaacagagctcacctgcaagagaacagtttactataatatttttatttaactgcttactggtgttacctcgttgatgtagcccatgtatcaggttattcttcagaagatgaaatgttactacagaacaaatatcttgagaaaagttgatcaatcatgtaggactctatagaacattcagtcgcattaataataccaagataataatttttcatatagtatatccctagaattaacttaaaactgggccatggtagataatggggaaaaatgtagtctggtgcttcagtcatataaaggaaaaataatcttgaggtttagaataagacttagaaattaatcattttttgaatgtatgtggccgatttgagaatctttgctcacacgcagctttttgaaagtgggatgagttgaagctggtaagttgaagctgacaagcagtggtggcagcacccagtgggactgatcactggatcagtggtgaagtctgggcaccaccgtgtgaagacagggacagtggtgaagagggaagagcccgtgggagaggcagctttggcctttgactcagtgatttagtttttataaaaggggtccccgtcgtgttgcagtgactttcttctcttatgaggcaatttgttcaaaactgtcttgcagattcaaaagtggtcaatacaacgtttattaaagaacaagggaaagagagaactaatgtgtattaagcccttcagtctcacctactaagcacctactacactgccttactcagtccgcacaacctcacaacagtcctaagatgatgtcccttttttttcttttaatcatcttgtaagcacaccaacactggggcttcaagtttacagaatggctcttttccccagaccatacttgcagtctgcctctgctgtctgtggtgctttgatatgtgccttctgtagtagaccgagcccctgaggacaggaccatgcctgtgtttgctcactgctgtgaacctgttccaggcttttctgggtcagctcagaagtatcttggtcttctgcacacatcaccttggaagtggacctgtatatttaagtcactgatgtatgctgcaagctcctggttcacacccactcactccttcctgaaaataaacatgctagtatattgaactcactaagtaaggcaaagccttagtaagactcacagaaatcatcaataataacataggttgcagtgccccacctcccaccccagtttatttatgtctttattattattattttttgagatggagtcttgccctgtagcccaggctggagggcaatgatgtgacctcagctcactgcaacctctgcctccctagtagctgggattacaggctcccaccaccacccccagcaaatttttgtaattttttagtagagacgggatttcaccatgttggccaggctggtctcgaactcctgacctcaagtgatctgcccacctcggcctcccaaagtgctgggattacaggtgtgagccactgtgcccagccttttttttttttttttttttttttccagaaatggggtcttgctatcttacccaggctggtctccaactcctggcctcaggtgatcctcccacttcagcctcccaaagctctgggattacaggcatgagccagtgtacccagcatctcttggctctttaaaaaaatagtttattttcccttgtttaccagaacaagtcttgatttgattcctgactacactatttaaactgtgaggtgtagtcatttgtggaaattgaagtctgtatgtataggatttacctccaaatatttggtaattacagattatttttgctgttgcatcacttttcatatctcccttctattgaaaatacctcagttaataaacagtgcagctccacttgccaatatctgaagatacagaagaaggctgaacttccttgtcattttttattgtgcctcaccacatccacagtgggagtgcggtaatggtgttatgagaacccttatgtattaaagacactattggtttgatgtgaatagaatttggtatttaatatgaaatctgaatagtgttatttgaggcagagcaacatacctattaaactttagagctaggaagtaacttggtctgtggaaggagggtttacagcaggggaatactgcggcttttgctaaaatgatttcaaattttcaaatatctgaattaaacacatgagattgtaattttcttcatgtatgtctatgatgtcgttatacaacagtcaattttaatgaaaacataaatatttaagtcataatttctccttttcaatttttctcatctagaaggagctggcaaacagccctgactgtccccagatgtgtgcctataagctggtgaccatcaaattcaagtggtggggactgcaaagcaaagtagaaaacttcattcaaaaggtaaaatctgctcaaaatgtggtgacttagatttaggatgagatcggagctagctattaatgggatatcttctctgttattactttttttcctcctttatgatatgaaaattattgtccctacataattcatttcagcccttctttatacctcaaagcagcaaagacagatggcagcagaggttttaagggactttctttggagacaagcacagcagctttttgttcaaagtgcttaccttatggtttgcccagcgcttctgtagagaaccctttccccatacagcacgtccccaagaggacctggtgttctgatcctgactggagggagagagcgggcccagcctgctgaaggactcccctgccccatctcagctggacccttccccctaccctccatatctctcagaatatgtatgtgtgccttgtgctgtcacaggggatgtcttctttagaggtctttactgaaaaatgggcacactgtgaactaaggtacacaatctgaggatccagattctacttgtttcttttttatgtcttctttattaaagtgaaagtaacatgggcagttagatctaggaggaggggagaattggaattttataaatgcacacggttgttactacctaggaatgttgaaacatttccttggtgtttacttttcctgtagggcgaatatttattctgttattattataaagaagccctcattatatctcagatctccacaattagttatgtctgtttcatcataacttttctatttttaaactatagctgctgtagtattttataagacaaggatctcaaagtgctggaaactttgattattcatgggcctgcttacagtcagcattctgtaaatattggcattcttccttcctctcggatcataatcatagattaacaatccagttctgataaatagaagtcacatatgtaattgataaagtcctttctattcatggaagaagatttttaagttgaatattgtccagaagtacttactgttccatgcacttttctctcttcttgggaaagctgaataaaacttaaataatccatcaattgaaaccgctaattatatacatggtttttaaatatatttataatagtggcagcaacatgttgtgtagaaaaattaagggagagtttgtaatgattcttaatttaataaaagaacccaggactcttttctttcaatgcattattgtattccacctcatagtgaatgttaagaatgacaatatatagttttatagcagaagaaatctagttgacctttgctcattgacatttagaaaaaggtaaaaataaatcaggcccagcaggaatgtgttggattaggtcatacacaccgcatttttttagtttctactagatcatgacacctttgcctaggagattatttttcatttcacagggaaagtttttttttgtttgtttaattttgctggacacaatgataattaaatggaattatgatttccacaaatctacagagtagtctttttgaaccaaatgtgtaaatttcatgggttaattggaacatgtaaagttaatgtgtcattaatcttaggtttttgtcatcttatgctacttttttgttgttgttttaaaagcaagaaaaacggatatttacaaacttccatcgccagcttttttgttggattgacaagtggatcgatctcacgatggaagacattaggagaatggaagacgagactcagaaagaactagaaacagtaagactggctgttctatggcaattctctaattttcccttttctaaaactgtatacatgcttggtaaatacagagttagaattaggaagagtgttgttaaaaatcattccctattctacttattctcatcaaaatggagtttcttagacactgctattccttcacatattctgatctctcttttgttgagcatcttgcgtgaaggtagactagagttttctcagtctagaattggttacctgttaaatatctaatggttctgtattctttcttacacactagctttagttctgtaggctggttcctggttcacagtcgttttagacactttgtcagactaagttgcttttggctcagtttgtatcacagcaagcttaacaaatgttaacatgataagtcctagttcgctttttttgtagaaaaggtaaggctaatggtattgttactaattctggaaatgcctcctctgcttcccccaactggcagtgatccttatttcttcctaagctttgggcagattcaggtgatccttgggcaggaggtcagcatgccacagttcagtgttacagcccatcccagctgctccccaccaccagtgggcagggccggcagccagtgggtgtcttctctctcctcgggatggattcttccctggcttcctcttgcatgtgtctggttttgtttttgccctgggccatgcttgtcttcagttggcagtaaggccccatgggtgaaacaaacccaaggaatgtccagggcctgctagtggtttccatgtggtcatctcgagtcctgccagcaggtccagttttggaagccctgcaggtgtgagcgtttgacagacgcctgcgtgtgaggcagaaactccatttaatcacaggagaatggcagcaaatcagattctttggcacaaaaggaaacctatttttctggcacatagcatcgtaaagaatctgtttaaaattgcttacttttggtgattacagcagatctgcttctaattagttttatataaaccttctgagaggactaggacatattttctttataaggcaataaaatattttaaccttatcttatacataaagtaaactataggcagactccaacttatgaatggattttgttccaaaaaattttaagttgattgtttgaaatttggaacatattttcccatagagacaatgttataaattagggtttggtttctagactagccagcataatatgcctctttgaccccaatttctcatactaatattaggactctgagttctggatatagggaatagggtgatgagatggcaagagtggaagatacccccctcattccttatttttagtctagccacaggcaaaacacttaaataggcaagagcagatcatgggcacttcctacctttctttctaggcctctctcccacttctgtgttccctttttcaagagtcaggtgcctttctctgactctaacaagcacccccctggccctcgctaccctatccagttttagtcccatttgccttgtctggtttcactccctccaagtgcccaaggcttcaggaatacctgccagctctgcctttggctcttccaagcagctggtgggtgtccactgaacatgaaacagaagcagcaagagacacccaaacacgctaagcccatgatgcagcactggcatttcctacaaggatttaccaacagctcaaacccttgggaaagagcccttctctcagtttttaatttttatgctgaagaactgtgtgtcacatggggaagagtagttaccattgaccaggtgataagccctatctggtttggactctaaaccctacctatctctggaccccttggacagaacttgactgagatttcttcccccagggaagtgctcttgcttctctaacaagtcctcagcctcacgatacctgaacacagaatggtcccagcctcaacacgctgtgaccctccgctgtggagctggtgactcttgctctcacctatggcagtgggcctgcaggtgcagctgctgctccatgcagatcagttatttgtgagttgggaattgcactcgagaagaaggtgtaagatagacaagtaaaagcccaattccttagtgtcaccattcttatacccacattgctgaaactgattaaccccctcataaagctggtggaaaatctatcattggttcagagtgagggtacatagcagttgctttgtcaaatatctcaaaaacattttaagacaaatttcaccattaagtggtgcatcttaacgttgaatcccatttaagttattttgctgtaggtcattggggagtgcttggttccacacacagaatcaagatgctgctgctttgagtcctaatggtggctttgtgaaagcatcctcagaatctgggcagcatcaagcctgcaggccaagaatgcctacccagaaagcacctgcctcctgaagaggcatcccattttagagtcctcttcacacgcagaaatttctttttccttgaggtcctgacccctgacacctgatgatagattttaatgacattataatgctcttaattcacaaatattttaagaattggatttctttcaaatgggttttggccctggagagaactagcatcttgagaggttaggcacacgaggaatgcccctgcctatgatctgcagggaactgccctggagttgaggctcagcagctgaaggaggactttaggtaaacattttacctgtttgttcttaactggcacctccggttccggggtgggggtgaggatgtgttgagttttaacgtatttattgcatttgtttgttttctgttcatttcgttttttgttttctcattgagtggtgtcacttgtctggaggctattgttatgaatgcctgtcctttctaatacatctgtgtgcccttcatggtttgccatacattgtttctgtgcttgccttttctccctttcattctccctccttgccttttctccctttcattctccctcctttcagtaaacttcctttaaaggactccactgagagaccctgttctcagaagcagcaaagaggtgtggcccacaccctcatggcttgcttgtctggcctagggactatgcaaatatggaccagacccttggggtattttctcacattatattggcaaacaatttgtttacccattggctgtttttgataattttttatcagtctgcaggcttttgttttttacagttaaggatagataaaccttttttgtgctaagaaaagccttttgcaagaatgtcttcaaaccaaggttatttgaggggccacagaacttcattcttaatgtggatatggttatgaacatcacttcataatctcttctagatcttttttctccccttgcttactaacccctatttagagtctgatttcagcagctcacaattttattttacgtttagatgcgtaagaggggttccgttcgaggcacgtcggctgctgatgtctagatgagtcccctgtagggtcagagacaatgtcaaactgtgtaagtgaagacctgggtaaaaagatgtttcgaaacctgtacctttttggtgatgggcagttaacttgctgagcagaagctctaagtgttaaatgtggttttatttttagaatttaaaagataaatattttagaaattaatagtgaacacttattaatagtctttaaaaattttacctgtggaccaggttgaatttagtaatcctgggttagtttttagtgttatgggttagaacccagctgccaggtgctgttactcatcatgtagcacattgtcctggaagccagctgatttttcaatactgagttaattgacctggttctttgtagaaccatttgtggttagtaaggaaatatgcaaaatcacttgagatcaaataaagatcctctatcccataccatacgagccaacctcaataatttattttggctgcaatattttctgtgcaccagaaagtcttccttgatatttcgtcttcagttgttacagttagctttactctgcgtaaatgcactttagttttaatttatggtgtgaaccatttttgtggtcttatttctctaacacattatatgcccatataacaaattttcccagagatgcaaaaaaaaaaaaatcaaaatctccctcacaaattgaaaccagtgtgagtaaacaaaaatcaacagtgtgctgtcatcatttgtttatactgaactataatgtttattataaagagaacgagatgtagcactcccctccctccactgtggttctttgctgccccacatgagctacctgctctttaatttttgaacattgggatgaatgaaatgttcagttgtgagaaaagctagttgtgccaaataagaatgaagtaactcttccaagattccccccaaacacttttaaattccatgttcattaaaaaaaaaaaaatttaagttattgttacttttgttaaactctcctaagtttttgtgatttatttctgcctcgactttattttcccctctgatgagacaatatattgtggcattagtagtaagaccaaaatctttttgaacagatgaaaattgtaagatgcagtagttggggtacattttctgccaaaagttttgatgcatttggagagtgtgtgtgacgagctgctaacatttcctgtctctgtattttaacacattttgcactgtctttcacttttcttacagttacgtaatcaaggtcaagtgaggggaacaagcgcagccagtgatgagtgaagaagaatctgaccagtatcttgcagtgttgacgtttcccagatgtgtgcttgtgatgatacacacacatgcacaggttctcaaccacgtgtgtatatatgtatgtgtgcatatgtctgtagctgtatataaagcgcatgtagagctacagatccagatacacacacttgtgtatatatgtacatacagacatactgaagggattagtacaatttctccaaagtactgtacctatcttcagcaagaatgcaaaagaaaatattttcaatatatatacctggaacagattttaataattatcagagtaataccattaatggacaaattgactgcaatgtaatactagctggtatgtttcataaatgtcaagctgtggaccaacatatatagccttttattatttttctcttcttttaagtcagtctgttataaatttttttttagtcccataagcagtagactcccacagaaaatttcttcaaaattttttggtgttccaatgaatctgggatgtaaactctgaatgtatttataactatttatttctggatggtcattatcttgtagccaaatttgacaatataaagtaaggagcaaagttacaggccagtttttacttgtttgccctgagggaaaaatccttttaaaaaaaatttctggtttttattggatttttgtattttaaatttcaaatatttttctacatcaaacctagcaaaaatggagatgacggtttctgatttataataaatactagacagttttcaggctcctgttagacaaacacattgatgaagaaattagtcttaataggattgtaggctgtgtagaaaagttggaaatatagcacttcatggagtcttgttttgaagatgacagttttctgtaactacagcttggaaactatgcaaatggtctagattcctcagagctcacatgataggatatagttagtgatgacattttgctcttcttgtgggaacacacacttcaaggaggagatagtgactttgagataggaacagtttaagatgcagtgtgagtctggcctgcgtgcggtgaggaggccccgccaagagactggtggacatctgactgtgggatgtgctctcaagtaggacgtcatcaggacagattctgaataggcatcatgagagtgctggtcagaaacggctgccactttttttaatttaattttattttttatttaaaggaaggaacaatagctaggtaagatttttatcagctttctctgtctgaatccagtttttcctctgtcagtcctggaagcttgaatagaattatattgttgaagccttcaggtcacaaactgtcttttgtaacctcctgtccctcctaaaacacgccaacccctgcagtcaaatcacattagtaatctgatttgctgacagtcctgccctgcctgctcctcgttttcccacatgtcctgcatccctcccccactggagtgatttcagtgaatcagacaaggaaggatgtgtaggatcactactgcattgcaataccctgttatcctcagcaacaaaacccacatttcatacatcctttgtgtactcaggataaagactgatgtttactctctgggcactgttgtaagataggttttgtcagagcataatcattgtctgcaaagtgtttggtgcgaggaagattattgctaattttgtgaaataaagagtctagccctctccttttaatgaacttaactctcgctggcatctgtagtatcattgggagcttaggcgcacatggaaatgagagcccggcgcatggattttaatgtttttctaacaactgtggagatttgagggaatgtgtggtgaatgtaaaatacctagtttacttgccagtctcttgtgtaaattacagtaaaacaaagtaaatgaaatttaaacaaaaaataaatttgatcacaaaatgcc

SEQ ID NO: 36187 - DNA, 4396 bp, Homo sapiens
gactttggtggcaagaggagctggcggagcccagccagtgggcggggccaggggaggggcgggcaggtaggtgcagccactcctgggaggaccctgcgtggccagacggtgctggtgactcgtccacactgctcgcttcggatactccaggcgtctcccgttgcggccgctccctgccttagaggccagccttggacacttgctgcccctttccagcccggattctgggatccttccctctgagccaacatctgggtcctgccttcgacaccaccccaaggcttcctaccttgcgtgcctggagtctgccccaggggcccttgtcctgggccatggcccagaagggggtcctggggcctgggcagctgggggctgtggccattctgctctatcttggattactccggtcggggacaggtaagtgaggacgtgggggcagggtggggacaatgcactggagggagccggcgtgatcattttctggggtgtgcccttgtctggggcccaagaaaacccccggcctccctagctcttggcctctctttcccaccttggctctgtcagggaaggggccagccctctggagcagtggtgggtactaaggggtcagggaacccgagtcttccctactcacccctcctctttctctttctttctaggagcggaaggggcagaaggtgagactttcctcggagagggaggaggggagggggaggtgacttggatcggattcccctggggtttaaccagtgcctggccttcagctgggctgccttccaactagattctcttagggctcccagagtggggggttttagccctcaccttatgggcagagaagcagggacttgcccagggcacactgccagtgaaggtgcagctgggattcagatccacgtctgactcccaaagtggggcaatcgaggtggtttttttggtttggtttttgtcttttgaaacagggtctgggtctgtcgtcacccaggctggagtgcagtggcccgatcgcagctcactgcagtctcagtgatccagcctcccgggctcacgtgatcctcccacctccccacctcagcctccctagtggctgggactacaggtgcatgccatcacacccagctagttgtgttttgtttttgtttttgtttttgtttggtagagatgtgggtctcactatgttggccgggcaggtcttgaactcctgggctcaagcgatcctcctgccttggcctctcaaagtgctgggattacaggtgtgagccaccgttcccatcctggaggtggttttgagggaaccaaaccaagggtctcctttcttggaaggcacccaacccagctctgagtcagaccggctttcaatcctggcttccccatgcactggctgtgtgtcattggccaagtccccccacttctctaagccttagactcctcacctctaaaatgaagctggtcatgtccgtctcctggggctgtggagaggatgcagggagatgaggaagcgaaagcccctccagggcctggcacagccgctaggctctctaaatagtggctattgtcatgatgataagggagagaaagatctggtctgcaattttctctgctcctagatgactttgtgaagagcagttgggctccactccaaagtggcctcaatgggggtggggctggggctgtcctggaaactagacattcacatcacaggagcccagttctgctgttggtttgttgaatatatgtccacgacgccacaggcactgcagacatgagaatctgcccctagggaatgcccagattggtgtggtggaaacagacacagttgtggactccggaacaattgtgagactgggcagcatcggggagcatggtggaggttggggggtgctgggctcggaggcaatgcccaactcagccagcagaagcccgcctgtctacggaggggctgctgttccaatcaagcatccacaggcaaagggaagtttgccagacagtaaggatggggaagggcataccaggtagagtgacctggatcagccaaggtcccgggtaaacaagtgtgtggcctgatgtacacaactgaagggtccagaggggacggctgggtccgatggcggtgccatggtctgtctggaatgtatcttaaggaccgcgtggagccaagaagggtttaagcagggctgtggcctggtcagattgggggtttatgaaaatcttcagacttgtaaggggcgggatggatggaaggcttgcaaggagagaagctgccatgagacctgaattaggtaatgggtagtggacagaaggggcacaactgcccatgcctgggaggggacaaaggggtgttgactcctgtgaacccacttcccaagctctatatcagagctcctgggctgcataggagtggccaggctaacaacctgaccccttcccttcctccctgggcagctccctgcggtgtggccccccaagcacgcatcacaggtggcagcagtgcagtcgccggtcagtggccctggcaggtcagcatcacctatgaaggcgtccatgtgtgtggtggctctctcgtgtctgagcagtgggtgctgtcagctgctcactgcttccccaggtaccaaatggtgaaagtcaaaagtgggctggaggtcaaagttaatgggtcaatccaggtcagaggttggggttcttgggttgggtctgagagtgtcagttctaagtctggaaggaccagttaggagtgaaggtgaggggtcagaggttacatgataaaactaaggtgcaatttgagacctaaaaggggctgatcggaatcaggggttggcagtgggggttggggaacaaggagaggtctcctgggtctcagcctttgccccctgcctgcagcgagcaccacaaggaagcctatgaggtcaagctgggggcccaccagctagactcctactccgaggacgccaaggtcagcaccctgaaggacatcatcccccaccccagctacctccaggagggctcccagggcgacattgcactcctccaactcagcagacccatcaccttctcccgctacatccggcccatctgcctccctgcagccaacgcctccttccccaacggcctccactgcactgtcactggctggggtcatgtggccccctcaggtgaggtgggacgctgggtgcctagaggtgtggaggggcacctgacttggggaggggcccagggtaagcctcttttacccccacagtgagcctcctgacgcccaagccactgcagcaactcgaggtgcctctgatcagtcgtgagacgtgtaactgcctgtacaacatcgacgccaagcctgaggagccgcactttgtccaagaggacatggtgtgtgctggctatgtggaggggggcaaggacgcctgccaggtaagcacaggcccggggggcagatgaccagtgcaacttcggaaaggaggcctggcccggtcctgatggctgctgtgtggcttctctcctcagggtgactctgggggcccactctcctgccctgtggagggtctctggtacctgacgggcattgtgagctggggagatgcctgtggggcccgcaacaggcctggtgtgtacactctggcctccagctatgcctcctggatccaaagcaaggtgacagaactccagcctcgtgtggtgccccaaacccaggagtcccagcccgacagcaacctctgtggcagccacctggccttcagctctgccccagcccagggcttgctgaggcccatccttttcctgcctctgggcctggctctgggcctcctctccccatggctcagcgagcactgagctggccctacttccaggatggatgcatcacactcaaggacaggagcctggtccttccctgatggcctttggacccagggcctgacttgagccactccttccttcaggactctgcgggaggctggggccccatcttgatctttgagcccattcttctgggtgtgctttttgggaccatcactgagagtcaggagttttactgcctgtagcaatggccagagcctctggcccctcacccaccatggaccagcccattggccgagctcctggggagctcctgggacccttggctatgaaaatgagccctggctcccacctgtttctggaagactgctcccggcccgcctgcccagactgatgagcacatctctctgccctctccctgtgttctgggctggggccacctttgtgcagcttcgaggacaggaaaggccccaatcttgcccactggccgctgagcgcccccgagccctgactcctggactccggaggactgagcccccaccggaactgggctggcgcttggatctggggtgggagtaacagggcagaaatgattaaaatgtttgagcac

SEQ ID NO: 36188 - DNA, 111733 bp, Homo sapiens
ggaaccgcgaccactggagccttagcgggcgcagcagctggaacgggagtactgcgacgcagcccggagtcggccttgtaggggcgaaggtgcagggagatcgcggcgggcgcagtcttgagcgccggagcgcgtccctgcccttagcggggcttgccccagtcgcaggggcacatccagccgctgcggctgacagcagccgcgcgcgcgggagtctgcggggtcgcggcagccgcacctgcgcgggcgaccagcgcaaggtccccgcccggctgggcgggcagcaagggccggggagagggtgcgggtgcaggcgggggccccacagggccaccttcttgcccggcggctgccgctggaaaatgtctcaggagaggcccacgttctaccggcaggagctgaacaagacaatctgggaggtgcccgagcgttaccagaacctgtctccagtgggctctggcgcctatggctctgtgtggtgagtgtcgctgggcctggggccgctgtgggcagggtggcccctcgcgcccgagggccaggcctgctccactgctcagcgttgcgtcaagtggcaggaattttcctcgggggagggcattgctgccccttcgagctctgcccgttctgcacctccagcacccctcgccctgcactcacgcaggtatgcggtccaccgtgtgcagcactcaggtccgctgcgagaggtaggtggtggtgctggagctcggttctggctagcaccctgcgccttcccctctcggagggttgctgctcggcaacaggcaccgggggaagggccgcttccttgggggtctccctgcctacctggagcagaaggaccctctcccgtgatgcgcccacgctggggctccggaccctgggtcctctgagcagacaagctcggggaactgccgggagaagcagaagggcacagcccaacccgaagactgcggtcatctgaacaaaactgaccaggaagggagctctctccgggcctttttttttttttttttttttcaaaactctgtcgaaatcccatcttgaaaagcgttctttttgaattcgcacttgaattaacagcgatccatagagcttaaaataccgactttatctcggtgagcactgtgccagcttgagtggtgtgtttccgattcggttgaaagcgtatttcctttccgtggaggggcggcggtggtagtgcctgcaagaacactgcagcttgagaaactggcaggctcactgattagtcacataccactgctcatttaagtattgttcgacaaaacaattttctcatttggagcaagaaagattcagatctgtaaggcgccctcaagatcaaaaagttattaacagtgctgggaggtattgtaaatattttttgagataattcctgcgaatactgtgttttaaaagtcccttagagagcttgcagggagttatctagttatctgcatttatggcctgaggtacacgatggttttcgtaaggatatggaaccacatagaaaaggaagggaagagatactttttagctttaatttacaccgtgagtgtgttttaaattaagtcgatagcatataatttccagacctgaaatatttcactaactgctctcttaacttccaaggttttataccctgtattttagattttctataatttgaaagctacggatcttaaactaagtatcagatttaactgttagctttttctgtgttttagtaattcgtattgtatgcgtcatttgaaaacgggcctgtaaaatcgtttttttgttttggaacaaattccaggcttttggatgtgttaatctttaaatatgatttctgtgtttcccaaagtcacatcatgaatttcctgtttggtagaatcttctgggtaattgagattgtgcaattgtgtccagcaacagatcatattgcattttctagttcaagttgcttaagttatgttgcagatagcaccgtgcttgacatctttctcccatttttacagcatggcagtttacattttaaaggaatttgcagcattttacattcagagagtgtgtgtgtgtagttggtttgcagcattttacattcagtatatacatattatataggtatatacattcagtatatacatattatataggtatatacattcagtatatacatattatatatatctagttgatttgctaattttcaaagacgtatttggatcattgctcttttaatattttatagctcattaatatacttccattttttcattcttgaattgacatacatttctgtagtatcacgttttcgttttcaatgctatttaaattttaatggagtgatacagcagaataactcaactatagagggtttgggtgaactccaattgaattgcttgcaagggttcgctactattggtgactagctctgcactggaacaggagattcagatttacagtgaagtaccattaaaattaactccacagttctttagtggtatacttttctgtggtatagaagccagcagtatctgacacttaaaagtacttttattttattgaacagattttttaaaatacattgacattgtataaaatttgaaagttttacaaaggtactcagtgggccgggtgcagtggctcacgcctgtaatcccagcactttgggaggccgaggcgggtggatcacagcgtcaggagatcgagaccatcctggctaacacggtgaaaccccgtctctactaaaaatacaaaaaattagccgcccgtggtggcgggcgcctgtactcccagctactcaggaggctgaggcaggaggatgatttgaacccgggaggcggaggttgcaatgagctgagatcgctccactgcactccagcctgggcgaaagtgcgagacgccgtctcaaaaaaaaaaaaaaaaaagatattcagtgaaaagtctcctttcctttttgttctccagccactctactctctcaaagacaggcactgttaagtgtcttgtgtctttccagagaggcagttttttttatttgcttgtttgtttagtagtctttctactaaagggatttaagatgtaacctacagcatattggtgaaagaaaatacaactgaaactgaaattgtatgacaattgacaataaacaaattataactaatgttggaatgaaaataccagaatttagatttacaattaagtgttatcttattcagagattcagcgtagttatttgaagtttttcttttctttgagacgaagtctcactctgtcgcccaggcttgagtgcagtggtgccatcttggctcactgcaacttccacctcctgggttcaagcgattctcctgcctcagcctccctagtagctgggactacaggtgcccgccaccatacccagctaatttttgtatttttagtagagacggggttctccatgttggccaggctggtctcagactcctgacctcaagtgatctgctctccttggcctcccaaagtgctgggattataggcctcagccacggtgcccagcctgaagttgttctttcaatgagtacctttttaggtgtggcagaaaacattttttggaacttcttttagaatccactttggagcctgtgatattcttcttcttttttattttgagacagagtctcattctgttgtccaagttggagtgcagtggcaccatctctgctcactataacctccacctcatgggttcaagcgattctcctgccttaggctcccaagtagctgggatacaagtgcgcaacaccatgcccggatgatttttgtatttttaatacagacagggtttcaccatgttggccaggctgatctctaactcctgacctcaggtgatccacttgccttggcctcccaaagtgctgagattacaggggtgagccaccgtctctggccatccatcttcatttttttgagagcagatttgattttagggaataacagttcatttgaatccaaataatttagggaatttggactcaagtctgataagaaagataaggcaatcaggttggtgatactactgttttaggtcagataggagttataactataaagtaacaacacataattttttgtgtgacttcttgaactggacctgaagtctacttccaaaaaaatctccgaattttattttatttatttatttattttgtagagatagggtcttactgtgttgcccaggttggtctcaaactcctggcctcaagcagttcccccaccttggcctcccgaagtgctgggattatagggatgagccaccacacccagcccctgaattttattttcaagaatgaaaataaatgaatagaatatttcaatgaataaaattcattcattgaaatatttgtcagtttccgaattttattgctctaaagtgtggtatactttgtaacatttacaaattattttaagcctatattattttaatttatactaagtatagtaaaaaaacaagtagaagcctgtgtgataaccaactatgaatcaaaatagagttttacaaatatgcctttccgttaaagggtaaagggaactagactaggtcttgcagttttaaggaactttatgcattgtctgtgaggggaaatgaagcaaaattgtttaagaatacattgttgcaaagcattgattttggggttttgggacagaaggggagaatctttgtggtgagtttaaggaaatacaaacaggaacttaagtgcctttcctctggggtagggttcttccaggcccttgctgttgattagaggaggtgggacactggtaaccatgaaataggaggtgacagttgagaattactcttagatcttattcaactgtttattcaacagtgtttattgaatacctaccatgggccagatagctaggttctggaaatagagtgctaaacaagacagaaacaagacaatccattctctcctggaacttacagcctagtgggtttaataactacattttgtggattgcttgctatgttctagcattgtgctgtgcactttatcatcagcataaaaagtatataacaaaacctttggtaaaaggatagcaaaacttgctaagaaatcaaatacaacttcctaagtgctttgtggaacaagattattctagtataaaagaaataagtgaagctaactttttttaactattaatggccattcaccattttaaatctatttttttttttttttagaatgagccagggcacaaagaaataaaagtgcatgattattaagtatacaagggtgactttcttgactcctgaccagtgagaagggtgtgccctttacttttctagtagtgatagtaggtccatgctgagctttccattcttttctttgtaaccaaaagtaaggtagttgcctgtatgttaccagtgccagtcaataagaagtctttaaacataattaacggcaagcatttgtattattgatgtataaagattgttttaagaaagagttcattcgaagctggctataaagtcattttattatcaaatcccatttttccacttttttttttttttgagacggagtcttgctgtgttgcccaggctggggcgcagtggtgcaatctcggctcacggcagcctctgcctcccgagttcaagcaattctcctgcctcagcctcctgaatagctgagattacaagtgcgtgccaccatgcctggctgatttttgtatttttagtagagacggggttttaccatgttggtcaggccagtctcgaactcctgaccttgtgatctgcccaccttggcctcccaaagtgctgggattacaggaatgagccaccacacccagcctccactggttcttctttaaaataagcttatcctggatctccaggttttcagttctgccagtttgatttcttgatactgaggagtactctgcttttgatttctttctagcccagtctcagagatgatgtgttgactttgcctttcatgggcaagagtgcagatattgctgagcccctggggcctagaattcaaagatggaagaattcactggggtagatcaccctcactttagaattaactgacatttttagggatttttgcagtttataaagtgttttcattcaaagcattatcaatcagttctcactagctccatggaggctcatatttattaactccattttatagatggggagctggactcattcattaaaggaatggcatacttgtcaatgctacttttagtagtctcctttctgatagatgtgggctgctgaggttgcgcggtggcaccttctcttatgcagttaacctcctcttgtgaaaaaggggttgctgagtcactcggaatagagcttgagtgtaggaaagcagttccaccagtgtcattgcccagtttatgtgaggggtaatgacttaacccatttaacccattagagtcatgtctcttcctcagaactgataaatcaaaaatgcactcattgcccagattaaaattttttctgaaggaattattaggcagtgcaaatagttaattcctgaatttatgaatcctattggattgaaattcttcagtgtacatttatgtaaagttgggactgtctgtacatgtttgtgttacataagtataggatataaatagaaataactgcctctccagccctttgaaaatacattagatttttgctttttgcagtaaaatttggggtaaaactgatttgttcttatctaagaggtataattactgcagtgctcagaaaagcctcattataaagtgggctcccctgacttggaacttagggatgtcttctcatggctgctatggaagtcatgcagctgtttcgtcaggaaaataaccaaaaacttctttaaacttggaaatgtttttgtaaaagaaactttcagtattcagagtagtttgtctttcacagtgcttccataaattaagcacaggcacaactcgttttattatgcttcacagataattgctttttttttgcaaattgaaggttagtgacaaccctgtggtaagcgagtcttttggcaccatttttccaaaagcatgtgctcacttcatgtctctgtgtcacattttggtaattctcgcaatatttctttctttctttttttttttttttttttgagacggagttctgctctgtcgcccagactggagtgccatggtgcgatctcggctcactgcaacctccgccttccggtttcaagtgattctcctgcctcagcctcccaagtagctgggactacaggcatgtgccaccacacctggctaatttttgtatttttagtagagatggggtttcaccatgttggtcaggctggtctcgaactcctgaccttgtgatctgcctgccttggcctcccaaagtgctgggattacaggtgtgagccaccatgcccggcagttctgctgggattacaggtgtgagccactgtgcccggcagttctcgcaatatttcaaactttctcattattattaaatattatggggatctgagatcactgatctttgatgttgctgttgtaattgttttgaggtgtctggaaccatgcccataggcagacttaattgataaacattgtgtgtgttctgactgctctgccaaccagctgttccctctctccatctcctaaggcgtccttattccctgagacacaataatactgaaattaggccaattaataacactacagtggtttctgaatgttcaagtgaaaggaatgtttgcatgtctcttactttaaatcaaaagctagaaatgattaagcatagtgaggaaggcatgtcgaaaactgagataagctgaaagctaggcttcttgtaccaaacagccaatttgtgaatgcaaatgaaaagtttttgaaggaaattaaaaattatattccagtaaacaaatgaatgattagaaagcaacacagccttgttgctgagctggagaaagttttagtggtctggataaaagatcagaccaaccacaacatgcccttaagtcaaagcctaatctagagcaaagccctaactctctttaattgtatgaagtttgagacaggtgagaaagctgcaaaagataagtttgaagctagcagagggtggttcataggtttaaggaaagaacctgtctccatagcataacttatagtgcaaggtggctgggggcggtggctaacacctgtaatttcagcactttgggaggctgaggcaggcagatcatctgaggtcaggagtttgagaccagcctggccaacatggcgaaactctgcctctagaaaaaatacaaaaatttgttttttatattttttggtgttgtggtgtacacctatagtcccagctgcttgggaggctgaggcaggagaattgcttgaacctgggaagtggaggttgcagtgagccactgcaaccaagtggcaaccgagatcgtgccactgcactccagcctgggcgatagagcaagagtacatctcaaaaaaaaaaaaaaaaaatcaatagatgagaaattgcttctcaggaatgaataaataaagtagtttcttgaggtggaatctgctgttggggaagatgcttatgaacattgttgaaatgacaacaaagggtttagaatattacataaacttagttgataaagcagcagcaaggtttgagaggattgactcccattttgaaagtagttctactgtgggtaaaatgctatcaaacaccattgcaggctacagagaaatctatcacgaaaggaagaataaatcaatgcagcaattcaccgttgtcttatttttagaaattgccatagtcattccagtcttcagcagttatcaccctgagtagtcagcagccatcaccctgagtaggcagcagccatcaacactgagacaagaccctccaccagcaagaagataataacttgctgaaggctcaggtgacccttagcattttttagcaaaaaaatatttatttatttatttattttttctagatggagtctcgctctgttgcccagcctggagtgcagtggcacgatcttggctcactgcaccctccacctcccaggttcaagcaattctcccaccttagcctcccgagtagctgggattacaggtgtgcaccaccatgcccagccaatttttgtatttttaatagagatggggtttcaccatgttggctaggctggtctcaaactcttgacctcaagcgatcctcctgcctcggcctcccaaagtgctgagagtaataggtatgagccactgtgcccggctaataaaatatttttaaattaaggtatgtgcatatatatatttttttgacatactgctagtgcatacttaatagactacagtatcatgtaaatataacttttatatgcactgggaaaccaaaaaatttatgtcactcatttttttgtgatattcactgtgttgtggttgtctggaactgaactcatgatatctttgaggtacacctgtatgtatgtgttaaggatttacaaaattaaccagctttcccgtgcagtgttcaagtcttttaataatttattatagggaagaagaagtggtggtttgtaaattctgtacttgacaaatggatactgggttttgggcatgcttggctccaaggctgaatgttgggggaaagaagtataggagagtgaggagtctaggatttctaagttttggccttgggcaaatggatatattttagtgccattttctgaactttgtgttacaaagttacaaaagagtgttacagggtacaagattgtagagagaaaggggaaggagcataggttcatggtaatctccttgaggacaggactcattataccttgagtgcctaccatgtatggtttgccgtaagtgctggagatgaaatgtgaacaaaagagacaaaaatttctgccttaagaagctatattctggccaggtgcagtgagtggctcacacctgtaattcctgcactttgggaggccaaggtaggtttccttgagcccagtagttagaaaccagcatcctgggaaaaatggggaggctcctctactaaaaaataaaaataaaaaattagggatgcttggtggcacactcctgtagttccaactacttgggaggctgaggtggagggattgcttgagcctaagaggattgcttgagcctgggaagttgaggctgtagtgagctgtgatcctgccactgtactccagcttgggtgacagagtgataccctgtctccaaaaagaaaaaaaaaaggaagctatattctaatggggatggcagtggaagtagataataaacaaaatatatagtgtgtcagataagtgctgtggagaaaatgcaagaagggaaggagagtgagtgctaggatggctgttgcacttttaagaaaggtgaatacggtaagcatcattgataaagtaacaattgagcaaaaacctgaagaaggtgatataggacactggttggacatgggtgaggatgtgataacattctaggctgaggattagcaagtgtgcaaaagccctgaggtaagggccctgtgctccaggaaatagctaagagaccagtacagctagagctaaatgaaccaggggccaaatatagggagaaaagtggggtgaggagagggttgcagatatgcagggatcatgtagggtcttatttgcctttgtacagactgtgacttttcctttaagtgagaggggaagccttggagggttatgaccagaggaaggacatgacctaaatcttgttttaacagattactgtgctctagggtcccaagtttttcgtttcggttccttacccattctaccctaaaccactactgtgaataggatagaacggtggagttagatgaattggtgcaagccctgacccatgctcacaactctcattccagcagtcccagagtgccagagccagtatttttgttgggccctagaaatttagggtattccagtccagctctttaaataacatgggctgactttactttttcaggtttttgttgccaaaaggaaggagcagagattagctcttgagtttagctgaaaaaggaagattagtctgctggcagattgagtgttttttaacttctttggcttttagggtttttcttacttttggatcatgttttaaaagtcatttttaccttctttcaacagttaaacatttaagttttatttgattttatttgaccctttttctgctttacattcctctgccttttccccattataatacttttagtagaggttagaccattgttatctgtcattaatgtcttagctttgaggccccaaggacttctctgttaaacttaaatatatcatatagattgaaagattatctacagacatgtgatcctataaaaacccatattatttattgtcctccctgcctttacagatgtaaacccctctcctcttttcatcagagctccccctcttttactgctctatcatcaggttgcagaaaataagttttcctgcaaacatagattcccatggcaacataacaaaaaggtaatagaacaaatgtttattttgtctagacctgctgtctgagtaccattagaccctgaacatgttggctcctgttatttgaatatgtggttacaaattccttattttcctcaaaacttacttctcttaggccttggtgatattgtcactgtgcctgtgatatgaaggaaggtgtgtgtgtgtgtgagtatgtgtgtcttactgtcattctactcaaaagtgtgtattgattgcattttcaaacttatggcttaaaatgtagacaccacacaatctgagcatgtgaagaaaaaaagcataccagttttgttctttgttttcgtaagttcattaatttaatatttccagtgcactatactagatattttgtttacagagattttaaaaaaaagaagggtccctcctttcgaaagtatcagtccaggctgggtgcagtggctcacgcctgtaatcccagcactttgggaggccaaggtgggcggatcacttgaggtcaggagtttgagatcagcctggccaacatggtgaaaccccatctctacaaaaattagttgggcatggtggtgtgtgcctgtaatcccagctattcaggaggctgaggcacaagaatcacttgaacccgggaggcggaggttgcagtgagccgagatcactcccctgcactcctgtctgggcgatagagcaagactcagtctcaaaaaaaaaaaaaaaaagaaagtatcagtccagaggagacatatttatgtttcctcatagatggctttggaagtcctctgtagttttggatcttgaagcattttaggttttggattttcagattagggatactcaacctgtataacccagggtaattcaacctattgacactttaggtgggataatgttttgttgtgggggactgacctgtgcagtgtagtatgtttagcagcatccctgtctccaactcactgtatactaatagcaattcccagttgtgacaaccaaaaatgtctagacattgccacatatctcttgacgggtagggagggcaaaatcacctttagttgagaaccacttatataaccctatatatttggattgataaccctgtatatttgattgagtaaaaactagatgggataacatgaaccttccacctgcaaaaaggcagaaatgctatactttctgcattataaattgggcctctctaaacatgatttttgttatttctaggagagtaacagcatttctaatggtcaaggtcctagctataacccaataagcttaatggatgggagaacttgcacaagcatgtttgcaagaggccaggtgtatcactggcacatttgagaaacaactaattagtgagggagacccaattttcatgaataattgtgttttgtcattgtcatggccccaacttagggtgttttgaattttttctggaaaggaaattagcatgaagtccaagttggtaggtaggtagcattttccctagtgtctcttctggtattctgtgtcctttctctcctgtcttctttcagtatttagcgttttcaaactcctagaaataaaatgctgtttagaagaccacaaagagagctgcacataaactaaggagcaagaagtagtacattgtgaattaattttctgtatgtttttgaaggttcttgcatctgggaaggcttgcttagttttaaaaatattaggtaataacagactgaaattttgaagatcttgtggatctcaggtagcagtaactcaggaagatcagccttctttgatttagaatgtcatttaggcacattatgtattctggtaccttagaagatacaatgcattttcctgaattatcattgctactgctttaattactttaagggtgtgaggcagtaactaactttagtgtcacaatgtatacatcttaacatttattgtgctcttttttttttttttaaacaccaccttaaagtactctgctattcagatttttccttgtgtttctctaattctcctatttcatccattggtcagttttttcttcctcttttctttctgctccatgatccattcttaaattttcttttctctttctgtgcatattctttttgaattcattatctgatagtctcaacaatggtcttgttcatatactatccttccaaatttgtactttcaaacctaatctcaagaatgactgatcctttggattctaaatctattgagatgtaatgtttcatgcttttccttgattactttcctacacacttcttgaagataccagagatgtagcactaacttccgttggaatgggattcatgttacaagcttgaatggttcagtttagatatgtgaagcggatgtcatcattagcactgatgactgacagtagttataaaaattacaatcaggaatgaaccaatttacctgaagttttcaataactctaggtattaatgcaacataattttgaaagtttgaaatatataggtataaatattgatgcttatattttagatttactgtagtgaaggaaatttgccagtcgtccatcagtgttaaatgcccaccaatgtgtaaaagaaatagacctaaaatattaataaattgtgtatatatgtatgaaggtattgatgtgtacagagaagtggagacattgtgagttatagtggtcagtatggttttatggagcagaaaggatttgaagattatttagaaagatgggtatttggagagaagaaaaggaaacattttcagacaagagaaaacataaaccaagagaatagatatgaaaaggactgttctgacaggaggaacatctcaggtagggtgaacccagttgtggttctcattcttgttgtgcttcagactcacttgtggaacttttaaacatacctctggaaattaagaatgagatctggagtgggacttaggcagttgcatttctaaaaagtctacaaatggttctttaggtagtagagagctgttggagtttcttgagttgtgaactgtggaggaaaattgttttaaaattggtcttggtggagtgtaaagaatggattagaggaaacaaatgtattgctttgtcaaagtctggtaaatttatgtgtgcctctgttcattttgactcctcggctagatttcttagttccttgaggtcataaacaatcagcttttaaagcttcagtgaaggaatatctttttttttttttttttttttggctgggttgggggacagggttttgctctgtcacctgggtggaagtgtagttacgcagtcaatggctcactgcagccttgaactcctgagttcaagtgatcttcctacctcagccacccaaagtagctgagactacaggtgtgtgccgccatgcccacctaattttttttttttttcgtagacacgaggtctcactatgtcatgaagttgcccaggctggtcttgaactcctgagctcaagcttcctcctgcctcagacttccgaagtgctaggattacaggtgtgagccaccgcacctagcaggaaacatcttataaaatcattctactttcatttggaacttgcaggctcgtgcctgcaatcccagcactttggcaggctgaggcaggtgaattacttgagctcaggagctcaggatttctaaaccagcctgggcaacatggtgaaactttgtctctaccaaaaatataaaaaaattagccaggcgtcgtggtgtgcctcagtagtagcagctactcgggaagctgaggtgggaggtttgttggggcctgggaagtcaaagctgcattgagccgtgatcatgccaccacactctagcctgggcaacagagcaagaccccgtctcaaaaaaaaaaattaaaaatgaaagtaagtttcattaaaaaatactatatatgtaattacagtggtgaaattgttttgtgattaaataaatactgttgtgttgacattaaaacaagatatttgagagttagcgaagatattaaagctaatgttttaaattttgagtttttaaagtcaatcttaaatctcctgctactctgaagaagataaatgtatataattttaatttttctatttcactaggtttgaagaatattttttgaggttcctaaatcaaaacttaagttccaatttttgcataaagttgcctttattttcaagacgttatttccaaaatggcaggacagagcatccgcttcagagcaacagtgatatttgcacatttacttgaatatggaaggaagaaaagctaggcttctgtaatagaatgtaacatgtgcagaaaaatatttccagtatgtcatttattgaaatttgttccaggtgctacaggtaaagagaaagttccaagttagtggtcttaattatttagttatttagaaggcaagttttgaagactattattaattatcctgattcagttggaaaaaaagcctgaaattgtatgatccggagaagaggtgtcatgtttttgcaaattatttcttctcactttatagatattcttttttctttttctttctttttttttttttttttttttttgagatggagtttcgctcttgttgcccaggctggagtgcaatggcacaatctcagctcaccacaacctctacctcccgggttcaagcgattctcctgtgtcagcctcccaagtagctgagattataggcatgcaccaccacacctggctaattttgtatttttagtagagacgggatttctccatgttggtcaggctggtcgcgaatacccaacctcaggtgatctgcccacctcggcctcccaaagttctgggattacagtcgtgagccaccgcacccggccctcactttatagatattctaatgaatttaatgtattaatgagactttgctaattcagtgtaactacagatttcaatatatttaaatatttccattaacttccaaaagtaaaccaaattgtgtttatcttcttagaagtcatctatgaccattgaaagaaattgtaaaatcacttacgatccccacaaattactcaaagacttgctgagtgattactcattcttcatattctgttgatgaaaacacagattgttttttgaggaaaatcatggtgcagtcgtttgtactttaatactctgtggacatgggcacttgtccagcaccttacctttcttaagaggttgtctccctttctctactcagctgatgttaaatttattgatctgccattaccttataacagaaaatctacaagtcaggtgcccatcatggaatataaacacaagttccctatatctctatacctatcaaaagctcagttgacagccgaacatggtggctcatgcctgtaacccaaacactttgagaggctgaggtgggaggatcgcctgaggccaggagttcgagaccagcctgggcaacaagcaaggccccatctctacaaaagaaaattttaaaaataataaacaaaaagctcattgatagctccagtcatctttggaggattgtctgaagaatatggagcttatctgtttttctaaatgtatttaagatttcctcttggattaagtctgtcagagaggccaggtatggtggctcatgcctgtaacccctgtacttattgggagtccaaggcaggaggatcacttagcctaggagttcaagaccagcctagggaacatagtgggaccctgtgtctacaaaaatcaaaataattagcgaagcttggtggcacatgcctgtagtcctggctacccaggaggctaaggttggaggattgcttgaggccaggaggttgaggctgcagtgagccatgattacatgactccactccagcctggatgacagagtgagaccttaaagaaaaaaaaaaaaagcaacaccgtaatattttgtactcctaccctctttgctaataatgaactgtattttggccttacgacagcaatctgtactgatggatgctctaaaaagaaaaccatctgaaacccactattatattcttttaaagatgttgattaggacatttttaccacattatatgtctccttcttgaacagacacagaatgaacttttccctggtttattacaggaataattatgcctctcttcagctctcctgagtacctggttggtttttattgtatggcttctgtgattcatgtcctaactgattctgttctctttgttaatggctttagtgagctttgagccaaatttgaggcctacctctaatgggtatttaaaaaggacctctggccgggtgtggtggctcacgcctgtaatcccagccctttgggaggctgaggtgggcggatcacgagatcaggagatcgagaccatcctggctaacacggtgaaaccccatctctactaaaaatacaaaaaaactagctgggtgtggtggcatgcacctgtagtcccagctgctggggaggctgaggcaggagaatggcgtgaacccgggaggcggtgcttgcagtgagccgagatcgcgccactgcactccagcctgggtgacacagcaagactctgtctcaaaaaaaaaaaaaaaaaaaaaaaaagaaagaaaggacctcatgatatatgctaacctcagctgtacagactttcttattttcccttaatcacttaccattttgtcaggttttatatatataattccagtctgctttaaatccattgtgaataaaggaaggtatacatcaataaatttagaagttaaacagaattatattaggatatatgaagaatctagtaacccacattttctatgtgtgtgtgacacaaggggaggcaagtatgaatgtgtaacaaaacattgaagtttatttaatgattatccttgtgtgttatgtactggattcacggtcagcagtagatgagtgagaatgacatcctaatattgtaataactgcttctaatttttatatttctttcagttattttttactataccaatgattttataaaatgtgaattaatttgataattttggaaaagttcatgtaaattcacaattgggggaaaaacttgttaaacagtatgtcctgaattttagtttggagaacctgtttatcataaagataatttcattttatgatgttgttcatgaaaacaaggttttacttgtagctctacttttacagatgtgattgagaggcgtatttgagctttgccatggaccaagctccttgccaaacctactataaaagttattacatttaatcctaacatatccaacagatgaaatataaacataattctcatttcatgaaagaatttaattaacatcctcaagattatatagctattaagtggcagaactggaattaaaatccagatagtctaattccaaagtcccagctcttatttaatcactctgttggagtattataaacatgtaataataaattgtgattgttggggtctatagggtactgattaattctagcctgccttttgctgaatagattcaggagtcaaatagagataaaaatatttacttttattagtaaagctggcatgcagagtgccttgggcgggcaactcaagtgggcttcttatttcttccccagttaattgaacttgcacacttaatcagtcagatcagctagaaaactgctgctgttccttgctccccagcaggcttaccaatggaggagagaagaaagtgttcagcttgcaggtggaaggcaaactctgaggtgggaagttgaagaagctgggtcccacaggggcaatggccatttttccagtctcaccagagctagtttagagaactgggtttagagatgagtatacatttacttgctacttttgagagggaagaagttactaatttatgggtttgtaggagcaatgggagtggaaaagaagagaaccaccaccctcttttatgtgagataaggaaggagtcagtgagggtgttgtgacagagtaatggcttcttagaggtccctaacaggttcctgagcaggtgactatttaaaccaatacttgaaggataaggatttagctatggggtgggatgggggcggaggagaagaaaatcctaggaaccaggagcagcctgtctgaatagttaaaagaactgaaaggagctagcagaacatagcagctgagagagagggaaagagtagcacaggaacaggtggaataatcagtggtgaccagatcacctgggccttgtaggccatcatgagaaatttgcattttactctgtatgccaaggagattccttgaatggtttgaaggaggggagtgttgtgatctaatttgtacttttattgctattttttatttttcatttttgagacagtctcactgtatcttccaggctagagtgcagtggtgccatcatggcgcaccacaacaaggttgagcagcttcagccttcctgggctcaagcaatcttcctgcctcagcctcccaagtagctgggcatggtggcccatgcctgactaattttttttttttttttgagatgaagttttgctcttgttgcccaggctggagtgcaatggcatgatctcagctcactgcaacctccacctccctggttcaagcaattctcctgcctcagcctcccgagtagctgggattacaggtgcctgccaccacacccagctaatttttttaaatatatatttttagtagagatggggtttcaccatgttggccaggctggtctcaaactcctaaccttagcctcccaaagtgctgggattataggcgtgagccactgcgcctggctgcctaatttttaatttatttattattatttttttgagacagagtctcactctgttgctaaggcttgagtgcagtgatgcaatctcggctcagtgcaacctccacctcctggattcaagtgatcctcccacctcagactctcaagtagctggggttacaagtgtgtgccaccacaccccactaatttttatatttttttagtagagacgggtttcaccatgttggccagactggtattgaactcctgacctcaagtgatccacccgccttggcctcacaaagtgctgggattacaggcgtgagccactgcacccaacccgttttttattttttgcagagacagggtcttgctatgttgctcaggctgatctcaaacttctgggctcaagcaatcctcctgccctggcctcccaaagtgctaggattacaggcttgagccattgtgcctggcataatttatatttttaaaagactgtattggatgcatttggaaagcatattagaaggaggtaggccagtgacatggactaatatgatattggtgaaatgaagagcagttgactttgagacgtcttttggaggtgaaaaccatgagacttgccaatagatttgaatgaggactgaggaaagggagaaatcaaggatgacaatcaaatgtctagctcgagcaactggatgaacagtccatttattgagataacagagccatggagaagaatagttctgggtgttttgaacttggtacgcttcaggtgcttatgtgtctttcttatggagacatcagggctcagagaagagatttcagtgagagacataaatttgggagttttcaatatatagatggcatttaatttaaagtcatgggcatagatgagattatctagaaagagaatgtgggagagagaagagggcccagtaccaagtcctgaagaactccaacatacagagtttgagtagaagcagcacatgcagtggagacagagatggagctgccagaggggtcatagaaaaccaatggaagtgttgatatagactccaggatggacagtatttagagaaagtggtgactatgtcaattactaatcttagaaaagtggatttggtagcagaggtcattaatgaccttgagaagagcagtttcagtggaattggattgaggaaagaatgggattgaaatgagtcagttgtgtagatgtgtgcttctcacaccttaagaggtatattaatcacctggaaatcttgtcaaaaagtaaattctattttagggcccaagatctcctttcctttccttttcctttcttttcttttttcctttcctgttgtctgcagagatcctgcattttctaatgagctcccagataatgtcaatgctgccggtccatggagcacactttgaatagcaaaggtataaattagtggttctcaaactgtaatatgtattagaataacatggagagcttgataaaatacagattattagacccacttcaaagtttcttattccattaactctggggtggtacctgagaattttcatttcttataaattcccaggtgaaactgatgctgctgatctgggaacctctggtgtaggtgacttttttggagaattttaactgtgatggagaactgttaagggaagtcttttgtttgttggctgaaggcggtaaacaagtagagcaaatttatgctgatgagaatggtccagtagatagggagacactgatgatgcaagagagaagaggaatgaagaagtgaaatccttgagaagatgagggaggtggctccaaagcatgtattgtggtcttgaattttgataagcaggggcatattcttagttatagcaagagggaaggtggagacgatgggtttatagatttggggctaagcaaatggagctcccctcctgatggtttctgttttctcagtgaaggcaagggcaactcttgagggaagagggtgaattggagatttgagagagaacatgtcaaacgatcattttcgagtaggaaaatgaacttactagaagaaaatggctttattgagagcctctttgagattaaggtcagaaactaagaatgaaaatctgattctacagtctttcttgttcaacctcagttccttggattcagtcatggagaattaagtggttgagattacccaaggttagactttatccaggtgagtacatcagagagacagacagacagagagagagaagtgcaagggagtgattataatcatggaacaggaagggagatgaagacagaagagggctgaaggatagaaacaagcaatgacaatgaggttaacaaattgttgtagtcagggtacaagtaaactagaggtaactaggtttttgatgaaaagcaaatgctgctggcattcaaaattttgtaggtggggcagtttttggtaggaataaaggtctagaatgtgaccatgaagatggctgggtgtggtggagtttcctagagaggtcaggaaacaggatgttgggtgtgccgttcacctggatgttgaagttgccaagaatgatgacagaagttgagagtgtagagagatcttctggatagaaactaacttttcaatgaatgatggaaaatttcaggtcagtggatacctgcagcagagagggatagtttatcagggttgtgagcaggaggtattttatagaacaaacggaaagtaatggtcctgaagtggtaacggctgccaaggaagactcctacgcacctgctagccaggaggtatctgggctattagagaatgctttctaatggcagggctataagagaagcagtgtcttctagaaatggcctagtttcagagatggaggggaggttcagaaaagaggttgaagatttataggagtttatcacaaattgggatttgaagattgagggtatgccataaaagtttgggagtgaaaggaagggcactggagtaggtacagagttgtaaaagcaagtttggcaggcagagagtttggtgataacagatgaccagaaagtcttggatacatgttagagactgagacaaactggaggatgaggcataatggaactggcccagacaatttctgttattactatttttttttttttttgagaccgagtttcactcttattgccaggctggagtgcgatggtgcaatctcagctcactgcaacctccgcctcctgggatcaagtgattctcctgcctcagcctcctgagtagctgggattacaggcacctgccactgcgcctaattttgtatttttagtagagatggggtttcaccatcttggtcagactggtctcgagctcctgacctcgtgatcctcccgcctcggcctcccaaggtgctggattacaggcatgagccactgtgcctggcgacgatttctaaaaataattaaaatacacatcgcatttttgctatagatgtcctccatgatctagctgctgcctgcatctcttacgtcatcccttcccactctccccttgctccctgtgctctacccacacagcctttctgtctttctgtcactcactccagcatgccatacgtttcctacctctgtttcttttttcgtttgtttgcacttgctcttctgagagatagcagagtcaagtggtcagtagcataagctctggatccagactccctgctctgccgcttttaagctttgtgaccgtggtcaagttacctaacttctctctgcttcagtttcttacttgtaagtgggagaatgataatagtacttatttcataggggattcggggaaatacaaaagctgaattgagacaaataaatgtaaagggcttagaacaatttcttgtatgtgtgggtaaagactctataaacattaatattattattatttcttctgcttgaagctctttttcttatatatttatatagggaatttaatcattatattgtttccttctcagctcagatgtcattcctcagccatcctagctaaagtggtataactccactggctttctgtcactctttatcccattacccttttatttagtcatagtattttcatcactacttgaaattattttattattctgttctgctcttcccccattccctgaaggtgccaagtactttgtaggtgctcaagaaatatttgtggcaatttattgtcctgaaaacatggtttcctgggcctcgactctgagcaggcagcagatgtggcaaggtgacgacagtgaggcctaggcagggaagacagaattcaactctgtttattaatctgttggctcatctagatcaggcagctgccagtttttgtaaattttattagaacacagccacacccattttaaaacttattttctggctgctttcctcatacaaccacagagttgagtagttgtgacagaggtcttacttacaaagttgaaaatattactatctggcccttcattgaaaaaaatttgctgacttctgatttagatacatagaaaagacaaggagaaaacaccaaaaataataacagaagctttatttggataatgggataataggtcattttgctttttatctttatgcttttttttggtattttgttatagaccctttaatttggaaatagccttataaataccccaaaataatatttagaacagctttttaatggtgggttttttcccttttttctccttagtgctgcttttgacacaaaaacggggttacgtgtggcagtgaagaagctctccagaccatttcagtccatcattcatgcgaaaagaacctacagagaactgcggttacttaaacatatgaaacatgaaaatgtaagttattcattcaaggaagaatacattttgatcttgaatagactggggaaaaatgttttaattactgcagatggaaatacgctggagtgcatcaaacgttggtccctgctccttgtcctggggtgttagtggccacttggttatgtcaggtcaaagacttggaatgaaagtgatgcatcttcctggagttttagttttactcaaagatttttagaggagaaagaactctttaaaattttaaaattaaaggatatgttatgaaatacaacacaaaattcacaataatttttaagagaaaatattaaaaagaagttatgtattctttgcctggttttcctaaggctatattatgagaatatgggagtctgtggctattaaaagacaaaatagccacagactcccatattctcataatatagccttaatatttttaagtggaaaaatctgagaaagagtgccttaggctcactgaaagtcctatcagagatggctattattttatatatttgttaataatttttctttttttccagattcacgtattttaataaatatgtcagaggcattgtttaagttaaatataactttttcttttttaccaatttgttgattcagttgccattctgcaaagatgcttacaaattctaatacgataaataagtggatataattggaatactaactgaaagtaaaaagacagttgactgaagacacttattttactgaatttcaaaatcaagttatgaatttctgtgactgctatatgaagggtactgtgaagtttgtagcattgtggaaacaatggccatagagatttcaaagtcctctggctgtactgcttgttaccttgtggaagaaaattcaaaatctgtgaatttattatttgactatttagactgttttagtaatttaacttcttcatagcgagaaaaaagtcacagataagtgactcttcattagcgtacatttgtttcattagtgcaaatttcttctaaattgagaacattaagacttaaatttgtaattggattatggatgccattataatcacagctgctgctttttattttcacattttattttgattgtatgctattgaggaaatcctatttctacagacaacttctattcctgagtataattttacttaagtagctatgtgcaaaccagagttttaagaatgttcagtgtgaagctgcagccttcctaatcagtgacatgtttacaagaagttgagatatgcggaaaaagctggcagcagaaactttattcctaggtctgcataaaatcaaagtggcctggcagctttaagggatgtgtttgcgtttgatttttaacacatttaagtgtgtatgctgtttttcattacacattattatatgtgacagagacagtgtcacagctttgcaagtataaaggatattttgaaagtgaaatgcaagccaaacatttatggaaccccagagcacctttgggagccactaggatcctattgatgtggctatgctaatttaagaacatctggtttaggagattatcagtgctacactgattgttttgcttttcttcataaatatgttaagccaatgtttagggatcatggtattagaaaaataggattttaatttctatacattgttttataagtggcttgcttactagcagtcttttttttatataaagatgtttaagttctaacagttggtggtcacctagatatcagtgatttgttatttaaacaaaataaggcacatggctgaatgtctcatagttctctattccattggcaaatgtttgaagccaaaagacttgactcaatgtagaaaaattcctgcattttagcctattttgaaaacatttgttaggtgcttataatgtcaaagtagttttacccaataaagaaccaaaacttccggtaagtttaattgagggttttcagagaaattcatctcgtttaccctcctcttcttttttaaaaaattactgttttgggtcaccatccaatttttatagcggccaaacctcccacaggcagcagcaacaggcgcttaaaacttgtgaacattttaggtgttggtaacaaatacaattttcaggtgccagagggcacatgtgatcttttacacaaaaatgcctctgacccacaatcggtagttcatcttgaattgtctcttctgttagtgatcatgaataatagataaacatttattaggtgagtgactgaagctaggggatgtcctctgtgactgtgagagtttctctctgaacaaagttagttggaccattcctgattgaacttctgaccttgatctcgttaacacctgctctaaggaaagattaaagggaggcagcctgccagctgcatcctttgctgtctgggcagacactacagagatggcccatatatgggcctagagatctgtacattttagaatttaaaaatgatcaaggaaattgttttgtaaattttatttgggagccttagatttaaccttaccattgtagaccaagagattgttttggtgtgcttttgttaaatatgctaaatattgtctctggatactgagttaaagtatttttttttggatgtgtgctaatttaataaaaatacgacttaatatttgccaggctttggaccatgatgggataatcattagagatatttgctgcttatttgtattatgaatgtcttttctaaaaatttgattcctgggttactttgaggtgactgaagtcatgtaacagcagaaggagttaaggaaatagactaaaatatgacttgatttagaagggaatttccatttaagaaatgagaaatggctgggcgcagtggctcatgcctgtaatcctagcactttgggaggccaaggtgggtggattgcttgaacccagaagtttgagaccagcctgggcaacatggcaaaaaccagtctctattattatattaaaaaaaaaaaaaagaaatgagaaatgaatagattcctaaaatattttccagatctattttaatgctgataagcttttgttttacagtattttccttatgattaatattcataagtatgattaatggagtgagggatattttgtaaaaacccatcaaaaatttaagtactttgatttagcatgggtagttttaatctcaaaattgttattttcggtgtgcttatgttaaacacattaaatattgtaaatattgccctttttaggaaattaaaatttggtagggtatttactagttggcttttctctattttttttcaggttactttatttttcttcttgcagtcatggtttttaatcatttgaatagttgagctttatgtctcatattctgttaatggaagtagctgcttcagatagtttgcttaggtatattgtattttgtaattgtctattcaactgtgtgggctgtggtcaccacttattttgatgatccacagtgggtcagccttttgtactaggcaccttcagatacattgtctgctcagtcttgctgtcagtactgtgaaaataagcaatgatgtcctcatgtttttcatatgaggaaaatgggactcagagaagataccaaatgtatttgccaattattatttacataacagccattcattgaactcctgctgaatgccaggctccattccaagtgccagcgttattggaatgaagaaattataagctcttggacccaagaaatcacaaactgatactggggttcaaacttacagctgcttggttccaaaatgtctgttgtgttttcagtttgaaattggagtttttatttgaaaatagttttgacttttgtcttttgaggtaactcttgcatgtgtaaatcagatctctaatgatttagttttatttccataggaggattttcacaatcacaatggaaacactgtaaaacaatgtaaatagttttaaacttttctattgttttgaggagatgggcatctcagataacaagaatcattgattagaaaatattggaacggtgaataaagttagcttctagacctcagttaccttaagtagaagtgggtataagggagagtgattaaaagaccagaggtcttaagccaggagtataccaaactcaagggaaacgattatggtttagatggagaaggtaaaaggaaatggatttgacttaaatttaaagcactattgtgaatgaggtcacaggtactctattgggaggcatgtaagttggccttacctctatggaggaccatttgacaatattaagatccttaaatatattggtgtcctttgattctgtaattctgtttcttgaaatttatttcctggaagaaaatatgagatgtgcaaaatacatatatttttcttgcagtattccttaaatgtctagagataggaaattggttaagttatggtatacacaaatgatagatatgctgtatacaaatatttaaatattaagtaaaaaggcaggatataaaactatgcatggtgtaaccccaatttaatttatgtacatcagaaaatcaaaggaaatatatctcaaaatgttaatgatagttataatgggtggtataattatgggtaattttggttttcttatgtactgttgtctgggtaagatctgaaagtgattctatttcctttggaacaattttcaaggacttgaaacctattcttgaattccaagtatgtgtcccaccacctccttttcaggttcagactgtaaaattaaagttgcttttaaaaagtgacatttggagtcgggcgtggtggtgcatgcctgttatcccagctactcgggaggctgaggcaggagaatcacttatacccaggaggcagaggttgcagtgagctgagattgtgccatgcactccagcctgggcaacaggagcgaaactctgtctcaaagaaaaaaaaaaaagtctgatatttggatgagtggagtaacatcctaattagaagatctttttcatgataatgttttgagtgttaacatatcttacttctagagctttgtgtttaagttggcagtttagaacagtgtgctagtgaggccacagtcttgcttcataaccagatactctcaaatatggctgggcgtattacaaatgaattatatatttcttatttgccttgtcaatgcctaactttgtagaaatgaatggcctgggttttaaggaaaatagatgggaggtaggggttggagggtgctgtatgtggataaatcagtataaattcctgatcagaaaaactgctcaaagaccatgggttattgagtattaagtagctctttgctttatccctgtgtaaaaatagactttttttttcatttttaaattgtctgatttaaataccctatacattaagactttgtgagaataataccaagaatatactgagaatattttgagactttaaaaatgtcagttttgaagcatatacagttaatatggaaatttttcgtggaatacatttttaaaaaacacaatattacggtaacaaccatggatgtgtgacctttttcacctgttggattaattcattagaccattagtacatacgtaaggcaaggaccctaaatctttttgccttctgataaactactgactacatatgaataaattctaaagagatgaagatttttaatggtaaagtgggttaatatgagaattgatgttaacaagtagaaaacaaaagcataatttgggtagaaaattagttggagttattaagtatatgatgtgatgttatggaactgaggtagctggttttgaattagttcctattaaaatgattgagacgtggctggccgtggtggctcactgctgtaatgccagcactttgggatgctgaagtgggaggatcgcttgaggccagaaggtcaagaccagcctgggcaatctagtgagacacatctgtacaaaaaaagaaaaattagctaggcatggtggtggcacgtgcttatagtcccagctacttgggaggctgagacaggattgcttgagctgcagtgaactgtgatggtgtcactgtactctagcttgtgtgtcaagagtgagatcctgactcttttttttttttttttgagacagagtctcactctgcacctgcactctcccaggctggagtgcagtggcgcaatctcgggtcactgcaacctccgcttcccaggttcaatcagttctcctgcctcagcctcccgagtagctgggattacaggcgcccgccaccacacctggctaatgtttgtatttttagtagagacagggttttaccatgttggccaggctggtctcgaactcctgacttcaggtgatccgcccgcctcggcctcccaaagtgttgggattacaggcgtgagccactgctcccggcctagaccctgactctttaaaaaaaaagaagattaagacctgatgggtactatactgagtttaatatttatttactttttaatttttatattttcttacaggtgattggtctgttggacgtttttacacctgcaaggtctctggaggaattcaatgatgtgtgagtaaattttttgcatttgccttcctggtctacagaatgaagactaatagcccatttctattcctgaaccatttagcaacatatagacttcaaaaaattctttattcctatcatgcacctctttttgggtgtagggatggataccagaagatgtatgttatgggtggtgcgtgttagtatttacatcatttcaggcacattgtaccccattgaagagtcagtcttgaattcttacaaaagttccatggagaaaggagtggagagagttttgactatggattttcttttcaaagtgtttatcccaggtttggttttgttgttgttgttgttgttgttgtttttgttttaaaagacacggggtcttgtgatattgcccaggctggactcaagctcctgggctgtagtgatcctcccacctcagcctcctgaggagctggaactacaggcacatgctaccatgcctggccgatcccaacttttaaaggtgctcttcaagaaatgtaacggatccccagccatatagactccctcctcttttatcgcccatgcatgtgggagatgatactagaactacatgctgatccttgaagtattagatttctatactgggataaggggcagactctacctgttgagaaaggcttcttctctcagctttgtaaccacctctgttgttttagcctgggatacccctagaaagcagagcctgggattctcaggaaccagtagtggggggctagggaaaatgaaacaggaaaggagagaaagcttctatgagtatatgttgagttggtcaccactatggacaattgggctgaaaactgccaagatctaagaagctgtacgtaatgcacctcagatggggatcattaatacactggctcctgaccccattggcaagggttgccacgtatgtcattagtgccttcacatgcccaggttgcacattggtgggccataagacagattccagcaagtgttcccatgtatgtgtgaactctctactatagtagcttttctagtatctgagttgacacagctctccctgcccccagttcacatatacactataccatgaaagagaaaaaaaccttaaacacagttatacttttggtcacattgaaattttggcattcctaaatggagagtgttactattatgaaagccaaaacagaactgaagatcgtgacttctcttccttaacctccattcccccattgaccccagggctgaacctaaccagtttctcctcacccttatcctggtttcagtttctcccattcttatcctgggctgattgcaaacaccgtttactccttccccacagaacacaaaggggatatgtttgaacttctatgttctgtctaaggaaagggagaaagaaataaagaagatgaaatggaaagggaaggaggaaaggtggcaaaaacatttctccaccatttgaatttagttggaacagtgtatggctgagagtagaagagtagaagttaagagaggagaatttggtccacctacaagatctccttggctacattaaccttgatcctgctaatgaaagtttaagaaacaaaggaaaaaaatagccaataactaagaaaaattgttcttctcgcagccctgcttgatacaacaatatggaggcttccagagattactggatgttactcaggggcatgtatattacagtttgttgagccctactgtatgctatagttggaaaagggaatgttacagaatgatggtttttaaaaatagttttcctaaatgtagaagaaatgctgaagtaatgtgtttgtgaattactttggaaaacatttgagttagatctgagctgtatcccaaaattttaggtatactaaggatggatttatataacaaaggaaatgatttgctgacttgtgcaaagtgcaaaatgctgtattttggcctaattgggcattctggaaccggattaagaacctatttttcctatgtgaaaagaccttaattaaggccagtgtctatttagaaggttaagtgttactgatagtggtgcctttgtttggctccttcatccatgtaaggacccagcaactacaaatctacctttgaactaaggtttcattcattcattcaaccattcattcattcatttattcaataaatactatggctgttgagcaggaatccgttctttctatttaactctagctggatactgttttttataaacaataactgagtttacctcttggaagcaaatctcattactacttgttgactacttactgaatgcagaacactgagcagagtgttagcacaggctcagaataatcagaaacagtcgcccttccttttgatgaaagtgtctggttgggggaaacgaattcaaagcacttttgtatccaagctaccaattggccatatgaccttggacaagtcactttaccactgtaggcccagtcatttcactgtaaaatgatgagaattgaggtcgttgacttctgaagtgttttaaattacagaaagtctctgaaaatagaatgaacttgtttgccctaagaaaaatattccattgtttactttttattgtgatgttcatatcactgaaaaaatcactgtagttcgactatagttatttcagtgttttctttttttttgagacagcgtcttgccctgttgtcacccaggttggagtgcagtggcaagatcttggctcactgccacctctgcctcccagctcatgcaatcctcccacctcagtcccccaagtagctgggactgcaggaatgggccaccatgtccagctaatttttgtatttttggtagagacagggttttgccatgttgcctaggctggtctcgaactcctgagctcaggtggtcgccctcctaggccactcaaagtgctgggattacagacatgagccgccacacccagccatttcagtattttctaaagttattttgggatatgcataagaaactaaacatcttcacctacacttgcagggtttgcaaatttaaataccttcagggtcacacaaagaacataaatgaggttcagtgttacacaattgggagtggtggggtctgtggcaaaatacatctgcacctcctaaaagtattcaaattcacattgaaacaaaacaagtaaacaaacgaaaacctacacttctggccaaaccagacataatttaggctagagtggttctacaagctgcctgtttagagcaggctataatttgaacacaaatttttaaatgctaattagcaaaatctctataattactttcagatttatagttttttttttttctttttcttttctttttttttttttgaggtggagtctcgctctgtcacccaggctggagtgcagtggcacgatcttagctcactgcaacctccgcctcccaggttcaagcgattctcctacctcagcctcacaagtagctgggattacaggcgcacatcaccatgcctggttaatttttgtatttttagtagaggtgggatttcactgttttggccagactggtcatgaacgcttgacctcaagtgatccacccacctcagcctcccaaagtgctaggattgtaggtgtgagccaccgcgcctggcctacagttggcttttaatcatgtgatacgtgtatttgtccctttatgtttcggttagcacttttaatttatatacagtcatgcatcagttaatgactgggatgtgttctgagaaatatgtcattaggtgattttgtcattgtgcagacatcatagagtatacttccacaaacctagatggtataatctacacacctaatctatatggtgtatcttgttgctcccatactacaaacctgcatggcatgttactgtactggatgctgtaggtaactgtaacgtgatgctatgtgtttgtgtatctaaacataactaaacatagaaaacaacagtaaaaatatggtactgtaggccaggcttagtggcttactcctataatcccagcactttgggaggccgaggtgggcagatcacttgagcccaagagctggagaccagcctgagcaacatagggaaaccccttctctacaaaaaaatttaaaaaattagccgagcatagtggtgcatgcctgtagtcccagctactggggagtctaaggtgagaggatcatttgagcccaggggcagcggttatattgaaccatgattgcgccactgcattccagcccaggtgacagagtgatatatgtggtccactgttgactgaaacattgttatgtggtacatgactacttcagatttttgctatgttttaaattttaattcttacaaatgaagactatacctttgagaaaggaacaataggtagtgcattttgaacattaggaacaatatacagttactgaatctggatggagatgatttttggaaaatgtagtgttaaaagatggatatactaagttgctcttgaccaccataggatgtggttgtacagatggcaaaattttgtaaagatacagtacatctagatctcttaaatgactggaaatcctttgggcctttctgttggcttcttgatagtaatgtttggcaagatactgcatgcatatatattcctgtgtattcagcagatattaccagtagaaatgcaaaaatcttaaatagccaatatttgaacctaacaccagagcaagctgtaattcagtattactataatattgccttttctttgtgtgtgtgtgtgtgtgtgtgtgtgtgtttgttttctttttgtagttggggctacaggctcacaccactagactcagctgtttttatttttttgtaaagacaaggccttgctatgttgccttggttggtcttgaactcctggactcaagcaatcccccaaccttggcctcccaaaatgctgggattacagatatgagccaccatgcccccccccacccctttttcttaactgtagtggttctttgcgcaagcatagtagacaagaattttttgattcctcctgggaactatttcctcaaatttcatggaaactgaattgtcatgagttaagtggaaattagtcttctgatactttttcctttattttacaagttcccatcccaggtttcttatactgaattccttatctctgcctcattcttgaagagggaaatggaagtggggttttggattctaccatgatagaagggaagacctacaacaaggctattcagcagcctttgttttagtgaaagccaatgagaagagatcacttcttccacttactaacaatgattgctcaactaataagtttagcttttttatttcaatgtaaaagttgctgaaaacactgaattggtaaaggaaatttctggatttacattttaacctgatgttgttcaataaatatttgaatatctaccttatgctaggcacagtaatagtctctgaggaatataacagtaaataagagctgaggctgttaatgggagagaagaacaatgtaaatgatcaaacaaaataccatgtggtaagacctgaaaggtcctacatgagttggtctccggtgtactctctaatctaacctcacctagtcctctttccactctgtctccaccccagtcactctggcctcttgttctttgagtacagacaaccacatttgcaataagacctttgcaccagtttctgttattgccctggaactttttccccacatacctacatgactgtctcctttccttcaggactctacccaagggtcttctcatcagaagctcttcttttgttaccattctaactgaaatagtacccctactgtcactgtttactccttaccctgctttgttcttagcaaattttgttattgtctgtcttctccctttctttgtaagctgtgttcaagcacggagtttgttttcttcgttgctgaatcattattggagtatatgcactccattgtttgttaaacaggtgaacacaagaattgccattatagggcaggtatagagtgctaaaggactgcatagtatggccacctaacccagacatggggtgtcttcaggaaagcctctgcaaaaaaaatgtatacacagagggcttaacggatgaaggagagttggaaaggtggggaaagtacaagttcatccaggggccgagagagggagctgagggcagaaaaggtgtgtgtgtgtgtgtgtgtgtgtgtgtgtgtgtgtgtgtttggtgggaatagaggtgtatatggcaaaagatgaagctggaatggggagggactagatctttggggctttataagctaagcctcattaaggtggttgctttagagaagagatcaaagggtactgggaactggaaatgggattggaaaaaggatgaaaggttttacttttatgtgggatgacatagttacaactctctcccccttcctccccacacaaacacattccatagtgtgtgataaaaagatatcattttaccagaggcagttttctcctggatccttaacacattaggaaatattttggatgagcatactagttgaaaatctgaaatggatataagacttttctgggaacttaaatttatgtaatgatgcttctcattgttaatatctgactttaatttcttttggtttgacttcttgccaacattacaactatgtcctttcttcaaaaaacagggtcttatgcttatgagtgaaactgacaaaacatgtgggtgagcagttctataaaaactctttttttttcagtaacatcttggagggtacaaagggctttcacataatcttatttgacacaacaatcctgtgaaacagatggtattatctctaattttcagatgagggaactgaggttgagagagatgaacctaattgtataatatcacatacaaaattgcatctctccctggtcttttggctctaaacctatttctcatcacatttttctgatctaaggctatgattattatttgaaagtctgctaccccttcttattgagtaaatattgtgttaagttctatgtaagatgccaaaactaagggcctgtctcgttttccaattgctatggtcttattaaagaaatgaggcatttcttattaagaaatgcttacctaaaataactgaagggctgagtcaaatctgtaatgtctagacaacttacagggtgctgcatgaaactcagaatattagagaagcttagtggagaaaagcctctaaagaaggtaataactgtgtccgaagaaacaaatagggataggatgtggaagttgaaatttattccagacagagaatgaaggaaatatgtaaagtgtacagaaaagagatttgtatggaatggagagtgttaaatgagaataactattgatacttcttttgtacttggataaaaattgtgcattgatgaattctgggtgtgtgtgtgtgtgtgtatgtgtgtatgtgtgtatgtgtagggttattcctgatttagctaataaatgtgatctttttggaaataatggtgaaagaaatacctagccgagttgcttggacttacaggttatttcctaatttagctaataaacatggtagttttggaaataatgctgaaagaaatactagcctagttgcttgaaactaggctaagtgctcaagatagtgaacacaggaagagaagtggtctaggaaaaagattaatgagttaactattaacatttatgtttacaattttttttttatcagagaggtctgctgaaatggagatggtgggtggcgaaactccttgtagatgtttttacaaactcacatttgaaatctaaataagttacatatctcttaagaaaatatcattcagtttttgcctgacatgatcaataagatgccacctttttctcagattagctagttttaaaaggtaaagaagcttcaaggcctagcttagagtttgagtccttcagcaatctctctctaattcacttcttcctaagtctgtgctgggaccctctcctgtgtgttctccatcaccgtatgtccctttattatgattatatattcatatatgccttcctttcatctaaaggctgtatctgtctttcccactgctgcatccccagggcccagaaatacgtatttgttgatggagtgatagaatgagtgaataactttgtgctgtcactgtttataactggttgatgatttggttgtctgaaagcatgctcagtgctctctcctttgactagcttttttgttttcatcctgtaatgtagactgtgtggtaaaatattgagtctagtttcactgatgcaggtaatgtagagggcatcttttagtaatctttgcttcaagtgagaataatttgttgtgaaataagcctactaagctgcctacttggctgctgaatgattcttttacccctaaattagaacagtctggtctgcttaccagtaagatctttggcacatgtatttcaataaaatgagcccttgtcttatcttactagtagtgctgtgtgagttgtcctgagtcattcagtggtaattgagtgcctactatctatcagacactgttctcggtactttagatactacagggaacaaaaaataaccctgtcctccacgaacattgtacaagcagataacaataaacaacagtgagcatataaaaaaggaaattacatagtctgttagcagacaataatgctataactaaaaagaaaaggtagaaaggtagaacaggaaaggggaattaggagtacaagggtggggggaagatgaaattttaaatggataggccttattgagatgaattttgagcaaaagtgtgaagaagtagaggaattagacctggggatatctagaggaagagcattccaggcagaagaggaagtcagtgcaaaggtcctgaggcagactgcatgatatattggaactggagcaaggaggccagtgtggagctgagtaagagcaagggacagagacatagactatgaaatcagagacataattaggggcagtgtactggattaggtagggctttatctgccattgaaaggaattttgtgttttactcttagtaaaatagggagccttttgaggaaaggagtgccctgatctgagttttatttctaaagaaacactcttcccctgtgttgagaatagactgtagtaagtcccaaggatcaataggtgagttgcagaagcttgtgcttacaaattgtcaatccctgtgattgttttaagcaccctgtttaaatatggaataaatgggtttttttgttttgttttgttttttgccttttgataattgctttgaataggactgatagtagtaagagacgccagtctatagatatcgaagagttttttctacataggttctttctgattgttctgtgctttaaaaagtgggaggtggggaggaagagggcgggggcagtggtgctggtcttaacaattgggtattatccaagaagtataaatgaagctgtaaaatggggtgctgtctagagtactgaaaagcatttatgacagagttcttccttcttgctgtcacagtacattttactcacaggagtcacattgagaaatgtgatttgtgctctctatactttgattaaatttaaagaagaccaacttcacaagaaaagtgaaaaacaagatttgtatcagtccatgaaattgttttcagcttttagcctaataaagtccaacttaacttaattcctttgtaaagatgtgagaactagatagctttccaaccatactcaagtctaaccttccttaatttactttaatttactttacttaatttactttaggtgttatatacattgacaatattaggcatgtctttactaaaatgtaattgactatgctttccagaaacaaatactatagaaattatgtgactctccattaatgcctcttttggaatgtgcttcttaaaatgtgctcatttatattccttgccccccatcctgttcattatttttagaagttggtgcatcttccataaacaatcagcaactttgcatgatgcttgcttttgtcccctgttgtaagacttattttgaaaatctttctatatgggagttagaatgtaacaattggtggtcatggattggtctttgggcctcctggaaacaagtatagtgattaagttagttcctgcaagatgcttctgccataaataatgcctttcagtttatttcattgtagcttagtagtaatgcttgatagttattactatatagactgattaatcttataaacttacataatgttttggcagtctcaccctcgttctaaattttggtgataaaatggatgtggtctctgagggggaaaggatttgagagaaattacatagtggtaaactgttctaattaaaagctctttccctctctctctctctctctctgttgccatgcagtcagtggtcctctggctgcctaagatttcttaactcactggtaaccatttacacataatagctgtacttgaagttgctatggtttcattagtagttttgcctaacctttgtgaactggctcaggcctattagttaggactagtattatttttatttaaaaataagttatgtttgtctcttctccataaaattatttagaaaagttcaaagaataaccctcttattatccaatgtcaaaaaatataattatgtgcaaagtagtcttatatgaccgaaattagattctgtcttcctcagcttatgcatcaatttagggttaaaaaatacagtaactgtgattaggacagaatactgctatgttcttgccagcctgagaactttgttaagattaactttgatagtaaatacagtattgagaattactaaggaaattattcagacatattgcttccctagttattgtgacgtttaaagagttttaaaaaggtcattcccttgatgtaaattttgtatcagctgaaagaattgttggaagaatatgtgctgtgattaagatcatggtctgtggggtcagttagttttagatccaactcctgacattactactctttttgaccttgagtagatggcttatccttattctgtctctatttccttgtcaatgaaatgggaacgctaatggacattatctcacagagttattgggaagagtacatgagacataatgagtacatggacataataaactgcttgctgcagtgctggacacagaataagtgctagttagtgcctttggttatgttgtgttgagattggaacatttcttaaaacgtttcagtctcatttacttattaattacatttagagtctactctttcctcaaggccgtataaacatgcaagttttaaaaatatgaaatgctaacatcttaaggttgcaactaggttaagtcctgttgatcttcatgaaattgagaactgaccatggcagccctaccaggaaattatgacagagaaaaaaattccattcctcttggaggacagaaagtaataaatatagtgtattagttgtgtgtgtaggtatataaagagaggtcacacacacacacgtttattcttataatatattaataatagatctaaattactgacctgctttcttccctccaaaattcataaaaaaatgaaaatagaaatgaaatcagcattctttatagctcagctgatatatattattacccaatctcaggaataggaatgattcttagacagtaaataaaacttacacttatttttaaaaattcagcctcttagccaggcacggtagctcactcctgtaatcccagcactttgggaggccatggtgggtggatcacttgagatcaggagttcgagaccagcctggccaacatgatgaaaccccgcctctactaaaaatacaaaaattagccaggcatggtggcgagtacctgtaatcccagctactcgggaggctgaggcacgagaatcgcttaatcccaggaggtggaggttgcagtgagccgagcttgtgccactgcactccagcctgggcgacagagcaaggctctgtctcaagaaaaaaaaaaaaaatcagcctttttagaaccgatctactttctatgtttccatagctgtgtaatacagtaatgagtgggttaaggcattgtgtctagaatatgtgtggtgaacctgttggacttgaatgtaatcattccctaatcttaccacataaagatgggattaataaccagcaccacacctgtgaggagaaattctggaatgcctcatcttgcctccagataaaacatgttcctccttcctttaaggtaaatgcaggaatattgtcaatgaacaaaatcctttcactagtcattcctgaaaaagaattacagttggaaaataaaaaaaatactcctattttagaacctgtaatgtggaagacttataatgaggtgaaaatgtagcggtggatttaaaactacaagatacttaattatagccatgcagtaagttatactatatatttgtcatgcaagaataacatttgtaagaaaactgatactgacacatgtatctttctaatccctacctttgctgtttttgttttcttttctcttttattttttgtagagatggggtttccctgtgttacccaggctgatctcacactcctgcctcagcctcccaaagtgctaagattataggtgtgagccacaaagcttggcctggtttcttttttcttgagataacctggaaaaagatatgtcaagtaggaataagtatgtaaatgtttagaacagatggcaggtagttaaagttagaatagtaatgttgggaggctaaattgggaggatcacctgagaccaagagttagagcccagcctgagcaacatagtgagaccccatctctacaggaaaatttaaaaaaattagctgtgcgtggtggtgcacacctttagtcctagctactcggaaggctgaggtaggaggatcacttgagcccaggagtttgaggttgcagtgaattactatgattgctccactgcatgacagagcatgaccctgtctctaaaaaaaagaaaagtaaaagaatagcgatgttgaaaatgaggtaatgaggtgcccttccccccaaaaaatgagtagttgttagcttttagctgtcatcgtggtacagctaccattttaagggaagggtagccttcccttaaaaacttagaagtcgggccaggtgcggtggctcacgcttgtaatcccagcactttgggaggctgaggcggggggatcatgaggtcaggagatcaagaccatcttggccaacacggtgaaacctcgtctccactaaaaatacaaagattagccgggcatggtggtgggcacctggagtcccagcaactcgggaggctgaggcaggagaatggcgtgaacctgggaggcagaggttgtagtgagctgagattgcgccactgcactccagcctggcagtagagcgagactccatttcaaaaacaaaaacaaaaaccaaaaaaaccaaaaaacttataaaagtcttctgaagataagaactttcttaggggttctagattgttatgtaacttttcactaatttctaggtatctggtgacccatctcatgggggcagatctgaacaacattgtgaaatgtcagaagcttacagatgaccatgttcagttccttatctaccaaattctccgaggtctaaaggtacagataatacaagtaataattttttaaaatgaattctccctttctcccctccttttagggcttaaacaaacaagtaaacaacttttctaatggaaaattcaaacacataaaatcacaggtaaaggtcatatagtacagtaaactgccatgttcactcagtgacaacagttaccgacatatggccaatcatgtttcttttgtatttcccaagccctggattattttaaagcaagtctagacattatataataccatccatagatacttcagtttgcatatctgaaagataaggactcttcattcttacatctaaacaataatttattgatgtaatctaatatctggtcagcgtaatgttgagattttcaaaaaatcctcaagaaagactaatttatttgttggaggggcagataaacagtgttttaaaattaaacccatctttgatatttagctgctttgagtccttattgagctccagagtgccaaccagaaaatagattaaaagctcaactgagtggagtcaatggctgtggaaattatagtaatggtaaatgtacacaatactgatagttacttatgctgatttctaatcttactattaacactagcagttcttactgattcatgaaaatgtgcagcaaatatgttatataatatgacaatagaaggttggaggtaactttgacttttttctcttttgcagtatatacattcagctgacataattcacagggtatgtattgtgactttgattacattattttggggaagtggggtgagagtggaagaatggcatttagccaagatcctaatctaaactttagccattgaaatgttgattgattgcaactttactgtaggtttaagctgattaaagaaagaagatgtgtagtttttttctatgtaaggctaacttggactggatattgactgtaggatggagattgtcttttgatagctggatgaagtcttttatgtctggatcctcattattacctgtagggggagaattgatcatgcatcataaagttgatcctgtcttccctgtatttgcttcctaggacctaaaacctagtaatctagctgtgaatgaagactgtgagctgaaggtaaaatgaagagacagtattcattgtttgctttactttgagattatatgtttgactaagcaggcagactttcttagggagtagctttgtgagccatgactatctgaaattcgtattatttttattatcagactttgaaatttaaaccatttctgagtaagctaagtgacattgaaagtggcatcacttgtttttattttaacataaagttaaattataaatttgatatattagtcataataaaggaggataatagtcaaatatcaagtaagtaggcccaaagaggtgataactagattaaatacatttctaagaggagaaatggcagaaacccactcactcaaaataattcaaataaaaaataagtgaattaattgtttctaaatagcaagcagctctagaacttttgttccatttcatttttttaacttgaaaaaatgtctgtacattagaatgcaccatttcatttggcaaaattatatatccacttaactcacatttatgataaagaccatttctttttttttccttttttttgggatgcagtctcactctgttgcccagtctagagtgcagtggtgtgatcttggctcactgcaacctctgcctcccgggttcaagcgattctcctgcctcagcctcccgagtagctgggactacaggtgcacgccatcacacccggctaatttttgtatttttagtagagatgggatttcaccatgttggctaggatggtgtcgatctcctgacctcgtgatccacctgcctcggcctctcaaagtgctgggattgcaggtgtgagccattgctcccagccaagaacatttggattactttaaaaagtttatggccaggcgtggtggctcatgcctgtaatcccagcactttgggaggccaaggcgggtggattatgaggtcaggagatagagaccatcttggccaacacggtgaaacctcatctccactaaaaatacaaaaatttagttgggcatggtggcgggcacctggagtcccagctacttgagaggctgaggcaggagaatggcgtgaacctgggaggcagagcttgcagtgcgccgagatagtgccactgcaccccagcctgggcaacagagcaagactccgtctcaaaaaaaaaaaaaaaaaaaaaaaagtttattgtgtcccttcctagtcaatccctacccctccacccctaactctggctccaggcaactatggatctgcttctaacactatagattaggtttatcttttctggagtttcatgtaaatggaatcatatagtgtgtatttttgtgtgtctggcctttgcttggtgtaatgattcggtattgttgtgtgtgtcagtggtttcttcctttttattggtaatagtattttgttttatgaacataacagaatttttaaatctatccacctgctgatggacatttgcttgagtttgaggctgtgtaaagcaactgtgaatgtttatgtgcaaacctttgtatggacgtaagttctcattgcacttgattaaatacctgggagtgacatttttgttttgctttttgtaatttcattttaagttcttgctgtatatttaccatacattctaagtatggaccaggaaatctctttatgaaagtgctattttgttctcctttttaataaggcaacagaggtttgtttgttgttgttgttttgtttttttttccctgcctgtttctaagtcttagcagtttgtctgttcctcttctgccctttagattctggattttggactggctcggcacacagatgatgaaatgacaggctacgtggccactaggtggtacagggctcctgagatcatgctgaactggatgcattacaaccagacaggtattactcgccttggttatttagggccttatttaattccatgttggatgcatttgggattctcagaaatagagatggtgggagtgggaagaaatgtcttttcttccctcagtgatccttttaaagcctgcaagtaaaaatatttcacttcctcagatggggaagtggggttttatacacagcttttaaaccttgtgatttagcaattgggtttttatttatttagattttgaatatattctctgagtacttatacctaaagacaattagtccataattttaacccctcaatgttacttggaagaatctaccattctactaataagaaacttgcccctttttaaacagcttatttctcttaagtgtgttttgacttaccccacctttgaacagccctttagtcaggtgaagatcttagtaagctatttatttctgtaaaaatgagtatgattgttgagcctcagatgtcttaaatagtaatttgaatatttcacccctagttacggtttcatttgttgccaagaattgtaacagtgacattgcatatacttttacttctttttaattttgccagttgatatttggtcagtgggatgcataatggccgagctgttgactggaagaacattgtttcctggtacagaccgtatcctttaaaaagttttggattcttgtttcttatctgtattccagtgtccatgggtgtatactccttttacttatctctagggaagactctcagtattttgcttttatagtctagataatgcattatgaggtctttcttcaaactgagtagcttgccttgccaagaaagaggcttcagtttacttttgtgagttggaaaaattcctcataagttgaaaaacccatcaagtctgtcttctttttgcaacagtcccttattaatcatcccacagcagttctgagacctgagcatactcatgagaaactccagatcccagtgacagttttagtcttcttgtataaacacttaatgagcacaagatgcccatttataaatgaagggcatcttgctgttatgtttatgtattaaaagggctatgtttggtacctgcagtgatatactgcttacttgttatgtttgttgtttgacaacaaatagtaaaagcaagaagtgaaaagcttaccatgtaatgtacttttgtttttccagcacaactttttcccagattgcagccaaaccctaatttactccaagacttactgtctagtttatggtttattatagcccctttattttagctcctttcctatctgcggtatgcttgtttcatggtttagtattaatgtcatgaaaaatgtggtctgttggaactctcatcagttctacttatggaagatgtttaggtgagaaagattgttaaaatatatgtctagaattagttttggggattttttctttttttaatagaattgagttaactagccttcaggtggttttggttaggcaatattagacatgctacctctgatctattatgcctagagatctaaaagccattttagtcccttacctaaataaactaattgagtttataaaccagaatgtcaattcacttgcttacagtttgggatatacttctgtaatggctatgatgttcatgatatctacccacgtgttctaactatcttctgctagagagaatgtactttcattatgaactgaaaaaacctctatttctcaggtaaagctgtttctttctctctgaatattaggattgataacagagttcagtctccctgtatttagcttaccttattactccctacctctggattttaaattagtttaatacctggtgtttctcctttgtcctttgtttcattcaccttatatctgtttctcagaaatttggtatatatatattacagtccaaggtaagagaattagggaaaattcatacttccccctttcctcaggtacatatctcagagtcccatccttgctttgtcctctagagtagctgctgtcctgatgctattctctgttccctgctccccttcctcttcttgtgtctgtatctccagctaccatttagtcagtcacagacctccatgccggtgtagacacacaaggtggcagagagggaaaggcagtataacatacaggttaagcacatgctctggagccagatttcctggatttagatcttagctcttttatttccagctatgtaactttgagtaagtttcctaacctctatttctctcagtttccttaaccgtaaaatgataataatcatacatactcacaaggttgtcgtaagaattcagccagaaaataactggaaagtactgagacgagcctgccagtaaatgttagccatcatgttcagtaatggccttgcaaaacagattaccccttcaccttctcacttaattgtctacctatgaatcattaatgttttgttttgtttttaattctgtgataggtaggaaaggatggaactccttggcagactagtgttagaaagttttcgaagcagtgtgagtcttgtacctttgtggtcctgtctcacagacacctgtctattccctgacccttttaaatgctaactttctgcctgtaggaaatcttccctttgtgcttaggtctttttcttctgtgagctttagataaacaacctagtgtttaaactttttaataagggattcattttttaatacatgagaattcatttcaaaattttggttttagttatttattttattctacttggctctttttcagacagatgttctctcctggattgtaaaagtcgaattcaaaggatttttatttgtaatatacttaacctttctcttgtaagttgccatctgtgtagatacagctttgattgcctgacaagaggaaaatgtttcccattatcttttcctgcctgaactatacggtcacttgtgttccagcatagtggttcttaaccctcatagtgtgtcagaatcactttgcagagcttttaaaaactctagatgcctggggaccaccccaaagactccattttgttgtcatgggtcaaagcacagtcttctagtttgcagctagtgttgagtacaactagagtttaacccagttgaattttagtttaatcttggctggtcttgaagatgttagtaatctctattcattttttttgaaaagtaccaatgagatcagaaagttaattagaaaacatctagttgaatcccctgtttttaatagatggggaaaccaagacccagagaatataatccaaagctacctgtcacataggccacaatttcttttccaatattctgttcttcgctgttcttctaatttgcagaactcctctttaaaaaacctttggagaatgtattggcctcataccctcttccttcagcctgaaagacatgcacctgtcacttatttatgatatttaaatgcaacctctagaacaggggtgtccaatcttctggcttccctgggccacattggaagaagaaatgtcctgggccacacataaaatacactaatgatagccgatgaacttaaaaaaaattgcaaaaaaaaaatctcgtaatgttttcagaaagtttacaaatttgtgatgggctgcatccaaagccctgggccacgtgcagcccgcaggccctgggttggaaaagcttgctctagaaggtactcattgtttgagtgtccagttttctccctgttttccttatttattgatcattttgcatttggaattggtggtttgggcttgtaagtaagaactgtgtactagaacttttgtggtattgcaaatgttttatatctgtgctatccaatgtggtggttataggcaccagctgcctgtggctaattattaagcaactgaaatgcagctagtggtgagcagtaacgttgtggagaagaaaaaaaagaaatgtagctagtttaacttggaaattgaattgaaaatatttttgtggttaaatgtatttaacataaaatttaccattttaacctttttttttttgagacagtcttgctttgttgcccacgctggagtgcagtggcatgatcttggctcactacaacctccgcctcccgggctcaagcgattctcctgcctcagcctcccaagtagctgggattataggtgtgtaccaccatgtaatttttgtatttttagtagagacagggtttcaccatgttagccaggctggtctcaaactcctggcctcaagtgatccgcccaccttagcctcccaaattgctagattacaggcgcgagccactgcacccggccccattttaaccattttaagtttacaattcagcggcattaattacattcatgatgtacaatcactactactacctatttccagaattttttcatcaccgcagatggaaacactcagcccgtgaaacagtaacttcccattctcccctctggtaacctctgttctttctgtctctgtggatttgcttattctagaaatttcatagaagtagaatcatattatactgtatttgtccttttgtttctggattatttcacttagtataatgttttcatggttcttccatgatgtagcatgtatcagaatactattccattgtaagtatttaatatatcccacattttgttgacctgttcatctgttagtagacagttgagttgtttttacctttggctattgtgaataatgctgcagtgaacattgtcatacaagcatctgtttgagtccctgcttttgattcttttggttatgtacctaggagtggaattgttgcatcatatggtaactctatgtttaactttctgaagagccaccaaactcttttccatagtgtctgcaccattttacatgcccaccagcaatgcatgaggattcctgtatctccaaacttgttctttttttttttttaatagtcacccaagtagttacaaagtggtatctcactgtggttttgatttgcatttctctcatgactaatgattttgagcatcttttcatctgcttattggccatttgtatgtcttctttggagaaatgtctattcaagtcttgcctattcttaattaggttgtttgtgtttttgttgttcagtggtggttctttatatatcttagacccttatcagatacatgatttgcaagtattttcacctattttgtgggttgtcttttcactttcttgataatgtcctttgatacataaaacatttttaattttgattaagttccaatttattttttttctgtccttgctcatgcttttttgatgtcatattttagactgtattgccaaattcaaggtcatgaataatttacccctatgttttctactaagagttttgtaactactaggaatataatagggtttagctcttatacttaggtctttgatccattttgaattaatttttatagatgatgtgaggtaggggcccaacttcattcttttgcatctggaagtccagttattctagcaccataaagagactattacttcccccatcgaatcaacatgataccctaggatttctcctttgttttttgtttctttcaccttttacctgtttcttagaaatttggtatatataattagcaatacacgtgtgggtttaattctggactctcagttctattctattggtttatatatctatccttatggcaataccacactgttttgatcactgtagctttatagtaagctttgaaatcaggaagtgtgagtcttccagctttgttcttctttttcaagattgctttgactattctgggtcccttgtaatttcatatgaatttaacaattggcatttctatttctgcaaaaaaaaggctttagaattttgatagggattgtgtcagatttttagatcactttaagtgatattgacatcttaaccactattaagtcatcctgttcatgaacaaaggatctctttccatttatttaagtctttatttttttttcagcagtgttttatagttttcagttgtaaagtattttaccttggttaaattttttcctatgtattttattatttttgctgcgattatagatggaaattctttggtgtgttcattgttgatatatagaaaccaaattaatttttgattgttgatcttacaccctgcaaatttgctcaatttatttattagctctagcagctttcttctagattctttgtgattttctatgtatagggttatgtcatctgcaaacagagatagttttatttcttcctttccaatttagatgcttttaattctttctcttgtctaatgtaatggctctgtctagaacttctgctacaatgctgaatagcaacagtgaaagtaggcatccttgtcttgttcctgtcttagggggaaagctttcagtctcttcccattgagtatgatgttagctgttggtttttcataaatgccctttatcatgttggggaagttctcttctttggtagtccatttcacattgctatgaaggaatacctgaaactaggtaatttatcaagaaaagaggtttatttggctcacagttgcatagctgtaaaagaagcattgtgccagcatctgtttctggtcaggacctcaggaagctttcacttatggtggtagggggaacaggcatgtcacatgtcaaaggagggagcaagagagatgccagactcttttaaacaaccagcatttgcatgaactgatagagcgagaactcactcattaatgtggggagggaaccaagccattcatgagggatccaagaccctaacaccttcaatcaggccccacctccaacattggggatcacatttcaacatacttggaggggacaaaacatccaaaccctatcaccttctgttcacagttttctgagtattttaatctgaattttaaatgccattaaaattttatttagattacattgaaacttaattacacatggctagtggtattggtttatgcatttttagatcccttcaagttatcttcctgttctacctttttcttgggttttgtaattagtctccttcttgaaagattattttggtactggttgttagtaattcctggatttcctttaaagatataagaaatactggggaggggacaagatggacaactagaaatagctgcaatcagaggcttccaacaagaagaacgaaaacggtgagtgaatcctgcaccggcaactgaggtattcaccttctctcaatgggactgactaggtggttggcatgacccatggagagtgaggaaaagcagggtggagcgacagcccacctgggagctgcaaagggcaaggggagctcccaccccaagccaagggaggtggtgagtgattgttctaccctgtccaggaaatcatgctttttccaaggatctgtgcaacctgtgattcaggagatccccctcatgagcacatgccaccagggccttgggtcccaagcacagagctgtgtaggttcttggtagccctttggctggagactacataagactactgagttccttgggggaggggttgctgtcatcactgcagctccagtctgctgttttcccctgctggtgctggagagactgggcggttgggacccagaaggaattccctacagtgcagaccctacagtggtggtggcacatcatggccagactgactctttaggctgaactctgactcatccccctacacggggcagggcctctctgcgggaatttcagcaactccagccaggggtttacagacagaattccaatctccctgggatggagcccctggtgggaggggtggccacagtctccacagatcagcagagttagtctttccccttgctggctctgaggaatccaggcagtctggatgagtgagatttcccccagtgcagcacaccccctccaccaaggggcagccagagtgcttcgttaggtgggcctgtgcctcttgactggatgagacccctccaacaggggtcgccagacaccttatgcaagagcattcccactggcatcaggttggtgcccctctgggacggagctcccagaggaaggaacaggcagccatctttgctgttctgcagtctccactggtgacacctccaggtacaggagggacccaggcaaagagtctggagtggacccccagcaaactgcagcagccctatggaagaggggcctgactgttaaaagcaaaacaaatggaaagcaacaacaacatcaacaaaaaggtccccaccaaaacccctccaaaggttagcagcctcaaagttcaaagctaggtaaagtcatgaagatgagaaagaatcaatgaaaaaacgctgaaaactcaaaaagccagagtgcttcttttcctccaaatgatcacagcacctctctggcaagggcatagatgtgggctgaggctgagatggatgaattgacagaagtagacttccgaaggtggataataatgaatttcactgagctaaaggagcatgttctaacccaatgcaaagaatctaagaaccatgataaaacattacaggagctgttaaccagaataaccagtttagaaaggaacataaatgatggagctgaaaaacacaacatgagaacttcataatgcaaccacaagtatcaatagccaaatagaccaagtggaggaaagaatttcagagcttgaagactatcttgctgacaagataagagaagaatgaaaggaaatgaacaaaacttttgagaactatgggattatttaaaaagactgaacctgcgaatgataggggtacctaaaagaattggggagaatggaaacaagttggaaaacacacttcaggatatcagccaggagaacttccccaacctagcaagacaggccagcattcaaatcaggaaatccctagagaaccccagtaagctaccccatgagaagatcaaccccaagatacataatcatcagattctccaaggttgaaatgaaggaaaaaatactaagggcagccagagagaaaggctaggtcacctacaaagggaagcccatcaggctaagagtggacctcagcaaaaaccctacaagccagaagagattcggggccaatattcaacattcttaaagaatttccaacccaaagtttcatatctggccaaactaagcttcatagtcaaagaagaaataaaatcctttttagacaagcaaatgctgagggaattcgtcaccaccaggcctgtcttgcaagagctcctgaaggaagcactaaatatggaaaggaaaaacttactggccactacagaaacacactgttttcttttaccagtaacactatgaagcagttacctcaacaagtctgcaaaataaccagctagcatcatgatgataggatcaaattcacacataaaaaatattaaccttaaatgtaagtgggctaaatgccccaattaaaaaacacagaacggcaagctggataaagaatcacgacccatcagtatgctgttgtattcaagagacccatctaacatgcaaagacatacaaaggctcagaataaagggatggaggaaaatttaccaagcaaatggaaagcagaaaaaagcaggggttgcaatcctattttctgacaaaacagactttgaaccagcaaatatcaaaaaagacaagggcattacatagtggtaaagggctcaattcaacaagaaaagctaactatcctaaatatatatgcacctaatacaggagcacccagatttataaaccaagttcttagagacctacacagagacttagactcccatacaataatagtgtgagactttaataccccactgtcaatattagacagatcatcaagcagaaaattaacaaggatattcaggacttgaactcagctctggacctgatagatagctacagaactctctatacagaaacaacagaatatacattcttcttagcagcacatcgcacttaggctaaaattgatcacataattggaagtaaaacactcctcagtaactgcaaaagaactgaaaatataacacacagcctctcacaccacagcacaatcaaattagaactaagattaagaaactcactcaaaaccacacaattacgtggaaattggacaacctgctcctgaatgactcctggataaataatgaaattaaggcggaaatcagaagttctttgaaaccaatgagaacaaagagaacataccagaatctctgggacacagctaaagcagtgttaagagggaagtttatagcactaaatgcccacatcaaaaagctagaaagatctcaaattgacaccctaacatcacaactaaaagaactagggaaccaagaccaaacaaaccctaaagctagcagaggacaagaaataaccaagatcagagtggaactgaaggagatagagacaggaaaaacccttccaaaaatatcagtgactcccaagatctggtattttgaaaaacataaaataaaataaaatagactcctagctagagtaatgaagaaagaagaatcaaatagacacaataaaaatgataaagggggtatcaccactgaccctgcagaaatatgaacaactatcagagaatactataaacacctctatgcaaataaactagaaaatctagaagaaatggatgaattcctggacacatatgacctcccaagactgaaccaggaaaacgttgaatctaccaataacaagttctcaaattgaggcagtaataaatagcctaccaagcaagaaaagcccaggaccagacagattacagccaaattctaccagaggtacaaagaagagctggtaccatttcttctgaaactattccaaacatacaaaaggagggactcccctataactcattttatgaggccagtattatcccaataccaaagcctgccagaaatacaacagaaaaagaaaacttaaggccaatatccctgatgaacatcgatgcaaaaatcctcagtaaaatactggcaaaccaaatccagcagcatgtcaaaagcttatccatccaccacggtcaagtcagcttcatccctgggatgcaaggctgttttaacatatgcaaatcaataaacataattgatcacataaacagaactaaaggcaaaaaccacatgattatctcaatggatgcagaaaaggcctttaataaaattcaacatcccttcatgttaaaaactctcagtaaactaggtgttgatggaacatacctcaaaataagccatgtaagacaaacccacagccagtatcttactgaataggcaaaagctggaagtattccccttcaaaactggcacaaggatgccctctttccctactcctattcaacatagtattggaaattctggccagggcaatcaggcaaaagaaagaaagaaagggtattcaaataggaagagaggaagtaaaactctgtttgcaggtgacatgatcctatatctagaaaaccttgttgtctcagcccaaaagcttcttaagctgataagcaacttcagcaaagtctcgggatacaaaatcaaagtgcaaaaatcacaactattcctatacaccaacagtaggcaagcagagagccaaatcatgaatgaactcttattcacaactgctaaaagagaataaaatacccagaactatagctattaataacaagggaagtgaaggacctcttcaaggagaactacaaaccactgctgaaggaaatcagagaggacacaaacaaatggaaaaacattctgtgctcatggataggaagaatcaatatcatgaaaatggccatattgcccaaagtaatttataaatttaatgctattcccattaaactactgttgacattcttcacagaattagaaaaaaactttaaaattcatatggaaccaaaaaagagtccatatagcccaaacaattctaagcaaaaagaacaaacctggaggcatcacactacctgacttcaaactatactacgaggctacagtaatcaaaacagcatggtactagtacaaaaacagaccaatggaacagaatagagatctcagaaataaaactgcacatctacaaccatctgatcttcaacaaacctgacaaaacgagcaatggggaaaggattccctatttaataaatggtgctgggagaactggctagccatgtgcagaaaattgaaactggaccccttccttacaccttatacaaaaattaactcaagatggattaaagacttaaatgtagaacccaaaacgataaaaaccctagaagaaaatctaggcaatatcattaaggacatagacatgggcaaaaatttcatgatgaaaacatcaaaagcaatggcaacaaaagcagaaactgacaaatgggcttctgcacagcaaaagaaactatcgtcagagtgaacagacaacctacagaatgggagacagtttttgcaatctatccatctgacaaaagtctaatatccagaatctacaaggaatttaaacaaatttacaaggaaaaaacccattaaaaagttggcaaagggccaggcacagtgactcatgcctgtaatcccagcactttgggaggctgaggcaggtggatcacgaggtcaggagatcgagatcatcctgactaatttggcgaaaccccatctctactaaaaatgcaaaaaattagccaggcatggtggtgtgcgcctgtagtcccagctactcaggaggctggggcaggagaatgacgtgaacccaggaggcggagctggcagtgagccgagatcacaccactgcactccagcctgggcgacagagcgagactccgtctcaaaaaaaaaaaaaaaatattggcaaaggacatgaacaaacacttctcaaaagaagacatttatacagccaacaaacatgaaaaaaagctcagtgtcactgaccattagagaaatgcaaatgaaaaccacaatgagatactgtctcatgctagtcagaatggtgattattaaaaagtcaagaaacaacagatgctggtgaggctatggagaaatatgaacacttttacaccgttggtaggaatgtaaattagttcaaccattgtggaagactggtgaaatcctcaaagacctagaaccagaaataacatttgacccagcaatcccattactgggtatatacccaaaggaatataaatcattctgttacaaagatacatgcatgtgtatgttgattgcagcagtattcagaatagcaaagacatggaatcaacccaaatgcccatcagtgatggactggataaaaaaacatggtacatatacaccatggaatactatacacccataaaaatgaatgagattgtgccctttgcggggacactgatggagcttgaagccattttcctcagaaagccaaacaccacatgttctcacaagtgggagctgaacaatgagaacacatggacacatggaggagaacaacacacgctggggcctgttggtggggtgggggtcaggcggagggaacgcatcaggataaatagctaaggcatgcggggcttaacacctaggtgatggattgataggtggagcaaaccacgatggcacatatttacctatgtaacaaacctgcacatcctgcacttgtatctcagaactttaatttaattttaaaaaaatataagaaatactcatttttgtcttaaagccaataatgtgttatcagattagaaattattcttgtttgtgactttgcagaacccttccatctggcctaatgatagcattattattttttaaagaatgaagccctttcttaaaagcctagttgactagggatatcaagtggacacagctgacagaactttgtactagaaaggagggaggatacagaatgtctcttcaggtacagtactaacttatttcaaataccatagatcttgaaatgaataagccactttgaaaattctgttaccaacgcttaacactctgcagcttaaggaagagagaaagttttatagccctgttatgcatcaaataccgtttttctaccagagatcacagccttggcttgctgttgttttccttttctccataatcaagtgaatttccttatgtgtaaaaccttctttaattttaacagaaatggtgctcttaagacataatgggttaatggagctgagttaaaatccacttgccatcagttactgccctggtctatgggagttttcctagtgtattaaatttgcttcttatatatttttttttatttcttcttttgcaaacatgttttgaaatatttcagacatactgctagacaaagaataataaacacctctgttcatactgtcctgcttgtgagttaaaacactggcaatagagctaaagcttctggagacccttctctcacatctgcccatcactttcagtcattggtttcaaatactctttctttttttttttgagatggagtctcactctgttgcctaggctggaatgcagtggcgcaatctcggctcactgcaacctccacctcctgaggctggtctagaactccagacctcaagtgatctgcccgccttggcctaccaaaatgttgggattacaggtgtggccactgcaccctgccaaatattctccctctctctctttttttttttttttggagacagagtctcgctctgtcgcccaggctggagtgcaatggcgcaatctctgctcactgcaacctccacctcccgtgttcaagcgattctccctgcctcagcctcccgagtagctgggattacaggtgcacgtcatcacgcccggctaatttttgtatttttagtagagacaggattttgccatgttggccagcctggatgttctctcatttttaaaaagcagtttcactttagacaccaaaagcaagtgtccaataaatgctgaagaagaaaaatattttattaggttatttgccctttcctctctaacttgaaaatacattttctcaggaaaaggtagaatcctcagatttgtccataaaccaagggtcccttaagaaattttctttgtgttacagtgaaaatgactattttgacaacttggaagataaggagctaggctaagtcttattctagtctatcctgtctgtcaccaggaagatttcctaccttcccaaaggttagtgctccacttcacccctatgtggatttatgtctttgaaaattactgctcatggcaggtaggtcctgcaattggtccttttatttatcttcaactttctggcctgtggaggttttttaggagtgcctggagcacttagaactgactagaatatccctcttttactttccctagaaatatcctgttatgcttagtttttttgtttttttttttctttacctgttcattctgactgacttgcttctgttaaagatgacttcgtctaaagagtaatcttaggcttaagttgttcttttcttcatttgttttagaaagattcaggagatttatgatttaaattttgacgttgtgatcattacaattaaaacacattttaaactaatagtaaaaatattttctacctaagagaaacagggctaaacctattacaaaggatggctcactgtggaaataactgattgtcatgatgtggtgagttttgctttactccgctaatgtggctacgtgacgctccttctggtcttaactgcctggacaaatcatagtggccttatagtagctggtactgttggaagactggcctgtatttcagtggatttgccagcttttgaagaacccatggtgatttcttctgaggtttgcatgttttaacttccttcatgcaaatgcttttagttactaagatttttattttatgttgtgtgtttttccatggagtatggtcattctgtgttttgagggcaaggcagtggggtaaagctgagttgaaaagcataatatggctcatcttttcttttcttttttttttttttttcattttttgctgcttttattttacgaaaaagctaattcaaatctacattaaactaagttgaatacaaagcctttgtgaagaaggcctggtagtctcatttacaaaaatggccagtgtcgtctttggccttaaaatttcaggacgggcacttcagatggcttcacatttgcatgtttcagtgctagagcatgggaatagactttggcatccactgtaagatgtttttcagctacgagagcatcgagtccctgcagcaggtcattcttgggtaacgaaatgacttccacaaattctccatcccctggctttggcttgggccttacattttctgcgtcatctccgttaatgattactgtcacgatgtgtgtggtacagtttgacaaacctgggtccatatagaccactggagaacattcagcagcgtcccctttgtagccagtttcttcctcaagctcccaaagagcagctgctcctggggtttcaccatcttctatgagttccctgcagggaactctatgcagtagccacccattggtggtcaggactgtttcaccagaacgatacactcgtagtgaagcgttctctgcagcacagggatgaccgctacatcatcaccagtctgttctttcctggttgtatgtttcactgagtcccaagttccagttttaccaataggagccatgtatgttgttttttcaagtttgacccattttccttctgaaattaactcctctgaaataatatagtgtttccattctgagacaattcagttggttcttggctctcccttttcaaactagtctttacagccctcaggagagaagttcacctccaaagtgtaggggtgacaaagggaagaggacaaaagaactactggaggcagcagtgtcagcatacgccggtgtcacgactcaagacatcggcacctcccgaggtgatgaaaggatgtgccatggctcatcttttcaagtcaactagtatttatcaagctgctctgtggaaggtgctggggacaggatggtacctgtccttaaaaccagaatgatcagactcagtggaaagagagttacaagagttacttgaacaactgtctctgattataaaataagatggagtgataaatacactagaatagagttatagataagctattgaaaaaaatccaagaagacttcatggcagagttcttgtttgaataggacttcaaagtgtaaataggaatagaaaaggcttggaaggacgggagaagggggaggtattctggtttatgagtacataaataagtacttggaagcttagaagtgcctggaatatctgatgtgagttgaagcattgagtgcattaaagaataataatttgagccagagtcaaactaggcttgattcttcaggcctgatattgtttcatgccagcagaggtgggagagagagggtttctcagctcattgatgtaatgagccactgtgactaatggaaattgcgtattcttcaggtaggttggggtgaagttcaggtagttgagaaattcacagctcagagagcctgtcttccttagagagagtataaaaattgactctcagccaggcacggtggctcacgcctgtaatcccagccctttgggaggccgaggcaggcggatcatgaggacaggagattgagaccattctggctaacatggtgaaaccccgtctctactaaaaatacaaaaaattagccgggtgtggtggcaggcgcctgtagtcccagctactctggaggctgaggcaggagaatggcgtgaacctgggaggtggaacttgcagtgagccgagatcgcgccactgcaccccagcctgggcgacagagcgagagactccgtctcaaaaaaaaaaaaaaaaaaaaaaacaactgactctcattgttaagtagtcagaaagaagtctcttaaacaagagtaccaatatcaaaagcttcattttagagattacttttgatgcatatattgtaaagccacttgtttgagatttgaagtagtcaagatttttcccatatatgatttactttatcttgtggtggctacccagttaaatatattcctgaagagtgttaatgtgaggaaactaaattttttgaattgagtcattttagatgagcaagaattttttttactgatttctattgtaatataattaatctgattattttagagcaagacagtatccatcccacccccattcctactctgtcccatgaacatatgctataagattttttacttgtcaacatcttgaactgagaagccagtattaaaatcttaacctttataacacaatgatttttgccatttgcagatgacaaaattccctgttattcttaatttagaaataatgtgagtggacttgtttctagtttgtttttgcttgctaaagaacacaagttgtttgggtttagggtggggtttggcgcaccttttctgaaagggccaggtagttaatattttaggcttgggaaccatatggtaactgtgcttgttgtaattggaaacacctatagactgtacataaatgaatgggcatggctgtgttctaataaaactttatatataaaacaggcagagcctggggtttggtgactccagcctagaattttcttccatttaagctgatttcatgtctgaaagaaagtaaaagacaggatgtcaaattactgcattaagttattcctataacgtaggcacctgtggcttatagagactgttgtttttaagtgctgctatgttgcctttatatgtataaccataagcaaaaatttctttcatcctgctctaccttttcctcaaatattttgactacctgtcatgtaccagatgttaggctggggataaatggtgaagaggcagagtggcccctgtcctcgtagagctgtagaccagtacagggggcagacagtaagcaaataaagtaattctaggctgtgataagcactatgatgttatcaagcatggtgctgagagagaattggggggtggggtgttatgtatatagagtgttgaggggaggcctcccttaggaggtgaagttgaagctgagacctgaagccaagaggatttagtcatgtgaaaaacctgatgggtcagaagacagtcatcctccccttctccctccctggaatgtcagtcagtataaacgtggataaactgttcacattttcagaggaaatattaaaagctattttataatatttttccccctctttttaacttcctttttaggtaagattaaaagcaatgagaacaaacaaatttttgtcttctggttaacacatgcacatacattctgagtatacattgaagtgttagctaccaggataaaagttatggcattgtggcctattatttagagcctttgggatgtgtgaagtttgttaagcattgttcatttgcattttataaggttgaaaccgcctgtatttgcgttctcatggcgctcctaaaggaacatgcgatgggagagcgccctctgctggcgactctccctcatagtgcctgctatagccagtgtgagaggcgaggcttccctttccagagggtgtgctccagtggtcaggctttggggtctcacaggccttccactgtcatatcacaagctctttaggtcacgcttgggagaatattcataaatagacttgtacatccctagctcctgtcttctgctgcttttttccttatctgtggccctctaattatcagtgcactttgctgaactggttactgacactgtgatggcagatgaagagggcagtgtaaactgagtgaagctcttgtgttttcacctgctgtctttggcagctaagaaccagctaaagttgcctcactttactgatacatgctgttgacagatgcataaaatgaatataaagtggatatgtgtttggtagcattttgaatctttgtacaggaggagcatgccctacgtgaagtgatcatcctgcaggagccttgacctagagggattcaccgtgttggctaggtttggggtgtttcatttttgttctcggtgtgttctgtttgtttgtttttgttttgtttgtcattgtttgtttttcatttttattttgtcccaacattttcctttatggtccaccattagatattgatcagttgaagctcattttaagactcgttggaaccccaggggctgagcttttgaagaaaatctcctcagagtctgtgagttgatgctttgtaattatctgccctgttgggagcctctgccacttgccttctaccaatctgtactttgacctgggtgtgtttgtaagcacacatgccctttgtgtgctgacttcccggatgagtgaggtataagacagtgtgagtgtgtgtgtgcgtgcacgcatgtgtgcctgcttgcatgcacaagtgtgttttattctctatctgggtacacactaagatcacgggagcctccattagacaatagtatcccagtaaagcaatgagatttgagattctaattcattccaagagattaatgtaaactttgtgtctctgtcctcaagacctgactttcttctttctcagaagtttcacgtatgctctagagctcttttcactgtttctagtgtttgttctcagagcatgagcttcaccatgtatttagtttaacttaatcactaaaagaataaaatgtacattgtctgcacactgttgccccttcccagaagttattttttattgttttagaatagatactcacatatcctatgtaaaatgtttgttcccaacagagggacctttctacccagtccctagaccccactcagaagaaacagcttcactcctgatacctcagatacacaggaatgtggttataaattttcctcctattgccttgtaattataagttagataacctgagacagagtttggaactagtgctttcttgcttctaagcagggacttagacagaagccatgggaatgtgagtctggcttacttttgctatgatttcctgctcttggtcattttcttgggccagaggcatgagagaagccatgaaagcccagcttttctttttccctcgatctgctgccaggcagttgaacaaaagaaaaaaagagctatggagccaagctccagttatgccttcctggattctcctcccaacatttatgactgaaggggccctttgcctagttgggaagatggctgggtagcttgaggcaagcataagcaggtgagttggaaccgttcatcatcttcctgacaaaataaagaataccgtcatctggtatgtatccggtacatttcttgaaaggatcccaaagcccagtgtatttctgaacctccactctgaatttgtttcatttacttatttaagataaagaagcaaaagcccagaagggcagtgacttttccatgtcatgcactgaatcacgtggcagagctgagtatagatcccagatgttctgataacatgatccaaactataatcccatgtgattacacactattttgaaagtcattgtcagtgttaccacaatgtcaacctaaagaggtatttttttctcctttatgatatgtagaagctgaattagagtgaatcaaagatatcagatgatgcttagaaagagcagtactttttttttaatgtttttgcttagaaacactgtcttacagtaagaggacctaagggcagagggaggagctcaattaataaatagtgctaatgagaccaagcaaattcatttccttcctgagagtgtctcctagcagccctttcttagtcttctcttccatcccaaccatctgccctatagatacgtgctattagtcatttggaattggattaggaattcaaaccaaagtctaggtaaaatagtcaatagtatttatctgtcattaatccatcacttatttttaagaaagaaacaatgagtgcacagcctaataatggaggtctctctgtgaaatgaggcacattatacatttcaacagctctactgaaattgagtaccagaatacagaacttaactcaaataatattatattgagtataagaataagaaaggtttttttttttggtttgtttcctacataattggggtgagtggataaaagtagtttaaacatcctaaggggtagacaagattaatttgatgttcgtgacacggcccaagtacctgtttatcttaaaagcgcatgatgtatgggaacagaatggaaaaataaggccaggtgagtaaaattgttcagagattttaaaaattaaaaaaagaaaaaagacattagtgaaggagtgcagtaaatagccaacagctgttttcattctcctgaaaagtagtgaagtagtgatggcaataattatgaagaaattgaatgccgagtaagagaatgcagtaatggatttagaacctattagaatgagccataggaaaaggtataaatgggttgtgatggaggccaaggacagagaattcatttggttaatgtcccagtatctataataatcagtgaaagaacaagaaaatcatattaagaaagcaaaagcagactgggcacagtggctcacatttgtcatcacagcactttgggaggctgaggcaggaggatcactcgaggccaggagtttgaggctgcagggagtggtgatcatgcactgcactccagcctgggcaacagagcaagaccttgtctttaaaaataaataaactaattaattaaattagataaaaaagcgaagacctgactcattcacattttcctccagaaatagaatctttctaacttcttgacagaaaggggatataataacctctttgactaaaggagacaaagacagaaaatgtgcaggccaggtatcattcacagaaagaaaggggaagtggaggatttttacattttaagacccaactggtattctgctattgctggtttactttgtggcccctttttgttatttcccttggcatgaaaagtatcatttgttatgtgatttgttaaaggtaactctaaattctgttatctgtactcctaacaaaataaagaattccatcatctggtatggatctgttaacgtttcttaaaaggaccgcaaatcaaagtgtatttcctatccccttttggaatttactggcctctgtctttgggcttagggagcgtaaaaggcagcgtggagcacatggctctagctccctccctgtggccagccttaaacagattactgctaagtcatctgaccactagggagttcagttcagaggacgagctaaagtagaaaaattatttgggaaagccatgaagtaaaattgcttggccatggtgcttattaaagatgacacttcacctgaatgagggaattagtagttaacaagaacaggactagaaaaggggtttattgaattacattgaatatttttaaaatctcatcacttctgctcttagtaggaacatgataaacagttctgacattttagaagagggtgagttgtattaacattgatggaacagttaaaagagagaagttgtagtacagcttacatatgtgcctatacatatagaaaatctcatagttctgcccttatcagatgcttgcagagtattctgcagacttccctccagctgtttgttaaatgaggttagtctgttcgctagttgaagagacttgtggaggaaatcatgtggcatgctttaacactctcagcagcctgtgacttctgttttgcctttgccattagcctctaaccttctcctcttctcctctttcttcatttaccattttgtgtttgtggcaagtattttaaatgtaccactaactaatgtctttgaaatgtggcattgcttattaacccagatgcccacgtgtgtcttaattcggagggatggtgccttggagaacctgtgccgcaaaagtttagtctcttccttgaatggatatgttggatattttattttgttcaaagttgagtcaaaatttttggaatcatctatatttctcccacaaacaggttttggccatcagtacttgaaaacagttctatggctggcatcctggatcaaggggcagtctgtttccagggaacctaaaatatttaacagtaaagatgatgctaaaaccaaagaaaagtaatttttcttatctgcatggccagtcactggctacgtgcctagttactcatgtcattcacagaagtgtactgtagcatgcagctgtgggctctcgggtagggggaatggagggtaggtttttttgtctgtttgggggtggctttttgacctttttaaaaacttgagttgaaaattattttttgcactgtatgtttaacaatgcccttgactaggcatctaagatattaaccagcttcagcagattatgcgtctgacaggaacaccccccgcttatctcattaacaggatgccaagccatgaggtgagaacaaagagactgtacagggatgtcgcactgagaagccacattctcattttattgccaccgtataaccaacagttcttaacatcactggatgcttgcatgtgccttgaggcctgcctatgtgctattgcaagatgttgacttttgggataaaatgtcatccagtcctgtgagattgggaatataattagtaagcttgtaaatggaaaattgttatttttatatttggttgtgtgaatttagtgcttgtgaggcggtttctttctaggtgctctgcctgtagctagggtgtgctactatcgtgacctttatcagaagggtagttaactgaagtccattagcatgctttccaattcatccatttttttaatgaccaaaagaggattctttatttaaaaacaaaactgaaatatccaatactaatatgtactatatttaaaagaaaatacacaaataatatagaataaatacaaacactttggtacagttaggtaccttctttattaattattaactacttagtctaactcttgttttattatcagagatgattggggcacttctttctttgtaagatacccttaatattttggggaaccaggttggcatcacagagggcccttcccagcagctttgtttctacttcagctatattcaggtcgtcttttgatttatctttattaaagggatgactgttctctgaatgagatagttctctcttacctgttttcccttcctctttttatttacatgttcaagtagaaagggattacagccatttatgtattcaattcctaaaactttcttttcaaatcagaaagattctcaattgcttttcaaagcagacctttcctcctgactccacatgcaataattaagaagcggaaggctgggtgtggtggcgtgcacctgcaacctcagcactttggaaggctgagatgggaggatcagttgagcccaggagtttgagaccatcctgggcaacacagcaatactgcagctctacaaaaaaatttaaaaattagggcatgatagcacatgcctgtagtcccagctacttgggaagctgaggcaggagggttgcttgagtcaggagttagaggccatagtgagctgtgattgtgccagtgacctccagcctaggcaacagagcagagactgtgtctctaaaaaaatttttttaataaataaagaaggtgaacttgcccaagcaaccagatttttttttttttaagacaggatcttaactctgtcaccccagctggagtgcagtggcacgatcttagctcactggaacctccacctcctgggctcaagcttcctgggctccatctccctgctcaagcgatcctgttacctcagtctcccaagtagctgggaccacaggcatgcgtcaccacacctggctaattttttgtatttttggagacaagttttcaccatgttacccaggctggtctcaaagtcctgggctcaagcgatctgcccaccttggcctcccaaagtgctgggattacaggcgtgagtcaccgtgcctgggcaaccagaactttttataaacttgtgtgtgtatgtgtaaacataaatatacatacatacttttactgttggactgtattaaaacaggagttttaaagaggtggttaagatagacagcagactttgcttctgaaggtgatagtgggatagcagataatgtttcttgaactgtcacttggaaccaagtactgtgttaagaaagtactaggtttgttatctctaatcttcactccaaccctgtgaggtaggactgttatattaagtttatattaacttttttgttaccaccgttactttgttagcaaggtttaatattgatatcctttgatgtactaagagcacctactgaagtcagcactgtcaaaagactgctggtccaagacttgctttgggaataccaacccctctaccaatttagctgtttgagaaggctgtctcagggctacttcttacatatcttggcctcagtttttaaacttctcatcctgtgatcagaaagctaatgaaagagaatttgattgatgagcattctcgttcacttgaaatgcaactgtgagagatagcaggaataaagaaggtgatgatcataactagggaagttaggatggcagtaagggagaagttctatcaaagacagttagaaacactgaagttagtggactttgtcagttaacactcgttccttagcaggaccaagattctttctttgagagcagtaacattattgaacaaagtcattctgaaaacccttgttttttcaggcaagaaactatattcagtctttgactcagatgccgaagatgaactttgcgaatgtatttattggtgccaatcccctgggtaagttgaccatatatcctcacctcatggatattgaattggttatgatataaattggggatttgaagaagagtttctccttttgaccaaataaagtaccattagttgaatcttggaaggtgataaatacggcttttattatctatttgtgttgtcagatttttttttaatcacatgagatgattgtatgtttaaatgatcacagaacttgggattgggggaatgggcaggtacagtggagaaaggagagaaagtaatgggaatgttgagagaaaagattggtgaggcaggaagaagcagatacagaagaaagctgtaacttgctcacaactgctgtggatttatggtgtctctgagtggaggacagaaaccactgaagtgcaggtgggtgtttagaggagccacccaggagctccctgcagggtgctctgctctaacggtagctgccgttgctacagatcctgtcgtcttccacactcatgaacttttcccctctcctcttctttctctgccctcagaggcataaccgtcctctcctgtttgtggagcttatttgctacctaaacttaaaggaatggcttcctatgccttcaagatccttggcagagggaagtgatggtggcagctgaagatatgtgttgccttggctaaaaaaggagttgctttattattattatttatttatttatttatttatttattttggtagtgtcagggtctcgctcttttacccaggctagagtacagtggcacaatcatagctcactgcaagcttgaactcctgggctccagtgatcctcctgcctcagccttccaaatagctaggactacaggcatgcatccccaagcctggctaattttttaaagaattctttgtagagacagggtctcaccatcttactaatcgtggactcctggactcatgcagtctgcccacttcaacttccaaaagtgctgggattcagacgtgagacactgtgcctggcggactatattctttgaaggggaggagtgatgtgtgcttcagatggcccctgaaagctgctttgcctgaggctcattccctgactcttgaagaggacagtggacagtgctgtttaatggtggacacagaaggatcagaccaggacctccctacaatagggaagggagctatgctatggtaacgagtataatctgccttctcacttttcttaagattgtattgtgtggtgtgttttaaaatctcactgcatttctttgcatctgtttgggtcatctgtcttcttaagggtcttggcagctatgcttcaggtttagttttatctttttgagggctgacagccatgctgacctctttagaagctggggtgaaggctaggtgattttacctttttaagtacttcatccatagtgattatggagaggaattttagtgtcgctgtgataattcttataatagcagagatactcacgctctttgaagttttgggcagttgtggatgagttcgtgtcagccttggagacagagagtatgtcatatctcagctgggtcgctctcctgccctaggatgaatccacagtctcatcaggggtgggtacgattctactgagactggcttaggtttgcatctgccctggcatgctctcattggctttgtgtgatttatttgagctgtattatctagttcaagggtctgtgagaagctctctttgagccttaagtactacaggatgttgggaaaagatgttgtgttctttctttccttttttttttgagacagagtctcgctctgtcgtccaggttggagtgcagtggtgcgatctcggctcattgcaagctccacctcccggctttaagtgattcttctgcctcagcctcctgagtagctgggaatacaagtgtgtgccaccacacctggctaattttttgtatctttagtaaagacggggtttcaccgtgttagccaggatggtctcgatctcctgacctcgtgacctgcccgcctcggcctcccaaagtgctgggattacaggcatgagccactgcacccagcccgtcgtgttctttcttgtcgtcattctgttctgaagttgtttcattttataagccttaagttttgaacagggcagtactcactgacaccctcttaacagactcagaaagatgtgttaattcattttttagggggagaggggagatatttgtgttccagcagcttatttaggtcacatacctcctgataggtcttcccattctttgaaatcatgacattgaaacctccaaaagaactagataccactttgctaatgagttgaaaggaggctttggtccatctggtgctcagcactgtacttctcagcatttaaacgtgccttacagcccattgccaaacagtgatgtcatataatgaggctccccttgctgggcagatggagcacagtgttactatcacaagctcgtgcccagcatattaactgagcaggaacatgccagaaatataaatattaacagctctgttttgtcagccactgactttgtttcactgctattcccaaaacatgaattaaaacttaaattaccccttgatgttagtgtatgtatttatctgtcaagattttttttttttaagagatggcatctcactctgtcacccaggttagagtacagtggcacagtcacggttcatgataacctcgaactcttgtgtttaagtgatccttcctcttccctatcccaagtagctgagacaacaggcacataatgccatgcccagctaataagatctttgaggaatttgttcttgcccctgaccttattggttataagaacatggtcctttttaccctaagggtaacagagacttgtcgtataatctgtgttcaattataaaatcaacagctgataaggtttctttttctaagaagagaagaccatcagaagaatatatatatatataatccaggcattcacctagtactgtaaagtgtaaacttatgaacttgaattgacacatgaatatttactttgtttctgtatccccttgaagcccatatttctccagtggattactctggaattcaagctgtaggacgggtgttttacagcctccaatatacacagcagtagatctctataggaagctgtcctcttcactactcacccccacaccctccacatttaaggagtaatttgcaaagtctcaaaagcctttttcaccacagtgataactggttatatggcagtatttattctcccaagtgccaccatgctgaaacacaaaaatactcatttgaaatatagagttagacaaattaccattttgtaaccccttatgaaataattgcttttgggaaggaaacccagtgaatgcagaaagccataagtgaaaagaatggatatttacttggtaccaaaatatcccgcagattacttgctttggtcaaaggggaaacatcttaacccagtgatcaattttagctcattagtagtgggacagatggccttaatgcactgtcacgtgcacagcatcacctgtatttttgctgaaaatgtttaacctgattcttaccaaaatttttgacctaacttccggtttttgggaagtacaggggatagtggaaagcagggtatagacacatgacagcaaaagaagcaaaatcagacacatcccgagaaacggtcattctcaggacaatcagagggtctctttagatcaaaatcaggaaagaacagggcttagaagtaagaagattattctagactaagagagactaaagaaaaccagtcagttgcagtgcatggcccctaattgaatcctggtttcaacaaactagttctaaaagacaacgttggaataattggagaaatcttaacatgaactggattttagatgatatttagaaattatttgtcagagataataacagtattatgattatataggaagatgtcttcgtgttgaaatatttggggagggtaaagtgtcatgtctataattttattttaaaacagttcagaaaaaaatacatataaatacagaaatataaaaatgttaattgttgaatatgctaggcatatgagtgttcactttatcatagtttttacttttctgtttctgtatatttgaaatttttcatagtgaaatttttaaaaataaaattccctttgattttaataccatgtctcaccctcatcaccatgtaaaacccccagtttattcactgtttgaagatctgttgatgaatatttgatgttagtaaataaacagcttagggggacaaaaaaaaaacagccctgcctacctattgtaggttacttcagctgtaggctttgttttatacagtttgactacactggtagcagtttgacattgacggtccacaaaagcctgttcaaacagaatcccagtcatttaaaaaaattcttctttagtaacatattctttaaaaatacaaaatacaggaggagggtgagggttgagagataacctatcgggtacaatgttcactatttggttaatgggcacgctagaagcccagtccccatcagtccgtggtgagacccatgtaacaaatgtgcacatgtacccccaaatcaaaaataaaataaaaaaattttaaaacatagaaaatacagatacacacacacacacacacacacatacacacataaaggagaagagggctaatatatcctagagtaggtattttggaggagagttctttgtttggatatgaagggtcaaaactatgtttgctcaataaggcatacttttttgtaacatgttaaaaactcttttccttcctgtctatggtactgatagctgtcgacttgctggagaagatgcttgtattggactcagataagagaattacagcggcccaagcccttgcacatgcctactttgctcagtaccacgatcctgatgatgaaccagtggccgatccttatgatcagtcctttgaaagcagggacctccttatagatgagtggaaaagtaagtcctaagggtaggattaacatcttgaaccactaaccaaaagcggtgggaaaaataaaaactgaatggtcataaccaacttgctaaagcttgtagatgaggtctctaatgcagaatgaatatgttctctggtggaaactgttgtagacagtgatactctctggacctttgagatacttatgtctggtctgattttatgcacagcccctcacataggagttttgcatggagagttgaggttttcagagtcattgcatttacaacatctctctgagcttttacagttttacaattagtagaactggggcaaagagaatttatgtcttatcagttaacttagaactagttagggacatagccaggaatggaacccatgtatcctgtgtccagtcccatattctttccacaaaacacaagttcagaactctagttaaatcccaagagccaagaccatctgttgctgtagcttgtgagagtgctctttcattcttgagcacctccgtagagagcttaaaagaagaggcactcagcgatgaaaaacatgagaaaaaaaatggttcttttctatgtcccttgaacttctgtgtgataacgtgttccagtaggctattacatacaagctgtgaggtagcccatcaaaccactacctggacagagaggaaggatcttgagcttagaagtcagagtgcttgccagcaaagagaatagcctaaactctcacatcttacttttccttcccaatttctaggcctgacctatgatgaagtcatcagctttgtgccaccaccccttgaccaagaagagatggagtcctgagcacctggtttctgttctgttgatcccacttcactgtgaggggaaggccttttcacgggaactctccaaatattattcaagtgcctcttgttgcagagatttcctccatggtggaagggggtgtgcgtgcgtgtgcgtgcgtgttagtgtgtgtgcatgtgtgtgtctgtctttgtgggagggtaagacaatatgaacaaactatgatcacagtgactttacaggaggttgtggatgctccagggcagcctccaccttgctcttctttctgagagttggctcaggcagacaagagctgctgtccttttaggaatatgttcaatgcaaagtaaaaaaatatgaattgtccccaatcccggtcatgcttttgccactttggcttctcctgtgaccccaccttgacggtggggcgtagacttgacaacatcccacagtggcacggagagaaggcccataccttctggttgcttcagacctgacaccgtccctcagtgatacgtacagccaaaaaggaccaactggcttctgtgcactagcctgtgattaacttgcttagtatggttctcagatcttgacagtatatttgaaactgtaaatatgtttgtgccttaaaaggagagaagaaagtgtagatagttaaaagactgcagctgctgaagttctgagccgggcaagtcgagagggctgttggacagctgcttgtgggcccggagtaatcaggcagccttcataggcggtcatgtgtgcatgtgagcacatgcgtatatgtgcgtctctctttctccctcacccccaggtgttgccatttctctgcttacccttcacctttggtgcagaggtttcttgaatatctgccccagtagtcagaagcaggttcttgatgtcatgtacttcctgtgtactctttatttctagcagagtgaggatgtgttttgcacgtcttgctatttgagcatgcacagctgcttgtcctgctctcttcaggaggccctggtgtcaggcaggtttgccagtgaagacttcttgggtagtttagatcccatgtcacctcagctgatattatggcaagtgatatcacctctcttcagcccctagtgctattctgtgttgaacacaattgatacttcaggtgcttttgatgtgaaaatcatgaaaagaggaacaggtggatgtatagcatttttattcatgccatctgttttcaaccaactatttttgaggaattatcatgggaaaagaccagggcttttcccaggaatatcccaaacttcggaaacaagttattctcttcactcccaataactaatgctaagaaatgctgaaaatcaaagtaaaaaattaaagcccataaggccagaaactccttttgctgtctttctctaaatatgattactttaaaataaaaaagtaacaaggtgtcttttccactcctatggaaaagggtcttcttggcagcttaacattgacttcttggtttggggagaaataaattttgtttcagaattttgtatattgtaggaatcctttgagaatgtgattccttttgatggggagaaagggcaaattattttaatattttgtattttcaactttataaagataaaatatcctcaggggtggagaagtgtcgttttcataacttgctgaatttcaggcattttgttctacatgaggactcatatatttaagccttttgtgtaataagaaagtataaagtcacttccagtgttggctgtgtgacagaatcttgtatttgggccaaggtgtttccatttctcaatcagtgcagtgatacatgtactccagagggacagggtggaccccctgagtcaactggagcaagaaggaaggaggcagactgatggcgattccctctcacccgggactctccccctttcaaggaaagtgaacctttaaagtaaaggcctcatctcctttattgcagttcaaatcctcaccatccacagcaagatgaattttatcagccatgtttggttgtaaatgctcgtgtgatttcctacagaaatactgctctgaatattttgtaataaaggtctttgcacatgtgaccacatacgtgttaggaggctgcatgctctggaagcctggactctaagctggagctcttggaagagctcttcggtttctgagcataatgctcccatctcctgatttctctgaacagaaaacaaaagagagaatgagggaaattgctattttatttgtattcatgaacttggctgtaatcagttatgccgtataggatgtcagacaataccactggttaaaataaagcctatttttcaaatttagtgagtttctcaagtttattatatttttctcttgtttttatttaatgcacaatatggcattatatcaatatcctttaaactgtgacctggcatacttgtctgacagatcttaatactactcctaacatttagaaaatgttgataaagcttcttagttgtacattttttggtgaagagtatccaggtctttgctgtggatgggtaaagcaaagagcaaatgaacgaagtattaagcattggggcctgtcttatctacactcgagtgtaagagtggccgaaatgacagggctcagcagactgtggcctgagggccaaatctggcccaccacctgtttggtgtagcctgctaagaatggcttttacatttttaaatggttgggaaagaaaaaaaaagaagtagtagattttgtagcatgtgatgtaagtaatgtaaaacttaaattccagtatccataaataaagttttatgagaacagagccgcactcatctgtttatgtattgtctgtggctgcttttgtgctacagtgacagaggcaaatagttgcagcagagactataggacctccaaaatgtcaaccatttaccatctggccctttagagaagtctgctgacccttggcccagggctacagttttctcatctataaagtgaagttcaggtttttttcatctttgacatttgagactatctataagccatatatttttattataaaactgccagagagaaggtttggtttgtatatataggtgtacattgtttgtaagcttttaggcgaatgtattttatgactctgttttgtcttagctggctacggtccttgaaaatattcttcagaatgactgaattgcatcacgggatgaaagagccacggggtctcacagctgagttctcagggactttgctgatgtgcttcctttcttggtgtccttggaatgacacccagcaggtgtcccagggtggattgtggggctcagcctgtgaggatattgagagctgggtttttgtccaggccctggctggcagctgggaatgaaggcagtgatcgaaggcagaccaagcatagtctcctttccatccccagtgacttcgtaaggaggtgagagaaaagggccccggttgttacatggggtcctttagctcctgttaagaatcagacagttggccgggcgtggtggctcacgcctgtaatctcagcactttgggaggctgaggcgggcagatcacgaggtcaggagatcgagaccatcctggctaacacggtgaaaccccgtctctactaaaaatacaaaaaattagctgggcgtggtggtgcatgcctgtaatcccagctattcaggaggctgaggcgggagaatggtatgaaccagggaggcggaacttgcagtgagccaagatcatgccactgcactccagcctgggtgacagagtgagactccgtctcaaaaaaaaaaaaagaatcagaccgttgtagggagtattttgccttcacataccagacatgagacatgagaacagccttcctcctaggcttctgagaagagggcctgcttagcccaaagagagctgacaccacaaaaagctcccctgaagtgaatccacttaaaacggggaccaaaatttcatatgtggtggacactgggggataggggaaacctgaatggaactttaatcatgaaaatggaacaaaatgacaaaagcatgttcataattttaaagatatattaattctgacaaggaaattaagttgtttttgaagtgaaactgattttgtatcttacaataattttctcatttgatttttgcaacgtgatcatagaaggaagttttgcaaaaatatttgagggcttcatcagttttcagaaggcctcttgatattttgatattcacattcttttttataagtatctatcggtgatcacctcctcaactttccttttattgttaactggtctgagtctgtcacccacacttttcagagcttttgcttaaggtttgagcagttttctagcattatttatcaacttcatcaaatccaccaccatttgcaagatttgtgattattgcaattaagttgcattctatttgtgtcatttgtcatatgcttacagtataaccatagagactaacagaagaccagaatacagtgggcaggataaatacattggcttcaggtacttaagaagcaaagagggactaactttttataaatagctcattagtgaatgttttcacattgggatgactttcacttctctatataatttggtagctgcaaggacttggttaatgaatatgcaaataataaagacccccttttatttataatgcagatatgttttaataatgtacatgccctttgaacttagcatttacacttctcagaagtcttcagcctgagcaacatagctggggactcttgactctacattagccaggtgtggtggtgcatgccttgtagtcccagctgcttgggaggctgaggtgggaggatctcttgagcccaggagttcaaggctgcagtgagtcatggttgtgccactgcattccagcctgggtgacatagtgagaccctgtctcataaaaaaaaaaaaaaaaaaaaaaaaaggtcttaagtgcacaaagtagaatgtttttcagtgtcacattctttgtacagcaaaatactggaagtaacccacatatctatgaataaggacttgattgaataagatggtcatctgtgcagtggaataccatccagctaggcatggatagatgtgcaacatacattgtgaaggagaaaaagtcagtggcaaactgtagtatcctagcccccttttttgttgataggtaatgcctggctaggaaatgaatatacattgaactgttagcaaccatctctaggcagtgggattgtgccctttaatttttatgctatttctgtaatgtgtacctttttttacactgagagttttgttttgtgatcagaagaaaccttttctttctttgttttgttttttaatgagaaaggtgtttaaaagtctatgtgacctggggaaccattctcaaatttcagttttgccagggctagagcccagcctttcaaggcaggagaacagttgctggaaagaaattgcacccagctgttaggcctctggcaagcaaagccgcaccagtactttgtagcggcattctccacccagctgggagggtttggttgtttcttcttcagtagaagggtgtattttaaggatcttaagcaggatttttcaattttggcactattggcatctcagaccagataattatttgttgtggaagctgtcctgtgcagtgtagggtgttaggcagcatccctggcctctacccactaatgccagtagcactcatgctcccttcccccagttgggatagccagagatgtctccagatgttgttgccaaatggcttctggggaacaaaatcatccctggttgaaaaccatgaatctaacacttcatccctcctaatcttgcagaacaccaaagcctcttttcttgaaaaaagagttaacacccactggcctgttgtaacttaaagaagtagtttggtggccgggcacggtggctcatgcctgtaatcccagcactttgggaggccgaggtgggcggatcacctgaggtcaggagttcaaaaccagcctggccaacatggcaaaaccctgtctctactaaaaatacaaaaaattagccgggcttggtggtgggcacctgtaatcccagctacttgggaggctgaggcaggagaatcgcttgaacctgggaggcggaggttgcagtgagccaagatgacaccgcagcactccagcctgggcaacaagagtggaactctgtttaaaaaaaaaaaaaaaaagtagcttggcatcttggaggaaaagtacaaattggaaaggcctttttagactcaaatacatatttttaggggaaatatgtttggtactgaataaaggtcatttcatttcttaaaaaaaaacagtaggttgagtaaattaagttatcctttgttcagaagttctttgccattatccacaggcagaaaatctggtaattaaactgggggtatgactacaagattttcttagaccagtaaggaaataacaaatctcaatgtgcctggtgtgttgtcgacactcaagatactggttagtctgcatctcacgagttgacagggggcatcgaggctgtcttgttagggggagtttgcagccttctgcatctgggaacagtgtgtgtctctaaagccaactggggagagagcttctgaggacaaatggtcctgaggcagtttctggaaaacccattattgaagccataggctgtggtctaagtacgcatagccagtgggataatgttatattgcagagttatttgagtagttcaatttaaggaaggtgctttgtttagaagttattataagttaaataaggaagtaaccttcagtttgcaactaaaaatagaaactgccaccaccatttgagtgtcagttgcagcagaaaagaagaaggtgtaaaaccacagacccagcctagattcttaacaaaaaccagtggttctaaactcttgtcagatctattaccctttgcataactaatattttataatacctcttttataatgctgaggtgaaattcatagataattcacacaatttcaaagaaaatataatgatccaatataaatgacaaaggaaaaatacgaatacatttccatatataagtgctggctgggcatggtggctcgcacctgtaatcccggcactttgggaggctgaggcgggcagaacacttgaggtcaggagtttaggatgagcctggccaacatggagaaacccgtctctacagaaaatttttaaaacgttaactggggcggggcgcagtggcttacacctgtaatcacagcactttgggaggctgaggcaagtggatcactcgccatcctggccaacatggtgaaaccccatctctactaaaaatacgaaattagtacaagatagaaaaattagtcagctgtggtggcacccacctgggtcccagctactcaggaggctgaggcgggaaaattgcttgaacctgggaggtggatcttgcagtaagctgagatcatgccactgcactccagcctgggcaacagagggagactccgtctcaaaaaaaaaaaaaaaaatgaaaaaataaaaagttatctgggcatggtggcacacacctgtagtcccagctactgaggaggctgaggcaggaagattgcttaagccatggaggttgaggctgcagtgagccatgatcattccactgcactccagcctgggtgacagagtgagaccctgtctaaaaaaaaataaaaagtaaattctcaggcatagctacataaaagaaataatgaagtagttagatgcttgtacctatacatagaatcaccttgaatatgacagctccaaatgcgtactgatacagttgtgttgtcttgacaactcagataccatggctgactgctgtcagtcatgatttttctgaaagtggtaagcaactcttggtaaaaatttcaaacaaacaattagaatctttttttttttttggacagggtctcagtctgttgcccagcctggagaacttttttatttactcagttgtgatcctgggaaatgtaagtatattaatatgcagaaaagtatttgtttgatatgtaaaaccaagttacagtctaggctcagataatcataaatagttttttccaccttcatgaatgtccagcaggatgtttgtaatgtgaagcaattcttgttaagaatcccactctgcacagtggcccgtgcatgctcatatcagtaatactcctgatcagtatgataaccaaaaatggccccagagatttcagtgcacccgctgagaactgctgacagatcaaatgactctgggacacctggagtcctaagaagtgaaacctccacaatgcaggacagacctggctccctatggtcttccttccttccttcacctccttccccctactttccttacctccctactaaaaagtagttcttttaatgaactgctactgtatgttaggcaatttacattcttgcatattctatacaagtaatgtctctttctcagtcacgttacaactgaggctagattcaacagactatcctgatatcaacgttgaaagactcctggttccaaagagttttatagcattggtgttagacaatcctcttttggtttttttaaagaaaatttaaaaaaattaattcagcataatttccataaggactccctggctgctgctggccaaattggggaggagtccctggcagccacagccaggcactggtgccttatcttgttcagcacacactgggtctctctccctagttccaggccccttgccctcgcttctctactcatctgggatagaaatgcacctccaggcctctgaagagaaactaccttttccctctttcagccaaaagggctcaagccagcactcgctttgtatgtcctagaagatgagcatgcttccctctggctctctatagcagtgctctaatgggacaaagtcactgtgtgctcttgctttctctcctggtctttgtgcgtgatagtccctctctctagaaccctcttcctcctcctcattcctctgagctaatgtattcgttcttctgttcagccttgacatcactccctcagtaaatttctgaccattcccaagcctggattagctgtgtcttctgcatgcaccctgtaatctggaatgatcattggtggcactgattacactgctttatcattgcttgctgtttgtaccacctgctcaaaaaagaaaaacatataaaggttaaggatacaggctctggaacctttgatgtgattaagtaatttgctcaagattgtaccaataatagagagtggggctgtgaggactaaatgagttaagacatgaaaaaccctgagtatacagtaaatgctaaatactggcttaaggctgcatgtcatcgaagacagatcatgtcttgttcactgtggtgtccctgtcacctagcttggtacctggcacacagtaggcattcagtccttattgaccgagtccataaatgactgtcagcttttaatcccttgcagatcaccttgtcttttgcttcctgtttttacaatcaatagtctttagaagcaaagatcatttaaagaaaaaccaaatatgtaggggttatctgccttgcctaagaaatggtgctgtgtggaatttccttgtttaagaagagatacgtgttagaagaattggcttctgattctctttgctgtgtcttgctgtgtaattcaagttggctgcacagcaatttaatgaattagaacaagaaccaaaagattattgaaagtggctgatggccataatctagataattcctactgtgtccccatccatctgccactttaaaatgaaaatagcaaggcaaaagaaagataattggaaggcattatggtgtcttgcaccctcattcagccattctacaaatatctattaggtaccttccatctgtcaggcactgggaatatgggaaagaataaaagtcaaattcctgtccccatggagttgttcgttgttttcatgggaaaaggcagtggtaaacaatgactgtaccatctcgctggcacccctagaacagaacatctaagcacctgttgctggaggccatttctgggccggtgcacctttgatccacctccctggcactcaactgacagacaacaggatttctcgtggcgtccagggctgcatgtcctcttgggttacctcgacctgatcagctggctccactgtgtgtttccagtgtgaggtgtgaggtcaccatccgctgccattacacaaagacccatttcccctgggccattgctcaagtatgacagagctgattgtcctgtatggaaactcagccactcacagctctgcccagtgagacaggcaatgactatctgatcatggttgctgacacagtgcttgtggtggggagtgtccctatctggaggcaaacagccgagtggctgctgtgccctcaacaagccccaccctgcttcacggtgaggaaacagcccccacccaaccagtcctctccccagcctccagttgagtcaggtgcccccctccaagtgtttatgtaatttgtgctgatcttaccagggtcaaagcacttaccacattactttgtctaactattattctttcatgacacaaaacatatttattgttgaaaatgtttaaatgtagtaggtaacatctattatcccactacctggaaataatagctgttgacagattggcataactccaagaaatttttttaaatctggaaaacatcgcttttaaaactcattattattcagtgatctgtgtcaataaatggcattgaaacagctagatagacactttcctccttcagccacaatcatttccagacaggtcaaagatttaaatggagaaaggctttcaaagcatgtccccaaacctagaaaccatgcaggaaaaggcaaatgaatttgcccgtgcaaaaactgtagagctttcatacattggcgtccatttggcaggattcagtaagggcagaagctgtacatagctgcggttctaggtaattctagaactttctagaagctttctcgtatgtcaacaaggaacagagtacagacttttcactcaacatcatttgtaatagcaggaaaaaatgggaacaaacctcaaacaccatcaataggggaataggaaataaactgcagtatgtattcatgcaatgaaatattaaatggcagtgaagacaaatgaactagaatgattcccccaccaccaccccagacccctgattttgcctctgtcccaggaacaataggcaatgtctggagacctttttagttgtcacacttggaggtgagggtggtgagcatctagtgggtagaggccagggatgctgctgaacattttgcgacgcacaggacggcccccacaacgaggaattacccagcagaaacatgtcagcagtgccgaggctgagaaacagagacgactcaacatcttggcagatctcaccaacaaccttaagtgaaaaaggaggctgcaaaacgatctatctggcatcgtttacagatgcatacgtatatagtaaaactaaaagcagacgagaataataaacaccaacttgtagaggggtcacctctagggagggagagagggcatggaatcagagaggggcatgaaagggcttcagctgccaagagccagacagcttaggttctaatcccggttccaccactgacactgtgtaacctccgcaggttgcttgatcaatcggggcctcagttatcacaactgtaaaatgggatgatattgataatagtgccttcttcacaggattgtggtgagggttaaatacgttaaccaatgtagagcacttagaacagtgtgtggctcatagtaagaactatatgtttttgtcaccgttttcatcatgatgatgagtatctatgatgttctatttttaaaatatcagaagtgaatatggcatgtgtgtgaaacatctcagcgttctgccttgacaaggaccttcactcctcctcccacccccaccagccaagtgaatttcaccctcagcacttagtctatatttgttaaggctggccatccggaacatactctccaaatctgagacaattcatccaagcagtgtgtttccttttcctcttcccccaccaccaccgccaccccccaccatgatgctggaaacttttctttattgatacagatgatgagcaatgcggtgataagtgtgtatcccccggctgttttcgcgttttcactaaattgatggctatgggattaccggattaacaaggtgcacattttgacactttggcagcattgccaaatggttctaaaagcttgccccagttgacactcccacctgccgacgacagtgttgtcactgtttcctgttgccgccctcactagggtaggagcttctcaagcacaggaactgtgacatttgtccgtgtattctcaatgtcttgagaggtgcctggcaaaatttggttgaatggattaaggctttaccttaatcaccaggtaggtaaggaggatagagaaaaataagacactcgtgccctcaagaacttacaatttaggtttgtttgaaagttaactgagaattccaagtctaagggtgctggtgagagtggcctggcaaagccagcccaggaagagctgctgagcaggttgtaaggaacgaggatgccccaccccccctccttggcaaagcagaggatggtattccagacaggtcacaaacagctcaagcaaagacgtggtgacagggatgaggaaggcacgcttgcggatcgctagaatggaggttgcctgggcacagacaccttggaggatccgattagcaagaaaggcagggcctgtccggatgggggcaagccttgcccaacagactaagaagtttaatctttatcctagaggccactgagagctaccgggggtggggcgttatggggaggcagggctgctctgaaacaggaagattaatcacagctgggctgcctgccgctggctgcctgtcacatgggagctgtgctgccctcaagctgcccagctggagcaccctctttccaggtgaccaaagctggatccgggtgccccctggcttaggaagggcagccctgggcaagtgtgagggagtgaagaccaggcctgagaagcagggagaagctgtttgtcagggaagtgtagtcaccaggatcagggtggcttcccctccacagccccttactcatccctgttgccacacctgtgctcgggctgacagtgacagtggtgtcctggagctctctgtgactcttatttttttagagacagggtcttgcaatgttctttctacttaattttatttcttacaaaagattggcctttcacaagcatcatccagcgcagctaagcatagtggttactagcactgaccctgggcaagactacctggtcttcactcccagctctagtgcttactagctgtgtgtccttgggcaagtcacttcacctctctgtgtctcattgttatacataaaatgggggatactgttaacccatctcatagagtcctcaggaggattaagttacatgtatgtaaagctcttataacaacttttgggaagtaattagtgctctttccatgtttattaaatgcatataatagaaaatgaatgtatccagagaggcagtctgacttacctaaggtcacacagcaaattagagacagagctagaatcagagcccaaacctctgccatggcaggtagccctgctagtcttgtttggggttatttgcccctgaccaaggtccatagggcttctggggaggatctatgtgtcctgacattggatagtttacttagaaggggtggagcaaggagaccctgtggcctctgccctggacaggcaggttgtggaggtggcctccagggtgcacagcttctcctgcctgaggcaggctgcacacaggagtccaggcaggacctgactccattactgcggtttgtcaggtcagcacagcagagactgccccaggcacgaaggtgagttgggcctgcatatcagctgcacacagacagagatgcagcgataacaaggctgctggggataaggccctgctacatccctgccattcggccagtcaccggctgccaggcactcttccaggtacgtggaattcagtgatgaacaaaatagacaaagcccctaccctcgccaacctcaagacattctattagaggggggcagacaataaacaggtacacagggcttgaagaacacgaggccaggtaaggcaggtgagcatggcttgtaatgaggtcagggggacctcggaggaggtgacacatgagcagtcctgaaggaccagagggagcaccatgcacaatgcctgcaacctggcatgtgttgcttcagtaaaccctcctggtgtccctggctatgcaagtgacattctcccatcttactgatgaggaagctccacctgtagctacaaatggaggcacgagattcagactcagccctgtctcccagaactcagctacctctctactggctcacaggagtacaagcacgcttcaagaatgtggacgtcacaaagcctgtggagggggaagcgggtggtgtgcagtgggggtcttggggagagggatatgcacagggttagtggggtgagtggatctagagttcactcgggaacacctccttgtagatgtgagtttagagttaggcttggaaagaaggaagggagggagagagggagggagggaaggaaagaggaaggaaggaaaggtggacaattccatagggagaggatctggctcatgcagagcttcagtgggagtggtgaggagggctgtccacagggaggaacctgctttggagtggatggtgcaaattcgtggcaagagaagaggcctcagattcaggttgtacactctggttctttcaccaccatacgaaggtccagcctcatgctaggaccttgggggccccacaaggatgaggcctctaggccttccctcagggagcaagggaagaacagcaaaatcagaaacatcctaggacagattgtatcagactgaacagtgaccacacatcccagatcccaccctgtggtaggctagccaagcatattcccctactattgcttactcggtcccaccatttgggtcttcaagccacatcttcctcctatgggtagtacccagaagagacacaaaactccttggttggttcagtcactaagtctttactgagcagctacaatgggccaggcacagtgccagggggctcagcagtggccagaatactgccctcgcccttacagagtcattgtccagaggtggagagggacatgtcacaggagacaatgcagattaatattatgctgaatgctaccaaggacaaggccgagatcaaacagagcggaggcctgggcaccagaccttaccccagccacatctttgtagggtggagtggagggtgacatgtgggctgggtgcagggaggcaggccttaggggtggagtggaacggggagtgtggaccggatggtgtggggagggaggtgtgaagaggggaagcctgtcatcccgaacccagaaggctggctgagaggtgcccgactcacagagctgtccccacccccgtcttccaccagggggtgctaaagctgaaggaggggagagaggaggaggtggaggaggtgcaggggagtgggggagggtgccttttctttcttgtctctctttctctctctctctctcctccctccctccctccctccctccctccctcccttccttccttccttccttccttcctgccttcctttcgttctttttgaaatgcagtttcactcttgttgcccaggctggggtgcagtggcacgatctcggctcactgcaacctctgcgtcctgggttcaagtgattctcctgcttcagcctcccaagtagctgggattacaagcaagcaccaccatgcccggctaatttttgtatttttagtagagatagggtttcaccttgttggccaggcaggtctcgaactcctgacctcaggtgatctgcctgcctcggcctcccaaagtgttgggattacaagcatgagccaccgcacctggctgatggtgccttatcttttgctgctgggatggatgttctgcttgagccctaagtctgctgaccagcccttgcccctgagaaggggaagaggtaatggggagacaaggttggggagatggccttgcaggaggagcccagcaccccatcaagtttccagaggctggctaggctcggtggctcatgcctgtaatcctagcactttgggaggccgaggcgggcggatcacctgagttcaggagttcgagaccagcctggccaacatggtgaaaccctgtctctactaaaaatacaaaaattagctggccatgcctataatcccagctgctcaggaggctgaggcaggagaattgcttgaacctgggaggcggaggttgcagtgagccgagatcgcgccattgcactccagcctgagtgacagagcaagactgtctcaaaaaaaaaaaaaaaagtttccggaggtcagtaaggtgtcccaggtgctctaagctgttcccctgagggacttaccagaggctgctggagtagggaagtaatgggcacaggaggaatgaggctgggtgcctggtctgcagggtcaagtgtcccctgaggggtttgggaggcaggcacctgctctttccccagatgtccgctgggctcactcccagacccactcaagggttgctcaaatgttgcctccgtagagagaccttccctgatcaaatagtactcactagtcctttagatccttactctgccttattttcttcatagcacttaataccacctgccactacatttagttgaaccatagagaagtattaaataccagcattttaaattacttgtttattgagacaaggtctcgctctgttgcccaggctgaagtgcagctcagtgcagcctcgacctcccaggctcaagtaatcctcccaccccagcctcctgagtagctgggaccacaggcgtgtgccaccatgcttggctaatttttattattattgttagtagaaacagggtttcaccatgttgtccaggctggtctcaaactcctgggttcaagtgatcctcccaccccagcctcccaaagtgctgggatacagccatgagctaccacgcccagccaacaaataaatgttgaatgaatgggtcaatgaatccttgggctgagtatctggcaaaaaacttaatagaggagttggacgtgagttggagccgactctcactgaggggacaccttctggggcagggactggacagccaaagggcaggggctggggttgggcagctggagtacccgggcagagctgacacagtccattggggaaggagcctctggcgagacctactgtgtgccaggcactgaattggacacttttctagtcatctcgtttagtcttcacaacagccctgtaacatgggtcttatcacccactctcgttttacaaatgagaaaacaggcttagaggagccaactaacttgtctaagatcacacagcttaccacgccacagagcagcccacatctgcagtctttcttctgcatctccctgcctccttgtaattttgcttgtttcatggagtcttgaaagccccagaagagcatgggactctctagagctggggccagagctctagggctccctggcctgtcccaccctcacaggaccccagatgtgtcatgctttctcatttctgtggaggtctcatggtgaggatgttcctgctggcccatcctcattatggtgaggaggttcatgctggtcctgccatatgggacagacagggtggctgctgtgctcgtggggcaagatagggtctgggtggccaggataggggacatgacagtctcatagttatgtggggcttttgtctcgatctctaagaaaccagtcaccaattcccacaccatgtctctgcctccagaggctcacaggctagctaggaagacaatgcaacaacagcagccacttctcaggcacttgctgggcaccaggaattctagttgacagttaaatgtgcagacttaggagccagatgccaggtatgaagatcatgttcaccactttcttagttatgtgcgaccttgggcaaattacataacctctccgggcctcagtctctccatctgtaccaggggaataattatattggaatagactagaccaaagcagccctgacatctgggagctgcctggtcctatcagccaggacttggttgctcagagctgtccagcctggtgcaattcggtcttgctgtgctgaacatagacgatttcacagacatcagcatagaacaaggccatccgcgaccagggcagactaagacaaaaatgaaactactccttaatcatatctgaacacagacaaaacatgaatattgtcaaatcacagaaatgacccaaatccccctgtagagctaagctgagtggaggctgctggtttaccagctgtagcttcagccttgctctagtctgctttccttctaggcaagatgtattaagactcccaatcatagtgttagctccacttcctgacagcatcaacccagaacaaagcctcacttccttaacctctccccaatcacctaacacaactccaaacattagactaagtcctttctaacgcccccttcctgggacgccccatgatccccatggtgcatgctctcccttgttgcaacgagtcatcagctcagcttgttcacccacacgtgtgtttctggtgatctctggttggaggcattgaaagttcctacctcattgggttgtcgtgaggaatatgtacttgaaatgatacaatcctaaggctctttcaatatgcttgtcatactttattattatccccatttcacaaggaggacactgaagctcagagagagggccagactttgcccaaggtcacacagctggtaatgacagagaaaggatgtaaattcaggcctcattccaaagctagtttcctgaatccctgcctccatgctccatgctcatagggcagaaaccaacaagacaacttgggttggtgtttggagaggagaagagcaaagggcccttggaactcaaaagagagcctcaggctggagaagcagggtatccaggatgacctgagtgaccctctcctcctcccctccctttcatgactccccaactggatcctccaagggctccctcccagactgcctggctgctgagtaatgcagagccagtcaggcccagagtaggggtcagtgtcagcagagtcggaggcctgagtcacttcctgacccttgctcaagagcatccggagctacagccagagtggccactcgtgctctcagaagatcgcacccacttgggcgatgagcatgtccttggtatccccaccttcctgggctcacctctgccccactcaggtgtttaagacgtgcagcagagaggcgccatcctgacctggtgccacatcctagcccctttccttactggatcctcaaaccagaagaaaacctgaatctctgaggtcagttactctcttttgcctgcgtctagcctaaaatctggcttccaggaccccaccccaacttcagaatcaaggtaccttgcactggtgccactgatcccaaaggtccaaaactcctgcagcactcacaggcaagcgaccccgttccttaggctctcatggggtctcagggccagagtagggggtgggggagggaaaaggctggggaaaatatcagataccccagggcaggatggactgagggagacatggttggatcagtagacatgtccttatgatgtgggcaaggccatttcctttgaggagcaattctgtcaactctaggccaccgcatagcctcgcagccaagagcagggactctagaatcaggctgtacttgctttcacccagctctgcccttaccagctgtgttaccttgggcaaattacttagcctctctgtacctcgggttcctcatctctaaaatgaggataatcatattactgactcacaggcctcttaccaggattaagtgagttatataaaacacttaatgacgggcacatggcaaacacaagtgtgtattaaatgactcttttacatctaatgggctgactcctccattcattctccacacatttgctgttatattgccatgtgccagaaatgaaaaagacagattgcctgactgaaataatggcaggtgttgttgtgtgatgatggcaccccaccctcatctcagaatgatcttccaggctgtgcctgaggctgcaggactgcccgggagggcttggggcacagagtttgggggctgcagactccctagtgtgggcccccggcttgctgtaagcccctagcaaatttctttccttgttcaatagaccttctttttgacaaagtgaagcaggtggtccccgccccttccacagccccatgcctgggcaagagaggggttggacaagtcaggctgggcatccagagcccttgcagccatctcctccccccacctgcccaccttgctcctcagaggcctttgtggtttgagcaaagaatctccatcaggctgcacaggccaccagacaggtggcaagggccccaattagtcattgtcctcatagagccttaggaagtccacagaaactgtgttcaaaactgcacatttgggccaggtgcggtggctcacttctgtaatccaaacactttgggaggctgaggtgggcggaccacctgaggtcaggagttgaagaccagcctggccaacatggtgaaaccccgtctctactaaaaatacaaaaattagctaggagtggtggtgtgcacctgtagtcccagctactcaggaggctgaggcaagagaattgcttgaacctgggaggcggaggttgcagtgagctgagatggcgccactgcactccagcctaggcaatagagtgagactccatgtcaaaaacaaacaaaaatcctgcacatttgaacctgcgtggatatttggtattatagaattagtgctattaattttaggtttaagaatgtattgtgggccaggcgcggtggctcacgcctgtaatcccaacactttcggaggccgaggcgggtggttcacgaggtcaggagttcaagaccagcctggccaagatggtgaaaccccatctctattaaaaatacaaaaattagccgggtttggtggcaggcacctacaatcctagctaatcgggaggcggaggcagagaattgcttgaacccgggaggcggaggttgcagtgagccgagatggcaactgcactccgacagagtctcaaaaaatatatatatatagtattgtggatacgtacttttaaaaatccttacgttttagagatacaaaaatatttatgaataaaatgatatgacgcctgggttttgcttcaaaacgatggtgggagaggaatgtggatgaaataaaattgattatgagttgtggttgctggggaattggggtcacgggggttcattagaacctcctatcagatgtggttcagaagcctcagacctgggagctggctagaaatgcagaatctcggctccaccccaaacctactgagtcaggatctgtattttaatcaaataaaatgcccaggggattcctgagcacactgaagtgtgagaagcgctggcttactctgttcaattctttcctgcatgtttgacattttccataatgaagaggttgtggggttttgttctgctttcctgtgtgttcacagtcacagggagctcttcctacggagaccggggctggagggaactgggaagcactgcctccccgctcctgcttggacccaccagccccgccgctggcccgcgctcggctgggaggcaccggggtcccgctgggcagccccgaccccgtgcctgggccgcacctgccgcagtggctccgtcgggccgggcggaagcgcgggagcgcagggctggacaggcccgggcgtggcggccccggcgcacctgggcgagccggcaggtgggagcgtagcagcccggggcccccgccctcgcgcgggggaggagcgggcggcgcggggcgggcgcagcgggggtcggggcgctgggagcccgttgggccgcgaacgcagccgccacgctggggccgccgagatcgggtgcccgggatgagcctcatccggaaaaagggcttctacaagcaggacgtcaacaagacagcctgggagctgcccaagacctacgtgtccccgacgcacgtcggcagcggggcctatggctccgtgtggtgagacccctgggccgctggggggcggggggcgggcgccaggctctcccctttccgcccagcccgccctgggctggcccctcgccagcgccaccttgaccgcggacctcaaggcccagcgccctccccggggccacccagcggccatctcccttttctcaccgagtggctgagtgaggtctctgggggttgagttgggactgggcctggttctccaggactgtacacttgcaagaccccagagttcatcgggcagatcctcactgttacagacgagtacaccgaggccccaagagggggaggtggctcgccaagttgcagacagagtgagactcccgccctgccgtggatcccgtcgcaatgagacgttgctgcccctggcgctgtgcccctctctcagctcctgcctggcttcctactccctgccctgcgtcccgcggctcccccatattctaggtggtgggcctagtcccctctcagcccagctgcccagtgggaggggtcagggcggtctgggagatacggcccaggaggagagcctcgcctgctgaccggcctgtgcccgacagctcggccatcgacaagcggtcaggggagaaggtggccatcaagaagctgagccgaccctttcagtccgagatcttcgccaagcgcgcctaccgggagctgctgctgctgaagcacatgcagcatgagaacgtaggtggtggctgccccggggagggggtgggggctgccctggggagtcaggggcaggcgcaggcggggcctcccggtatggagagctcgggacagtctcctccctgctcccctgacggtgcctctcgcctcactattgaaaggagggggtgccgagaccttccctgcccactttccaggaagaggtcaaagggtatttttggcagaatgcactttgtgaggtacagactgtgttatcctacagaggaaattggcacaggggaactttgtaattggttccatgtctgagagcttgtggccagctgggactagaatcctagttagcgttgtgtccacgtgaccctgataacaatagcaatatacacatattgagcacttcctatgttctaagagctctgcatacactaacttgtctagtcctcatgatatatgagtactactgcccccatgtcacagacaggaaactaaagcacagcaaggctcacagattagatggttagtcagtagcagagctggggtttcaatctcggcagcgaggctcccggtctgagcacatgaccatcagattgtcttgtctgatagaagcagctgggaaaaccaggggcccagctcagggcctggcagccaggctttgctgcaggatacctagattggagggcagacatttcaaagaatgatttcaaaatgttatgtacattttaagcccatccttctccagcaaacccctcccctatggcctccagccagggtgatcttgcccttggctctgaaccagccctgtggcaggcaaggatggatgtggctggagacccaaggtcaggggcagggagtttgctggctgaaaagctccttctctgttccctcctttttcccttccaccctccccttatgctttcctgctgcctaggtgagttgagagtgggtttgtgttgcttgccctgacaccagacttgacagcaatgagcacacatcattctccccaccttcccttctccccagcctgactctctgtcatgatttattgcaaactccctccaaatccaggggattcctctaggcctctgccctttttactgcttccaagaaggttggagacatgcctcctgctggaggtggtgtattaggaaagggtggatggccctgtgcatggccagggcccaggaggaggtgggaggagaaggtagcgtctgtctagccctcacaggtgacttcttccccaggtcattgggctcctggatgtcttcaccccagcctcctccctgcgcaacttctatgacttgtgagttgggctgcactgggttctggggcatttgcaggccttacatgccgctggggagcaaggtgggggagggtctagggtttctattccgggtgtggcggggagagcctccttccctggcagtcctgtgcctttgcctgtcaagtgtgattctctctggaaagatgcttttagccaaaggcaggcaggaagaggcaggaaggactttgtggggtgcttgcctggcagggggcagtctgcacagctgctttgctttttacccagctttaacaccatgaagacacatctgccagtcctcacagggttagcaccaactcacctttcctggggacacagatgtgagtctggaccttggagctctttctagcatgaagcaaggattaagaagccttggctgcctctggctgatgggggtgtttgacagaatggcagaaaaccagaatatttagctgcaaaatgtatagctttgcctgtgcagtgtctgaatgagactggactatttggacaagatggagaagtcagtgtggcacgtggaggccagcagctggcttggtcaagctgaatctggactgaccctacaggcagcctcaagacctggggactttgagccgggaggtgatatgttcagatgggatttgggggatgcacactggcagcagcaagaaaggagtaggaagcagctcggaggcagagggggagagcctggaggtcagtgttagtgatctaaagtagggatctaaagcagaggtgatgggatgccaagagcagacttgaggccccatttgggaggcagggccgacacaatgttccatctgttggggtgcagtagctgagtgaggtggcagaggtggaggaatgggcaggttcctgcttgaaatacacggtagaggaagaacagatcttgggggaaagataacgaactccattttggacactttacttttaaagaaactgtgaacattccaatgtttaatcacagttgcaaataaatatgaacctcaggagacgaaggtctgggctagggatgtggatttgtgctggaataatcaccgatgggttatagctgacacccgggaacagataattgtagaatgtggtaagatagtattgattcagatatcaacatgaaagagaagatccaagaggatgagcagatggaagaagctgagagggcctgataggaggcagaggagagtcagcaaagaattgagagggagtttcagacttggtgaaaggttagatcagaagaaaagggagtcatggtgtgtttgtcgggtgttcactggtgaccttgagctgagcagtctggcagtaggagggaagcagaaaccaggttaactcaggactgggaggtaaggcagtgggatccaggagtgtggaccgccctttctagaagtttggtggtgagagagggagaaggggtggtcagttgaagaagcaaagtcaagggaatgtggttctagcacagagaggcttcaggaagcatgttgccaagatgaaagaaccagtgcccgagtggaggggaaagacacaggaggggactgggcatggagaggcccccaagggaggtgtgtggtccggcaggagagggctgccaaaatccagagtctcctggagatgcctccagcatgtcctttcaaaaacaacaacaacaacaacaacaaaaaacacaacctattacataattgtttaaggtaacattcattttaaaaaagttttaaatttattatattctagagatagggctgggttgcccagactggagtgcagtggcacaaacacagttcactgcagcctccaactcctaggctcaagccatcctcccgcctcagccccccaagtaggtgggactacagatgcatgccaccatgtccagctttttgttttgttttaatttttatagatatggggtctcactatgttactcatcctgatctcgaattcccggcctcaagtgatcctcccacctcagcctcttgagtagctaagactaaaggtgcatgccaccacacctggctaatttttttttttttttctgaaaggtggggtccaggccgggcatggtggctcacgcctgtaatcccagcactttgggaagccgaggcaggcagatcacctgaggtcaggagttcgagaccagcctggccaacatggcaaaaccccgtctctactaagaatacaaaaattagctgggcgttctggcgtgcacctgtagttgtagctactcagggaagctgaggcaggaaaatcgcttgaacctgggaggtggaggttgcagtgagccaagatcacgccactgcactctagcctgggcgacagagcaagactccatctcaaagaaaaaaagaaaggaagaaagaaagatgggtccctatgttgctcaggctggtcttaaactcttcgcctcaagcgatcgtccagcctccatctcccaaagcactgggattggaggtatgcccctggcctattttataatttttattattttttgtctttgtcctggtctttgcttttactgtaacagttacattttgctggccttatcctgttgtgcaatcccctaagaggctgcaggagcctccccatctccctcttccaccctcctggaaactgttgtattgtttccttcttggaaaggtagacatattgtttgtttgtggagccatctcagctgggcatgaccctctgagggatcaaatatttggacagaagccgaaggaaatactggcagatgtttctaactcctagctgtggctttccctggggtgtggaggagggcaaggagagagtacctttgaagagcgggaacacagttccatgtggctttcctgagcgcgctccaactgcagcgcttactccgagctctgccagctgggcggcccgccacagggagactgggagccaggagcccagaggcccgtgtggtgatctggctggctgaggtggagttgagtttttgcacactggagggtgtctctatgacccctgttctgccctgaggtccctcctctgagctctgacctggggctgggtgggacccggcactgttccaagaacccctcatgccttccagctacctggtgatgcccttcatgcagacggatctgcagaagatcatggggatggagttcagtgaggagaagatccagtacctggtgtatcagatgctcaaaggccttaaggtgggtggggacttggaggctggcagaggggacgccttgctgtctagacctgaggtttggggaggctggagggagcgcactgttacaggtcggccagcctgaagtgcctggtgtggaagctgggccatggactcacccttctctctctcccacatagtacatccactctgctggggtcgtgcacagggtgagtgctttctctgccatggtcctcagaggcccctgtcccatccctgggtatggggttctctggcaatcaaggagtgggaaagttggagggaggggacactgcccaggagcacagaatgtggagttttcacacccagccacggcccaggaaggcctgctcaaaagagtcactgtgtcccaggggacttcatggggaattgctgcagacaaagtgagccctgagctgagtgtttcaggcttcaagaatcaggaacattttagagctgggtgggccctgagagaacacctagtccaaccctcattttacacatgaagaaactgaggcccagaaggggaaggggcctggctgaggtcacacccctgggtggtggtggagctaggacaagctccatctctgcctcagcctagcatgcattctctgtcctccccccaggacctgaagccaggcaacctggctgtgaatgaggactgtgaactgaaggtgagtgggctgcaggctcagcccagaggcgggataggccctcccccagggaagcccctggaagccgctcccagagcctcctcccctcagcaagttccttttctatttatcccctgtgccatagattctggattttgggctggcgcgacatgcagacgccgagatgactggctacgtggtgacccgctggtaccgagcccccgaggtgatcctcagctggatgcactacaaccagacaggtcagtggtcaatgcctgagagggcggtcctggggccatctggtcactcggtgctgactgactgctgggccccagacagtccaggtgacactctccctccctctgcagtggacatctggtctgtgggctgtatcatggcagagatgctgacagggaaaactctgttcaaggggaaagattgtatcctttgctggaaaagccaaactccatctagggattccttccttcaacagacactttatttaaataactgtcttttttttcttaatgtgagagtgatacatactccctgtagaataatttgtaaatgcagataaggctggacgcagtggttcatgcctgtaatcccagcactttgggaggctgaggtggaaggatcctttgagcccaggagtttgagaccagatgtggcaacatagggagaccccatctctaaaaaagttttttaaattagccagacatgggcctggcgcagtggctcatgtctgtaatcccagcactctgggaggctgaggcgggcagatcatgaggtcaggagatcgagaccatcctggctaacaaggggaaaccccgtatctactaaaaatacaaaaaattagccaggcgtggtggcaggcgcctgtagtcccagctactcaggaggctgaggcaggagaatggcgtgaacccaggaggtggagcttgcagtgagctgagatcgcgccactgcactccagcctgggtgacagagcaagactctgtctcaaaaaaaagaaaaagaaaaatcccagctacttgagaggctgaggtgggagggttgagcctgggaggttgaggctgcagtgagctatgattgtgccactgtactccagcctgggtgacagagggagaccctaactcaaaaaaaaaaaaaaaaaaaacaaaatgttgggtgggcatggtggctcacacctataatcccagcactttgggaggccatggcaggcggatcacctgagattaggagttcgagaccagcctggccaacgtggtcaaaccccatctctaccaaaaaatacaaaaattagccgggtgtggttcacgcctgtaatcccagctactcgggaggctgaggcaggaaaatcgcttgaacccaggaggtggaggttgcagtgagccaagactgtgccactgcactccagcctgagtgacagagtgagaccctgtctcaaaaaaaaaaaaaaaaaaaaaatgtagataagcaaaatgatgaaaaattctaccactacgtggaaaatacattttggcacggcacacattaactgagtacctgtgtgtgcagggcaggcctttggtgagaagacgaggaaacagaaaagagtcactgggatgaaggctgagaagtccacatccatttgttgggtagggacccccctcagcctggcacgttggaaagctctccagagccctgagccctgaagaataagcctcctcctgagagcaggaggtggttaggcagggctggagcctggatgatcagttgccatggtgcccgggtgaagtgatggtggggtcgcaggaagggcagtctcagacccaccaggagagcaaggctaagccttaacctgccaccaagacctggaccagctgacccagatcctgaaagtgaccggggtgcctggcacggagtttgtgcagaagctgaacgacaaagcggtgggtggtaaatgggacctaggctggcctgggctgtgtgcttgcctgacgtgggcccagtgggctgcaggcctttgtggaagaaggctcaccagcaccttcccacagcatcctcctaccctggcaggcactcttgtcttaatctcaccgtggaccctgacctgaactttcagccctgctctgaggcttttctgaaatccctgctctacacgctgaggccagagccctaaggggtttgatgcttttctgtcttccaggccaaatcctacatccagtccctgccacagacccccaggaaggatttcactcagctgttcccacgggccagcccccagggtgagtctcagagcccgctccccaggggcctctcagcgtatcccagagggcgggctctcccagcccctggtgtgaggctcttggctctgcccctgcagctgcggacctgctggagaagatgctggagctagacgtggacaagcgcctgacggccgcgcaggccctcacccatcccttctttgaacccttccgggaccctgaggaagagacggaggcccagcagccgtttgatgattccttagaacacgagaaactcacagtggatgaatggaagcgtaagagctggggcctcgggcttcctcgcctccgcctgcagcctctcttccttgcttcctccatctttgtgcctggcctctgccagccctacctgccacctccttcttggtgggcattgtctcctgggtgcttctttctccttgagctgacttcgctctccatgctgtctctgaaggggggtggactttctcgccacagcacctctttacgcaccttaaaccatgctgcctttctcagagcacatctacaaggagattgtgaacttcagccccattgcccggaaggactcacggcgccggagtggcatgaagctgtagggactcatcttgcatggcaccgccggccagacactgcccaaggaccagtatttgtcactaccaaactcagcccttcttggaatacagcctttcaagcagaggacagaagggtccttctccttatgtgggaaatgggcctagtagatgcagaattc

SEQ ID NO: 36189 - DNA, 28769 bp, Homo sapiens
cgatggccctgcccagtcccagacagaacctactatgtgcggcggcagctggggcgggaaggcgggagctgggggcgctgggggcgctgcggccgctgcggccgctgcagccgctgcagcgccagggtccacctggtcggctgcacctgtggaggaggaggtggatttcaggcttcccgtagactggaagaatcggctcaaaaccgcttgcctcgcaggggctgagctggaggcagcgaggccgcccgacgcaggcttccggcgagacatggcagggcaaggatggcagcccggcggcagggcctggcgaggagcgcgagcccgcggccgcagttcccaggcgtctgcgggcgcgagcacgccgcgaccctgcgtgcgccggggcgggggggcggggcctcgcctgcacaaatggggacgaggggggcggggcggccacaatttcgcgccaaacttgaccgcgcgttctgctgtaacgagcgggctcggaggtcctcccgctgctgtcatggttggttcgctaaactgcatcgtcgctgtgtcccagaacatgggcatcggcaagaacggggacctgccctggccaccgctcaggtatctgccgggccggggcgatgggacccaaacgggcgcaggctgcccacggtcggggtggccgactcccggcgagaggatggggccagacttgcggtctgcgctggcaggaagggtgggcccgactggattccccttttctgctgcgcgggaggcccagttgctgatttctgcccggattctgctgcccggtgaggtctttgccctgcggcgccctcgcccagggcaaagtcccagccctggagaaaacacctcacccctacccacagcgctccgtttgtcaggtgccttagagctcgagcccaagggataatgtttcgagtaacgctgtttctctaacttgtaggaatgaattcagatatttccagagaatgaccacaacctcttcagtagaaggtaatgtgggattaagtagggtcttgcttgatgaagtttaccagtgcaaatgttagttaaatggaaagttttccgtgttaatctgggaccttttctcttattatggatctgtatgatctgtatgcagttcccaaggttcatttaccattattaaaaaatttttgtcttagaaattttatgtatgtcaacgcacgagcaaattatcaggcatggggcagaattggcagctgggtggaggcttcggtggaggtgagcactccgaaaggaaaacagagtaggcctttggaacagctgctggaagagataaggcctgaacaagggcagtggagaagagagggtaaaaattttttaaggttacatgaccctggattttggagatctcgaatttaaaggtgatgcaccagggatgaacgctcagattttcagtttgaaagctggcgtgacatgtaaaggagtggagaataatgtaccattgtaatgatgaggcgcctctaggacatctaggataatttcaggcgtggggatctaggtgaattgaactgttggagggaagggaataaccaaggaaaagaatgtgggggttgagagatgccccgtttaaaacctaagagacctggatatttatggttgtaagaggaggcatggcagaggaaatggaaacagtaagaaaggagcagatgctgcatctctttaatgggacagatacaaggcatttgggtttgacacttaggtcactggtagagatgatgacaagagcccgtagctaaagaattgataaaagccagtctcaaaaatcccaatatagtctggtaatgttaatgtttctttggttcagatagctgactctcaaagttattttcctaagaaactgaaccaaaagtggacgctatatgtaaaaagtttttatagaagtgttataagagtaggatagagacataattaaacatgttttaaggtaattgagtggaacattaagcacctatttttaaaagtatgatttaatatcaatctacaaagtacacaaatataatacaattgtatcagacagttgtgacagcactgattagaggctgaacattattctaagtctttaattcccacaacaaccctagaagcaggaactattgttatctctattttatagataaagtaaaccacaaggggttaacacgttttgtcttgtgggtgacaaaatgcattcaacttgagcactttgactcagaatcttttttttttttttttttaagagggagtcttgctctgtcgcccaggctggagtgcagtggcgcgatctccgctcactgcaagctccgcctcccgggttcacaccattcttctgcctcagcctcctgagtagctgggactacagacgcctgccaccacacctggctaattttttgtatttttagtagagacggggtttcaccgtgttagccaggatggtctcgatctcctgacctcgtgatctgcccatcttggcctccccagaatctttactatgtcatacacaattgcaaatgattaaaactaaatattggatataaattggataatgccaaagggaaaaatagttagatttaggtaatgagtgataagtatgaattttggtaagacttttaagttcagttttttaaaggagatctctgccaaaccccaaaaacaaagagccctaacatcagcctaaccagatttcaaatttcatcttttggcggtatgcatttttaacagtcacccctcaactaacacatcatcctccctcaactcacattctactaaccccatcaatgcaactccctgcccaccttactcaacatatacaccgctgctagccccataccccgaaccaaccaaaccccaaagacaccccatacggtttatgtagcttacttcctcaaagcaatacactgaaaatgtttcgacaggctcataccaccccataaacaaataggtttggtcgtagcctattagctcttagtaagattacacatgcaagcatccctgccccggtgagtcaccctctaaatcaccacgatcaaaaggaacaagtatcaagcacgcagcaacgcagctcaaaacgcttagcctagccacacccccacgggagacagcagtgataaacctttagcaataaacgaaagtttaactaagctatactaaccctagggttcgtcaagttcgtgccagccaccgcggtcacacgattaacccaagtcaatagaaaccggcgtaaagagtgttttagatcaattcccctcaataaagctaaaattcacctgagttgtaaaaaactccagttgatacaaaataaactacgaaagtggctttaacgcatctgaacacacaatagctaagacccaaactgggattagataccccactatgcttagccctaaacttcaacagttaaattaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgacgaaggctgcaaagtaagcgcaagtacccacgtaaagatgttaggtcaaggtgtagcccatgagctggcaagaaatgggctacattttctacttcagaaaactacgataacccttatgaaatttaagggtcgaaggtggatttagcagtaaactaagagtagagtgcgtagttgaacagggccctgaagcgcgtacacaccgcccgtcaccctcctcaagtatacttcaaaggacatttaactaaaacccctgcgcatttatatagaggagataagtcgtaacatggtaagtgtactggaaagtgcacttggacgaaccagagtgtagcttaacataaagcacccaacttacacttaggagatttcaactcaacttgaccactctgagctaaacctagccccaaacccattccaccttactaccaaacaaccttaaccaaaccatttactcaaataaagtataggcgatagaaattgtaaaccggcgcaatagatatagtaccgcaagggaaagatgaaaaattataaccaagcataatatagcaaggactaacccctgtaccttctgcataatgaattaactagaaataactttgcaaagagaaccaaagctaagacccccgaaaccagacgagctacctaagaacagctaaaagagcatacccgtctatgtagcaaaatagtgggaagattcataggtagaggcgacaaacctaccgagtctggtgatagctggttgtccaagatagaatcttagttcaactttaaatttacccacagaaccctccaaatccccctgtaaatttaactgttagtccaaagaggaacagctctttggacactaggaaaaaaccttgtaaagagagtaaaaaatttaatacccatagtaggcctaaaagcagccaccaattaagaaagcgttcaagctcaacacctatcatccgaaaaatcccaaacatatgactgaactccttgcacccaattggaccaatctattaccttatagaagaactaacgttggtataagtaacatgaaagcattctcctccacataagcctacatcagaccaaaatattaaactgacaattaacagcctaatatctacaaccaaccaacaagccattattacccccactgttaacccaacacaggcatgcccacaaggaaaggttaaaaaaagtaaaaggaactcggcaaaccttaccccacctgtttaccaaaaacatcacctctagcattatcagtattagaggcacccctgcccggtgacatatgtttaacggccgcggtaccctaaccgtgcaaaggtagcataatcacttgttccttaaatagggacttgtatgaatggctccacgagggttcagctgtctcttactttcaaccagtgaaattgacctgcccgtgaagagacttttaagttcagttttttaaaggagatccactaaatgtcaggatgtccatcatatctatgcacatagataagtcctcaatgtcatctgtgagttcttggaaactgtgactttaagtgaaacaatgtagagcaaaaccaattttaccataggctactggatgtacacaagagttaagttcctagggcatattgctggtcacaaaaacatcaccaaacttctaaatgaaggccaaaaacacttctaatagaaaacactgaagtaaatatgagctatacatacatttaagaagaataatgtgcatgtctttgggatgtggaaggaaactggaatacctggagaaaccccatgcagacatgggaaaagcatgcagactccacacagacggtggccctggccaggaattgattatttttctcatcaacgttagaagaaaacgatgttattcaaggacatgttgtatataaatacatgaaaatatatgtatattcccaaaatatacttaggctttctttgtgattttataggtaaacagaatctggtgattatgggtaagaagacctggttctccattcctgagaagaatcgacctttaaagggtagaattaatttagttctcagcagagaactcaagtaagtaccttaacataaattcaccacaagaaaatcatgtctcatagtggagatcagtatatgataaaatgaaattgtataaaaggagctattgatgaagctgcttaatatcacaaaggtgattatagaaaattaataagcagttatttatactacatgacaataacttattctactacctgagtaattgatttcatcaccttgaaaagttacattaaacattaaatagctcactgtggtatcagatttgcaagttatcttgaaccatcattcagtaggcccaaatataaattatacagtgtaatcaataacctgtagtttcacataaagtcaaaacaactattttttgggacttgctaaaattaagtgatgatcccctttctggacccaaccctaaatgcaataaaatgtgaattttaggatgggctgaaatgggtcataatcttctactctgttattcctagttaaccacaatacccaataatattttgtacttaacattcattacccagtgtctgaaggtaaaacatttcaaagtattgaaatggttctagagatcctggagagaagcgggtatctccagttagcctctgctaagaattttcctgtcctccaacccagggttggagtcagtagttcatgaagcctggatatgccctggtgactggagagtgggaggggtaatcatattaagactgcccaggaagtcaactccaatggcttgggaggttgaggggtggccagaattggacctgtgttaatccattctcatgttcttataaagaactgcccaagactgggcaatttgtacaggaaagaggtttaattgactcacagttcctcatggctggggaggccacaggaaatttaaaatcatggtggaaggggaagcaaacgcatccttcttcacatggtggcaggaaggagaagtgccgagcaaagggggaaaggccccttataaaaccatcagatctcatgagaacttaactatcacgagaacatcatggggggtaccaccccccataattcatttatctccacctggtatcacccttgacatgtggggattattacaattcaaggtgagattttggcggagacacagccaaaccatatcaggatctaaggggaaggtctgggatctggcatgttaatcattcttagtctaataatataatcaccaaaaagaatgcagtatcctagggcactactttcttgggaacagtagtcatagtattcttttcccatgtgtattggtgaagattcaaccaaagaagcagaaccagtagtagatagatacaggtatattaaagagttttattgcgaggaattggcttacacaattatgggggctgggtacgtgagtccaaaaatctgtaaaacgggccatcagaaaggacaagctggaattctccagcaggggctgaagtggtacaggtgaaatttcttcaggaaagcctcaactctactcttaaagcctttaaactgattgattcagcccactcagattaaagtctgaccgggcacagtggctaacccctgcaatcccagcactttggaaggccaaggcaggtggatcacttgagctcaggagtttgagaccaaccgtgcaacataatgaaaccccgtctctacaaacaaattagccaggcgtggtggcatgtacctgtagtttccaggaggcagaggttgcagtgagccaagatagtaccactgcgctccagcctaggcaacagagtgagatcctgtctcaaaaaaatttaaaaaaaaaactgaattgtaatcacatctacaaaatgccttcaaagcaacacctagatacagtatctgaataaccaaggactatatcctagtcaagtttaacactatgggaaggaaagaactacacagctatataggctaaggggattcaggcttacatagattttctcccaagttcttcctagaatggcataggtaaaaaccgagaagaaagtgtatagaatatttgcattgattgcctctgggcgacggggcagatttgttgatgtgcatcttgctgcctgcttccatcttcatgctgttctttcttctggttgctaggatgctctgattatctctttccttggtagatttcaaattcacagactatatcgccattccaagaaactctttaatgatatttttgaatactactcaagtttgtttatggctagcttaagctcaaacagaaagaaatctcagtgggggagatgttcacttgagccagcatttctcctcgaatatgatgagtgtaatttttttttacgaccttcctgtgatgcatgtaattgggtttggttgcttcttctgtatttatatataacatatgttggtgtcttgtgcttttttttttaaggctgagaaaatttaaagtctttgttatcaagcatgccagggaaatagtgataccagttagtaaaaaatgttagagctcttttttgttgttgttcttccttccacttccttacttgttggtcagtcccacacatatagtgaacagctgctgagtgccaggcactgcagggtcctgaataagagggcagagatttatacatggaaatcacttgcttatgccaactctaaagatacttcatttttcacccctctcccccaatgtaagaagaaactgaatcctcaaagtgatcacaaaattttctaccaaacactatagtaatttagggtaaatatttcttaagtaaggtattgagggaaaatgcttttccaaagttgtctagacagtcaagttgtggctttaaaagaacttgaggtgagaagggtgggaatggccactgatgagtacagaatgttttcttttttggtgtgatggaactgttctaaaagtagataggagtgatgcttgctcgactctgaatctactaaacgtcactgaactatacactttaaaagggtaaatgttatggtgtgtgatttatatcaataaagtggcttttaaaagtctttggaaccagccgggcacagtggctcacatctgtaatcccagcactttgggaggccgaggtgggcagatcacgaggtcaggtgttcgagaccagcctggccaacatagcaaaaccccgtctctactgaaaatacaaaaattagccaggcgtggtggcaagcacctgtaatcccagctactcgggaagctgaggcaggagaagctcttgaaccaggaggcagaagttgcagtgagccaagactataccactgcactccagcctgggcaacagagcaagactccgtctcaaaaaaaaaaaaaaaacctcgttggaaccaaaaattaaataaacaagttttactgtaatgctatagtagcctggacaccatctttagaaaatccaaaattgcctccattatgtaagatttaaatagtctcccatccacgaaagttaacttaatttcatgttataattttttacgatctcactatcagaatctccacagtgattaaaacttcttgaaggtgcagttctctctccccctaccactcacacacttggagtagcaaacactgacctggtttctgatgtctactatggcacctaataactttgtgactttaggcaggttacaagtaagccttgttgaacctctttccttacctattaaatgagatgaataatgacaacttttttgggtgattttgaagactcactgaaattttgtatgtaaagtttctggcacacagaagggtatagatatcagttcctacccccacccccataaacttgctactttatatcttatagaacatacacattaatattaatattaatgaaatcacagtgaacagactcatgatctcattttcaccttaacatattactttgttcttgtttccctccatcttgagacaaaaatccactgccacctaaatcaactctctcatctcccctgacttgattctggattcctttttttctatcttcaccttgctctgctgtcccaaccttttagtattatcaaaggcaaaataaaaattttgcgatgaattctctaaatttaacattgtgtttgggaagaaaaaattgcagtttagggcatacatgcagacaagtgaccttccatatgtctgaagaacaaagggaaggttagaggttttatttaaaaggagaaatgttactgctctttgagaaagttcattggcactactaaggtttgggggagctagcaagctccgactggcgagcagtgagtggtgggcaaaatcagttctagagttgcagcaagttatctcagaagctatagataaaactggtttcaggttacaacaagcagttccagcagtcaggcttacagagaattacattcttggagcaatgttttataccctgagtgcttttttcccctggcccctcaactctgatttagttgggtatgacaagaatgacccactgtcacccaggccagagggcagtggtgtgatcgcggctcactgcagcctccacctccctggctcaagcaattctcctgcctcagcctcccaagtagctgggataacaggcatgtgccaccatgcccagctaatttttgtgttttttagtagaaatggggtttctccatgttggccaggctggtctcaaactcctgacctcaggtgatctgcccacctcagcctcccaaagtgctgggattacaggcgtgagccaccgtgttcggcctaccctgttttaaacctcaccatagtttacttttcttctaccctcaactttctcagagctttcttgtattaaataactttagtatgattaaaataaaattctatactacactttggttgtagtctgtcatgcctgtgcctttgcacatgtttttatctcctttgacactcagttaaggagtcatgccctgaggagtattctccctcatcaccccggccctgcgttcctgtatagcgtcctctgcatgtcttcgttgtatgtcctttcatacattatagtcactgctgagatatttctgactgctatcacaatctctttgagttcagggactgcatattttatctctatccccagaatctagcataacccctagcaaagtaggaattcaaaaatcacagaatgaatagtacataggtgatttataaaaatagaaccatcccacatagtaccactttgtaacccacctctttttccctcaatatattagaaaataaagtcctgtaaatatttttagtggctgcatagtattccattatgaggctggatcatacccaatttttaatatgagcatacctcagagacactgcaggttcagttccagaccactgcaataaataaagcatatcacaatataggtagtcacataaattttttctcagtgcatataaaagttatatttacactatactgatagtctaatagatgtgcaatagtatatctttaaaaaatgtatgtaccttagttaaaatatgactggaaaatgctaacaatcatccgagccttcagtgggtcataatcttctcactatggagtgtcttgccttgatattgatggttgctgactgataaaggtgatgattgctgaaggctggggtggctgtggcaatttcttaaaacaagaatgaagtttgccacattgatagactcttcctttgaagaaagatttttctggagcatgtgatgctattttataggattttacccacaacagaatttctttcaaaatgggaatcagtcctctcaaaccttgctgttgctttattaacttagtttgcatagtattctaaatctttcgtgatcaacaatgttcacagcatcttcactgggagtagatttcatctcaagaagccagtttctttgctcatccataagaagtaattccttatccattgacattttatcatgagattccagcaattccatcccatcttcaggccccactttttttttttttttttttgagacggagtcttgcctgtggcccaggctggagtgcagtggcccgatctcagctcactgcaagctccgcctcccgggttcacaccgttctcctgcctcagcctccctagtagctgggactacaggtgcccgccaccacgcctgctagttttctgtattttttagtagagacagggtctcactgtgttagccaggatggtctccatctcctgacctcgtgatccgtccaccttggcctcccaaagtgctgggattacaggcattagccaccacacccagcccaggttccacttctaattctagttctcttgccatttccaccacatctgcagttatttccacccccaaagtcttaaacccctcaaagccatcatgagggttggaatcaactaactccaaactcctgttaatgttgatattttgatctcctatgaatcatgaatgttgttaatgccatctagaatagtgaatcctttttagaaggttttccattgactttgcccagatccatcagaggctattgcagctacggccttacaaaatgtatttcttaaatagtaagacttgaaagtcaaaattactccttgatccatgggctgcagaatgagcaggaatattttgaaaggaatcttccttcctgagaagtaggtctcaacaggaggctttaaatatttagtgaaccatgctataaacagacgtgctgtcatccaaacttcgttgttccatttctaatacacaggcagagtatatttagcgtaattcttaaaggccctgggattttcagaatggtaaatgagcattggcttccactgaaagtcatcagcttgcattagctcctaacaagagaatcagcctgttctttgaaactttgaaactaggcattgacttctcctttatagctatgaagtcctagatggcatcttccttgaatagcaggctattttgtctccactgaaaatctgttcttagtgtagccaccttcatcaatgatcttagccagatcttctggataaacttgctgcagcttctacattagcacttgctgcttcaccttgcacttttttcttatggagacagctttttccttaaacgtcatgaaccaaacccttgctagtttcaaacttttcttctatagctttctcacctctctcagcctttacagaattaaagagggttaaagccttgttctagattgggctttggcataaggtactgtggctggtttgatctatccagaccactcagcttcctctacatcagcaataaggctgtttgcttttttgtttttgtttttgtttgagacggagtctcgctctttcgcccaggctggagagtgcagtggcgtgatctcagctcactgcaagctccacctcctgggttcacgccattttcctgcctcagccccccaagtagctgggactacaggcacctgccaccatgcctagccaggcatacacttttttgtatttttagtagagacagggtttcactgtgttagccaggatggtctcgatctcctgacctcgtgatccgcccacctcggcctcccaaagtgctgggattacaggcgtgacccaccgcgcctggccaagctgtttgctttcttaccattcacattttcactggaatagcacttccaatttccttcaagagcttttcttttgtatttacaacttggctgttagatgcaagaggcatggcttttggcctgtcttggctttgatgtgcctccttcactaagcataatcatttctagcttttgattttacatgagaaatatgcgactcttcctttcacttgtacgcttagaggccattgtagggttattaattggcctcatttcaatattgttgtgtctcagggaattgggaggccagaagagggggagagaaacaggaatagccagttagtggagctgtcagaacacataacatgtatcgattcaccatcttaaaagggcatgatttatggcaccccataacagttacttgcaacagtaacagcaagatccccaaaacgtattttaataatgaaaaagcctgaaatattgtggaaattaccaaaaggtaacagagatagaaagtgaacacatgctgttggaaaaacttcaccagtagacctgctcagtgcagggttggcacaaaccttcaatttgtaaaaaagaaaaacacctttatatctgtgaagcacagtaaaatgaggtatggcttagtagggaaccccatttttaaaggctcagtatgaagggtcttaaattgaagatgtatttttgcgttctggttaagacactattccatttcagggttttttgtttttaagtggtttcccaacactcctcagggaaattgagcaagaattccatcggcagtcctcacatcaggaacagtgaaaaaggataatgtttatatggcacccgagataatcagataaggccagaagacaagagtcagagggttctgcctaatctaagccccaccatcctgatgtttaagggcccctgaatcggaggaccctgccacaggcaccaactgaagtcttttgtccatgtaacaaattgcagctcaagtttcaaagtcaaatctgttggagttcaactcggaggtccatcatttcccggctgtgtgaccagtagtttcttaaccattcagcctcagtttcctcatctataaaaaggaatgatagtaccacgtacaattgccagttaaatgcagtgtgtacattatctcatttagtcttcatgcaaaccttcaagactcaatcacaaagaaatgtccacacatttcttaacaaagaatacatatgctactacataccaactctcctttgtcagggaatccaatctagattggtttaaaataattataggaaagaaattcagcagtgaaatatgtgactatattggatgcttgctatttgtcatttactgtatttctagcgcttgtgccatgtaagggctgatgaactcaaaccgtagctcagctttttgcatgctcttttttacccacctagaggtccagtgtttcctgtgatacttacctctaaactgctaaatagccacattttacggaagcatattcttcatacctttgctctaacttaaatctctaactttgcactatatttaatatgggttttttggggggaaggggggagtggagttggttttttttgagacagagtctcgctgtctcgcccaggctggagtgcagtggcacaatctcagctcactgcaaactctgtctcctggattcaagcgattctcctgtctgagcctcccaagtacctgagattacaggcacgtgccaccacacccagctaatttttctatttttaatagagacggggtttcactttgttggccaggctggtctggaactcctgacctcccgtgatccgcccatctcagcctcccaaagtgctgggattacaggcgtgagccaccacacctggctaatctgttcttcactttcttttctatactcactacaaaaaagggcaaggaagtcttcacagctgcacttactaacaccgtcacggctctgttttggccatcatctgtttattaactaaactctcttctctcccaactccaaatctttgtttcttctagattgagttctctccctgaagagcctaatccaacctggtccctgtaactgccctgataccttaggagatacctgggcttatttaacttctctctggccaccatgtctttttccagcctgagtcaaagtatattctttgctctaacctaattcttttaagaatgacagagtaaaataagtaaaatttatatgaggagggagagggaggaggcaatcaagagaatgaatagtccctattcttgattaatccttattataactatgagttcaagggcaattatataatcttgttaaagcaccaggctaaaaacttgacatggaattgtaatttctgttgtgtatctaattactatgaaagcctagttctacctgtttcatcatttataaagggaattgcaacccccaccacgaccaacaaagtagtttcagagattgggagggactaagctagtcaatgtaaaccaagcttgtccagcccatggcccgcaggcctcagtgtggcccaggatggctttgaatgctgcccaacacaaattagtaaatttccttaaaacatgcacagatctttttttttttaaagctcatcagctattgttaatgtttgtgtattgtatgtgtggcccaagacaattcttcttccaatgtggccaagagaagccaaaatattggaccacccctgagtaaacactgaaattaattaacttcttcccttttggattttaattacataagtaataataagctcattttttaatacttcacccattcctgtattgtttgaaacataaatcctttccccattcccaaaggtaacaacatattaacagtctgaatgtcattccaagcttttctgcagtcattcaaacatatcactctttttctaatattaggaaaatcttcacacatacagaaagaactttacagtaaactcaccacctagatctaccattaacattttactctactagtttcatcacatttcatccatcaattggtcttgttcatttttgcatttcataataaactgcagacattagtatatttccacctaaatacttcatcattcataccattaatgattcagtcttggccgggtgcggtggctcacgcctgtaatcccagaactctgggaggccaaggcgggcagatcagcaggttaggagattgagaccatcatggctaacacggtgaaaccacgtctcttctaaaaatacaaaaaattagccgggcgtggtggcaggcacctgtagtcccagctactcaggaagctaaggcaggagaatggcatgaacctgggaggcggagcttgcagtgagctgagatcgcgccactgtactccagcctgggctacagagcaagactccgtctcattcataaataaataaataaataaaatgattcagtctttctttacagtttttttctgaagtaaatattacatgagacacacgtcttaaatgtacatttgctaagttttgataaatgtatacacctgtgtaaccccagccctatcaaagatacagaatattacctatcacccccagaaagttctctcctgccctgtccaagttaatctttatcccacccctccagaaataactactattctgatgtttttccaccagagatatcacaagatatcacatggttttatgattcattgtgaaccacagatgtacaaatataggttaaattattggtcagaggccatactgatgttaagtgctttttgttgaaaggattcatatttatgatgattttagttctatagtcactgcatcttagtcagattatttgactagtatggatggattttacaaacattttgtggaattctttttttaaccttagggaacctccacaaggagctcattttctttccagaagtctagatgatgccttaaaacttactgaacaaccagaattagcaaataaagtagacatggtctggatagttggtggcagttctgtttataaggtaagtgtagttgttggtaaataaaaacaaatgttctgttctactttcagcttccttgccatttaaaggaagtggaagaaacaggtataactcattgtctgaacctttaaaaaattaagccatgcgtataggaagcagcacattatctgtactgtaaattatttgttgttagttgaaattatttgttgtttgatactatacaaactaaatagaaatgcaaaaataaatattttagtctgtatcagccttttttatttattcatttatttttgagacagggtcttgctttgtcacccaggctagtgtgcagtggcactgtctcactgtagcctcgagctccaaggcccaagcaatcctcccacctttcctcccaagtagctgggattataggcacacaccatcgtgcccggctaatttttgtatattttgtagagtcaggattttgccatgttgcccaggccggtcttgaactcctgggttcaggcaattcacctcccaatgtgctgggattacaggtgtgaaccaccacacccagcctatttatctttttaattggcaaataattgcatatatatatatatatatatatatatatattatgtacaacatgttgttttgaaatgtgtatacattgtagaatggctaaatggagctaattaacatgtattacccacttattttgtgtggtaagaacacttaaagtctactctcttagcaattttcaagaatacatttgttattaactaaaataatagatgttgtacaatagatctcttgaacttactcctcctatgtaactgaaattttgtatcctgtgaccaacatctccccaataccaatctactttcaaatcaaagaataattgatgtttccaatttaaaatccattctaaatcttttcctgagaattgtacttgcattgcactggtttctactccctgaatgtaccctagatacactgagttatgcctttgtctttcaggatgaatatatctcttactgagaaagggttggggctctcagttgatatacactaactagatgtatatgaatttattacaagtagaaaacttcttcaaccaatttttttttgttttgtttttgtttttttgagatggagtctcactctgtcaagactcagtcgcccaggctggagtgcagtgacacgatcttcggctcactgcaagctccacctgccagattgacgccattctcctgcctcagcctcctgagtagctgggactacaggcgcatgccaccacacctggctaatttttttgtatttttagtagagacggggtttcactgtgttagccaggatggtctcaatctcctgacctgctgatccacgcacctcggcctcccaaagtgttgggattacaggcgtgacccactgcgcccggccaatatacctcttttttaataccaaatgacttccagctttaaaatttttgaggataacaaatagaattctttgccttttaaaacaccaatgaaaaattaacatttatgaggaggaagaaaaatctagtttctgccatgtgggtggtcttgtggtaagatatatacagtgaaattattttagaaagaagaggtaggccgacgcctgtaatcccagcactttgggaggccaaggcgggtggattgcttgaggtcaggatctaaaaaccagctgggccaagatggtgaaactccatctctcctaaaaatacaaaaattagttgtgtgtgggcgcgggcccctgtagtcccagctacttgggaggctgaggtgggaaaatcacttgaacatggggggcagaggttgcagtaagctgagatcgtgccactgcactccagcctgggtaacagagtgagactctgtctcaaaaaaaaaaaaaaaaaaaaaaaaaactctcagtttcttgggctcctgtttctagaacctcttatgttccccatttgtaatagaagaaaagggacattttttcttgatatttttatccaagtatgaatttcttctaagaaaacaagttatttattttgttcagtgcctaccacactttgaatgattcattaccatagtcacttgaaaatgtattctttaagcaatataagtacgtaaatgcctttatataatatgataaatctacatatagataaataggaagtagaaccttcgaatggtatttttacacctgcctcacatcacaacagcttgtagatatcattcaggcttatcttcctatgggccaaatcggacctcccagcctgtttttgtaaagaaagtttcagtggaacacagacccacccattcattcagttctgtctgtggcctgcaaaggtaggaaaccctatggccctcagagcctaaaatatttaccatcactccttttacagaaggtttgccttgtataatcaactttttttttctttttttttgagacggagtttcgctctttttgcccaggctggagcgcaatggtgcagtcttggctcaccgcaacctccgcctcccgggttcaagtgattctcctgcctcagcctcccaagtagctgggattacaggcatgcgccaccacgcccagctaattttgtattttaagtagagatggagtttctccatgttggtcgggctggtctcaaactcctgacttcaggtgatccacctgcctcggcctcccaaagtgctgggattacagacgtaagccactgcagccgacttataatcaactttaatgcagaacttcaccaccacagtcaatctaataatccagacagctcctaagtgactaaggggcaggtaacatagacagcatgtgcaggacaaagggataattcacgccctaggcaggacagagcagaatggctcaagatttcttcacactacttagaacagcatgtcatttaaatcttatgaattatttctggaattttccagttaatattttcagaccacagttgaccatagataacaaactggaaagtgaaactgcagataaggggggagtctgcattccactttttaaatttttggtacagtaagaattagtagagcatctatttggttgtagcaaagataataaatgatttaatataaaatgatatattgaaaataaaaagtgaaatttgttctgtacccttatttggaattttaaaaataaacacttggatttgttgtgtgtgtgtgtgtgtgtgtgtatttttcttttctataaactatttgagatcaagaattactgctttgttagaattgcaattaagacatactttttatgaatgagaattttaatacactcattctagggcaactttttctgtagaaattatcaaccatattttaggcagtagttagaaaagtcatgtacaatataaagccaaatgttaatacaattgttagcaccaagaagcagaaaaattacctatctactagcattgtaattatcttctgagaattggaagcattacaaaattttatgtatatgtattaagtatgctcttggggttttccatagtcaaggtctcattaaattgtactatcttattcatacaagtttatgtaaatttttctatggagagcaactagataatttggggctcttaactctaaacagccaaagggaaaacaataaaagagaatgcttaaattaaaaagttcttgtaagcaaactggaggccagactatatttaaactcagtctctcataattattgataatggttagtgtcattctcaatataactaaggcatactttgcagcaccccagatgaaagaatagtatattttaataatatgctttggcagcaccaagcatatttttaatacctagtataaacttaactaaacataaatcttagagtttctttgtcttttgacacacattaagaaaactgatgttgttttatttcaaaggaagccatgaatcacccaggccatcttaaactatttgtgacaaggatcatgcaagactttgaaagtgacacgttttttccagaaattgatttggagaaatataaacttctgccagagtaagtataaggttattaattagtctgaagcactttggatttcctgcttaagactatagaaaataacatgtcttttcagactacaaattgggttcactgtgtactgctaggatgatgggtgcaccaaaatctcacagatcactactaaagaacttactcatgtaaccaaatacaacctgttccccaaaaacctatggaaataataaattaaaaaaaaaaaaaaaaagcttggcacagtgactcatgcctgtaatcccagcactttgggaggtcgaggcaggggcagatcacctgaggtcaggagttcaagaccagcctggccaacatggtgaaaccccgtctctactaaaaatacaacaaattagctgggcatggtggtgcatgcctgtaatcccagctacttgggaggctcaggcaggagaactgcttgttcctgggaggcagaggtcgtagtaagccaagatcacgccattgcactccagcctgggcgacagagcaagaccgtctcaaaaacaaacaaaaaaaaatattaagtattttaacacctgagcatgtgatgtctttccccttgtttaggtcctatttcgttcagcgatgttttatacctttcagtgttaatttcatacttatgtattctattccttttgatgctattgtaaatggtattttctttagtttcagactgtttattgctagttacagaaatgcaaatgatttttgtttattgatcttgtatcttgcaaccttgctgaactcatttgtaattctgtcaatagattccttaggattttctctatacagtataatgtcatctgcaaatataggtttacttcttcctttttaatctggattttttctttgcctaattgccgtggctagacctgccagtacagtgttgactaaaagatagcaagagcagacttacttatcttgctcctaatcttagaggggaagcttttctctctcatcaagtgcgatttaagctgtgagtgcctttatcacattgaggaagatcccttctgtttccagtttatttagtattttttatcatgagagtattatacattttgtgacatgctttttctgagtctattgagatgatcatgtggtttttgtcttttatactaatattttaatgtactattaatatggtatatcacattgattttcatgttaaactaatgtttctgggataaattctacttggtaatggtatataatcctttttatatgttactgggcttaggttgctagtattttgttgaagatttttgcatttatattcagaagggatgatttatagttttttttgttttaatgccttcccctggttttgttatcaggataaaagtgacctcatagagtgagttaggagatgttctcttcccttctgtttttttgaaagagtttgtgacagattgttagtacttcttaaatgtcttagaaaattttaatagtgaatcgattgagagaggaatacggaaattgctccaaagtggagattctaaacaaggctatgggagaaagcaaaaaactcttccattgcaacatttgatggtcatttgtactttcaggcatgtactaacataacatcataacagcctctttaatggaatggagggaattctctaacgggagacctagagtaagtcagtccttcattctatggagaaaaaggaaacctgtgaagataaagtgaatatactttgtccctggaaaacacattgctcagttctggagcggctttctctccagatctctgtgcgctggggaacttagatttgctttctactgtccaaatataaactttggtcattctccacctcccctatccctttccccacagctactcacttagtttaagtcccgttgtctctatcagttaacctcttgtggttatataggtttctgttcaaacataaagtcttttattaacaccattcttcccgatttaaaaaataaacagactaatatagtgaaatacagatgaaagagagaacttgtgagacaagaagagaataaaattagaatgtggaaggagccacaagtgatgggagccagagcagacggtcatattaataaagtaaggtggttttactttgtgtctgccgtcagctctgtacgtcattgtgcagtcgatttttcaacagcactgtgccagcctatcctctagggctctgctctcattcatcttgcctggaagaaatctttctcagactatttcacactagaccccaaccaaaccagcaggcccagatattttatattggcagttttctacttaatgagccccaaacaggcttttacttctagttaacaatcttctgtgtgaccacatagtcaaagagaagacagattaaaagaggcctgtggaggcagtagttggctccagagctgggacagatgccccttatcagtggacaccttgaagtaggttttggatgggctgatgtttcttcttctgaccctaaaacttcctgtcaggatgctggcatactcgtccacatgactcggatatccctttgctcctgagcctgtgcttcctgtagagtcttgattttaattgtattttggttttttggtttattttttgtttttgagatggagtcttgctccgttgcccaggctggagtgcagtggcacgatcttggctcattgcaacctccacctcccaggttcagcgattctcctgcctcagcctcccaagtagctgggattacaggcacgtgccgccatgcccagctaatttttgtatttttagtagagacagggtttcatcatgttggccaggcttgtctcgaactcctgacctcagatgatccgcccgcctcggcctcagcctcccagagtgctgggattggaggcatgagccaccgcacatggcccaaaaacttcttgatatgttgcttttgtcttatgaactgacaatcttgacacttgagaattttgcacaaaaaatgtatgtagatgttacttttcatgactcattccagagagactaaaattataatagaaaatggttaatagaaacattgcttcttcccctgaaatataaattattccagaaagtatctttttcttttccctataattttgttacattgtatctctgtttttgtttttttttttaccaaaaatgcataatctctaattagtcagcaaaggttaatgtctattattactcagcaatgtattgaatatcatgagacttaaaagtttactgtgttgtccctgcctacaatgagtttaaaaaatagagaaacgaggcgggcggatcacgaggtcaggagatcgagaacatcctggctaacacagtgaaaccccgtctctactaaaaatacaaaaaattagctggatgtggtggcgggtacctgtagtcccagctactcgggaggctgaggcaggagaatggcatgaacccaggaggcggagcttgcagtgagccaagattgcaccactgaactctagcctgggctacagagcgagactccgtctcaaaaaaaaaaaaaaaaaaagagaaatgaaacaaaccaataatactagtaggcaccatttatagaacacttgatgtgttaggcacaatgctacattcttttttggttttgggggatgggggcggagtcctgctctgtcactgaagctggagtgcagtggcgccatcttggctcactgcaacctctgcctcccaggttcaagcaattatcctgcctcagcctcctgagtagctgggattacaggcacccgccaccatgcccgggtaatttttgtatttttattagagacaaggtttccccatgttggccaggctggtttcgaactcctgacctcaagtgatccactcaccttggccttccaaagtgctgggattacaggcgtgagccactgcacctggccaacaatgctacattttttacaaggatgaagactttattgacagccaggctcggaggcatgtcacacagcagaaccagagtgaagcacagtctgattcaagcaggcgttcctgaccacctggagcatactggggtgcagcctgcatagtactgaagaagtaaccaaagattggggttcattggaggctggaagggtcagaagattcctcagtggagaagctgggtttggaaggggagctggagagaacacaggcttaagtgagagttagggaacaggaatagcagatcctaataaaggaattacaatctgccacacattgtggaattagggcagtatagtctccatcaatcaaacagaagcagagaacctgtcactgtccagggcacataatttcagttatgttctaaacagcttcagattgtatttttgtcttttgcttacacaagaaatgtgataccaaatgtaagtcttgcaaaaaattcttaagaaatttcctgttagctgggtgatagagtggaaagatacaagggaaactgctgactggtttttgagagaatgaggaatccaaaggaaacaaaaaaggagaaattacactttttgttttctaactttctatatagtttacagtttttttcttaccatttgcatatgtagtatactagcatgatatttatccaacttgacagtggcttaccattgtgaagaaaaaagggaaaccttttatttgctttatgcactattgatgcatttaaactgagaatcagggaagctgtgtttttaatggacacataatttaattatatattttttcttacagatacccaggtgttctctctgatgtccaggaggagaaaggcattaagtacaaatttgaagtatatgagaagaatgattaatatgaaggtgttttctagtttaagttgttccccctccctctgaaaaaagtatgtatttttacattagaaaaggttttttgttgactttagatctataattatttctaagcaactagtttttattccccactactcttgtctctatcagataccatttatgagacattcttgctataactaagtgcttctccaagaccccaactgagtccccagcacctgctacagtgagctgccattccacacccatcacatgtggcactcttgccagtccttgacattgtcgggcttttcacatgttggtaatatttattaaagatgaagatccacatacccttcaactgagcagtttcactagtggaaataccaaaagcttcctacgtgtatatccagaggtttgtagataaatgttgccaccttgtttgtaacagtgaaaaattgaaaacaacctggaagtccagtgatgggaaaatgagtatgtttctgtcttagattggggaacccaaagcagattgcaagactgaaatttcagtgaaagcagtgtatttgctaggtcataccagaaatcatcaattgaggtacggagaaactgaactgagaaggtaagaaaagcaatttaaagtcagcgagcaggttctcattgataacaagctccatactgctgagatacagggaaatggaggggggaaagctggagtattgatcccgcccccctccttggttgtcagctccctgtcctgtgtgtgggcggaacatagtccagctgctctatagcaagtctcaggtgtttgcagtaagaagctgctggcatgcacgggaacagtgaatgccaaacacttaaagcaattcgatgtttaagtatgtaagttcttttttttttagacagcgtttcgctcttgttgcccaggctagcatgcaatggtgtgacctcggcttactgcaacctccgccttcccagattcaagcgattctcctgcctcaggctcccaagtagctaggaccaggtgcgcgccaccacgcccggctaatttttgtattttgtatttttagtagagatggggtttcaccatgttggtcaggctagtctcgaactcgtgaccgcaagcgattcacccacctcagcctcccaaagtgctgggattaccggcttgagccaccacacccggcacatcttcattctttttatgtagtaaaaagtataaggccacacatggtttatttgaagtattttataatttaaaaaaatacagaagcaggaaaaccaattataagttcaagtgagggatgatggttgcttgaaccaaagggttgcatgtagtaagaaattgtgatttaagatatattttaaagttataagtagcaggatattctgatggagtttgactttggttttgggcccagggagtttcagatgcctttgagaaatgaatgaagtagagagaaaataaaagaaaaaccagccaggcacagtggctcacacctgtaatcccagcgctttgggaggctaaggcaggcagatcacttgagaccagcttgggcaacatggcaaagccccatctctacaaaaaacacaaaaattagctgggcattgtggcgcacacctgtattcccatctagtcaggaagctgagatggaagaattaattgagcccacgagttcaaggctgcagtgagtcgtgattgtgccactgcactccagccggggtgacagaagagaccttgtctcgaaaaggaatctgaaaacaatggaaccatgccttcataattctagaaagttattttcaactgataaatctatattcacccaaataatcaagggtgaaggtaaaataatacatttttagacaagcaaagactcaggggttacctccatgtgccctttttagggaagctgttggagaaaatactccagcaaaatgaaggagtacacaaaccagagaatgacatgaatccagcaaataggatccaacacaggcaatattccagctatggagctagctttaaaaaggaacagtaaaaatattaatcggttagctgggtggaatggcccatgcctgtagtcccagctactcaggaggctcagcagcaggacgacttgagcccaagagttccagaccagcctggccaccttagtgagatcccttctcttaaaaataataacttattgccagatttggggcatttggaaagaagttcattgaagataaagcaaaagtaaaaaaaaaaaaaaaaaaaacaaggggaaagggttggttaggcaatcattctagggcagaaagaagtacaggataggaagagcataatacactgtttttctcaacaaggagcagtatgtacacagtcataatgatgtgactgcttagcccctaaatatggtaactactctgggacaatatgggaggaaaagtgaagattgtgatggtgtaagagctaaatcctcatctgtcatatccagaaatcactatataatatataataatgaaatgactaagttatgtgaggaaaaaaacagaagacattgctaaaagagttaaaagtcattgctctggagaattaggagggatggggcaggggactgttaggatgcattataaactgaaaagcctttttaaaattttatgtattaatatatgcattcacttgaaaaactaaaaaaaaacaataatttggaaaaacccatgaaggtaactaacggaaggaaaaactaagagaatgaaaagtatttgcctctggaaagaacaactggcaggactgttgttttcattgtaagacttttggagccatttaattgtacttaaccattttcatctatttctttaataagaacaattccatcttaataaagagttacacttgttaata

SEQ ID NO: 36190 - DNA, 32796 bp, Homo sapiens
agtgacagagcgattactaagcctacggttcccaaacgactcaggtgaacctgatttacaggaaaggcgggctgtagctagggatggagacagtacctatcagcaagcggctccacagctcggttctctatctattctgaagacatgcggggccactcactgctcctgatagtcctctacctcccacagaccccacccactacgacacggaaaactggattacccaaatacctgcctctgagtctggggacgcaggcaagcacaaagacaagggggatggagcttctacacagggccccagcgctgtcgctgtggctgctgctgccgctacggcttagtgcaccagacgctgcatttcaggtgctcctacaaaagaggccactcctggaacgccgggagctcagacgctgccctttgctcgcgagccaagtcagccaaggttaaccttcgcggaacccggcgaggagcgcaagcctggccttccccaaacacagatccgagcttttcaccctctaccctcccctcagcctggccttttcttccgccctcacagccaccgcgacccaacgctgaggaaagaccccgacttgtggtgtccttccccttgcccaaactggccacgaaaggacatatagcgagagagaaagaggtgcggggggacggggggggtcgattgaaaatactgggtgagggaatggaagacgaggagcgtggtatggcaggttaatgggactgagcacaggaagaggaagaaagaattgagggttgaatctgtagaacactcaggctttcagcaaggacacctcattgggtcctttctcactgctatagtacgcgggtggctggacctacatgcttcctgctgtggctgtctcggaacccgtggtcctccgcttcatgtgagtgacgtcgtggcgggtcactcactcggggatcgccgattgcgatcgtaggggtcttccttctctaacttgcctccaggagagaggacctggcctgcgctgctaatgggtagtccgttcgcagcaggaccagccctggcctaaggaaacaggaaagagtttgagacttccttctaaaggagccacgtttgagaaatgggatgcaggcctaagttaagaatgctacagaaaaatatcgatccctaagcgtatttactgttatgtgaatgtgtgtgtcaaaggacttaggtgctttgggggagaggagggtgaagacaggaatttattcattgagcgaatagttattaagcgcccactctattccagacaccgttctaggcattaggtgaacagcagtgaacaaaacagacggaaatctgtgtctacttgtagctcacattttagagaggaaggcacatactaagcaaagtaattagaaacatactgtattttaggtcgtgatagtcctgaagagaaacgtaaagcagggaagaagggtataaagtgacacaggaaggtcttgctgaaaagatgacttttaagtaaagggctgacagaagtgggagatttaaccacgcgaatatcttgggaaagtgcagtcagacagagggaccagccattgcagaggtcatgaagcagaaacgtgctagaatagcaaggaggcctgtagggcagagttgagtgaagggtttagtccttcactggagattaaatcaaggcgagcaggtcatgaagatcttgaggacatctaacttttattctaaatgaaataggactttggagcgttttgagcagtagagtgatgggctctgacttccttttaagagggtcactctttaaggaaaatacacagaggaggacgtggtaggagaaaggagaccaataagaagagttttgcaataatccagaggaagcataatggtggtttgactatgggtggtaagaaatggccagttatattcttgatgcacttaatttggatatgtaagagtattatagatgacagggttaattttatttaattaggctttggaggacacttgaaaaatgaattccagtgtgagtttcagagtggcaaacacaagttaaaatcatggctttgctatgtggtacttgaagggattcagataagtcatgtaattttcctggatctgtctataaaatggaaatcacatctgtcaagattgcaaaggttagggtatattataggtatttaatgacaaggtatgtaatgggtctagtctgcaaatcttaaccaggtaaaagatggccttattgtgaggtaagagggtcatgggaggccaaggcatactcctttttaaattttatggactctgtactggggaggaaagtttttgtgttaatgacgatggtatttagaaatgcatggactggcctctcatagctgtccaccctatagtcattccttatagccatcctttaaaccctccaggaccccctatgtcctcatcagtaaagggaaagcaggctgtctggtaagggaaataggaacttccataaaaaagcaattttagatattctttttataggttttggcaaaggttgataaaagacctagggaattactgctggttgctgcgcttacatattttgagtgtcttcagatgcattgttctcagtgtatttaattttcttctttaaattctgacttttgacacatatgatttaaatcctagcaggaattttcacctagtgctaaaaggtaccacattgctttacactataataaggacggtctttcagtgtggggtattttatgtatactataatatttttacatatccagtaattagattgtgtagcaaatcagggaaagaagttggaaggcaagaataggaatgaagggaggagaagaaaggaagaaaatgattaaaattactatattccatcaattctgagatacacatttttctcttacttaacatctctgaaatagggatgtatttttaagttgttgacatctttaaatcactgtagatgaattggcagttgtgagatatttgtcattgcccacacttacacccacttagtcataacttaatcttgtcattatttcagttgagttatatatgcactattggcatatagttgttgagtgtaatttcccttttaaagatcatttagaagattatgattagcattagaatgaaaagttactgtgtatgtggggaaacaaagggtgatacaagataaaaatccagggttaaatttaaaagaagtctgtcaataaataatataggatgtgtctaagtaataagaaagcattgggtcagttgattcaatagtgttttttttcataatgtacataaaataatagagcttcttgggattgaagccattttacaattgatggcattttagatttcttgtatagtatttaaagcttccaacaaaaatgtaaatttttacctactgtaattctgaaatagggaaattagaggttttgagtagagacactttcaaatttgtgtagcgttcctatatagcataagaattctaaaattaaaagtctgcctgtaaaactttgatttcaaagtagtaacttacttatgtttgattcccaatgttgtcatcgtggggcagagattttgctttttcaaaaagattgcaggcaatttagatggtgtgggtggggaggactactgaggaaattgctcagtaaacaaaaatgatagtgaagatctcagaatctcaaaaatcatcttttgtgtgtgtattttaatgattaagatgtactataaattcatgtacagtatttgggattctgcattagaggcatcgtatgattaatggctttttaggtttgatgaagtatgataattaacattgagaaggacaaaattaatgtgaagggacagaatgatttagataatatgtttcaaaagcttttgtcctaaaaaatgcattattaccattttaatttagtaaaggaaaaagaaaaggtcttgatcctcaccaaacacaattaacatacttggtctacagttttctgtgcttctctcttcataaatgttttatattttcaattactgtgcatgtcattcttatatctattttaatctcacagtcttaatttttttacattttagtccagagacttaaactagcatttcctaaactgttttagagaatactagttcaaataaatgttaatagctgttcctgtgttaggattctgtcattaaatatattggaaaatgcttcgtaattatatcctttagagaaattatagctagagcattaaaagagctaactgcagcatcagacagacctgagtttcaatcctcgtttactatgtattacatgaggcaaattaattttaattcaagttttcttctctgtataatggagattattacagtattcgaaattgacttgtgtaaagcatttagccagccatagcgcatgttctacaaatatatgtagttgttattatcatctatgagaaactttatacatattagaaactctgaggatttaaaattttgaaggttgacttatactcaatgtaaaattgaaaaatcacaggggagtaattagcatagagattaatgaaatgagcactgggttgaatggtaaaagatttgtttgagctttaagcagtattgttgttaaactatcactgtgccctaagcgtaacattattttaaaaatgtcttcaactgtgtttcccccatttgtctgaaagcttagttagttcaaagaacatgtttatttttgttctctactataaacccagcacatgacacaaaatcagggagtgtaaagttggggtcatgaacttattttaggagcctggtaggtaatataaatggcagacaacagggagtagtaaagtgtctgtctgtcttacttaaagacattcacatcagttatttccaacactgttagccctggaaaagaaagctatccctgaactttgtcaggctagtttgtgatccctagaaaagattagtgattaagaccaaaccctgaagaacagcatcattaatgggacagattaaaaaaaaaaggagccctgaaaggaggtgacaaggaagtaggaggtgaaatcaggtacaagtaattttttaaattaagaaaagtatagccctctccctctccctctccctctccgcaccgtctccctctgatgccgagccgaggctggactgtactgccaccatcttgactcactgcaacctccctgcctgattctcctgcctcagtctgccgagttcctgggattgcaggtgcgcgccgccactcctgactggtttttgtattttttggtggagacggggtttcaccgtgttggccgggctggtctccagctcctgaccgcgagtgatctgccagcctcggcgtcctgaggtgccgggattgcagacggagtctcgctcactcagtgctcaatgttgcccatgctggagtgcagtggcgtgatcttggctcgctacaacctccacctcccagccgcctgccttggcctcccaaagtgccgagattgcagcctctgcccggccgccaccccgtctaggaagtgaggagcgtctttgcctggccgcccatcgtcggggatgtgaggagcccctctgcccggccgcccagtctgggaagtgaggagcacctcttcccggccgtcatcctgtctaggaagtgaggagcgtctctgcccagccgcccatcatctgggatgtggggagcatctctgccccgtcgccccgtctgagatgtgaagagcgcctctgcccggccgcgaccctgtctgggaactgaggagtgtctctgccccgccgccaccccgtctgggaggtgaggagcgtctctgaccggctgcccggtctgagaagtgaggagcccctccgcccggcagccgccccgtctgggaagtgaggagcgtttccgctttccgcccggcagcggccccgtccgggaggtggggggcagcccccgcccggccggcgccccgtctgggaggtggagggcgcctctgcccggccgccccatctgggaagtgaggagcccctctgcccggccgccaccccgtctgggaggtgtacccaacagctcattgagaacgggccatgatgacgatggcagttttgtcgaatagaaaagggggaaatgtggggaaaagaaagagagatcagattgttactgtgtctgtgtggaaagaagtagacataggagactccattttgttctgtactaagaaaaattcttctgccttgggatgctgttaatctataaccttacccccaaccccgtgctctctgaaacatgtgctgtgtccactaagggttaaatggcccctgctctctgaaacatgtgctgtgtccgctaagggttaaatggcccgtgctctctgaaacgtgctgtgtccactaagggttaaatggattaagggcggtgcaagatgtgctttgttaaacagatgcttgaaggcagcatgctccttaagagttatcaccactccctaatctcaagtacccagggacaaacactgcagaaggcggcagggccctctgcctaggaaaaccagagacctttgttcatatgtttatctgctgaccttccctccactattgtcctatgaccctcccaaatccccctctccaagaaacacccaagaatgatcaataaatactaaaaaaaattaaaaaaaaaaagtatagaaaatttagataactttaccaaggtcacacagtctaagtatatataagcaagcccaagggtatatatacccatgttcctctgccagtgctagtgatcattatctgcatgttactagaaaacattaacataaacttatgcatccaacctatatttttaaaaaatttaaatgataattaatcaacaagtattagaaaacctgtttccagagcttctgttctaaagacagcaaatggcttttagcacttgagcacagttctgttaacacacagacgtaactagaagtgaaatatttttagatttcacaagatgagactttttaacattggcatcatgaataatatttccagatacccagttatctaggactggagaagaagtagagtctgggcgccagtgcaatggctcacacctgtaatcccagcaccttgggaagccgaggtgggcagatcagttgagggaggtcaggatttcgagaccagcctggccaacatggtgaaaccccatctctactaaaaattcaaaaattagtcaggtggcaggcacctgtaatcccggctatttgggaggctaaggcaggagaatcgcttgaacccaggagacggaggttgcagtgagccaagatcgtgccactgcaccccagcctgggtgaaaaaggaagactctgtctcaaaaaaaaaaaaaaaaagttttatcacttctttttatcacattgtttccttttagtagttgcatatgtgtatttagtgtttagttcatttgtatttctgtattttgaaacatgacattctctttcctaaacttatgcttgttcttcaatatgtattataaaagtcatattttatgtaactaactattccacttatattttgcaaatagttaacagatttatcaactcagtaaaattgtatttttttctcttaggctaggatttattatctctattttcaaaattactgttattcttagaagattttttatatgtttctgtatgagtcagaacatgagtttctttttttgatttttcagcaacttggtgggtatttatttttgaaggactgtctagaactgttggcttatttatgagcattattctttatggactattattttaacagtttagaaaaatacagaccaaaagagcacaaaaattcaaatgaagataccacctttaaactctgctatttttaccaaaatgaacacagaataccatgttgttacttaaacgtttgcaaagccagaattgtagagaaaatatcttaatagaaatggatatatgaagaaagttaaagtaaaaaaaaaaaaaaaactatgctcttctgaattttagtatcctgagtacagcatttctttagtttttgatgtctttttattttagtctaacataagtaatgatgaaatatactcaataggtaaaatgtagctatcacaaacaataatgagtatctgattaggcagaattggcaagttttacatctctagcaaagacatatttgatgaataatactaaaatgaatgaattggtgcattttagaaaaatacattttgaaaagatatggctcaaatcatcttattcaaatttcaaaattaagagaaaaactagaaaactagtatcagctaatatgaaacaagtagatttaagtatagactgatgctcaaaaatgagccaacagatctagacagtcacctcaaaaataaataccagccagtgtattgtggcttttcagaatattttttatataggattggtattatataataatttgaaattttcaaacaatctgttacgtgtctattatctagtttttattcaaaatttcaccattaatattgagtactgcttcatttatttaaagttagaattatttcagcaatacttgtatcattgttataccttgaattataaattcttgttaaatcaggtagaaaagaacagttcatagtattactaatgattaacctctccattgtcagtgtgattatttttcttagtatgtggcagtttaaattttaacatggtgaattaatctcagaatgtttgcttacatacatttttctgtaccttgatagtatttttttaaatttctctgaatttattataaaactaaaattctaatttttaaaataaagacaacggtatatactgacattatatctgaacaagcatatgattaatattttcttaattgttgattttttcttttaatatttatctttcctaattgacgttttcttcttgaaaattgtacctaagtgaatacacagtagaaggatccagtatacagaaatataaaaggaatgaaatcagcaactctttactttggaacacagatgtaatactcattagcatagttacggttattgttattcttatctcttagtgtacctgaagctttctttgaaagctttcaaccttaaatgtggctaaatagcctgttttctgcatttaagaacaaactatatttcctcttctaagtagattcaggaattagtctacttaacatttctgctatttgtttggcttgttgctctccataggaaaactatttttctaagatatttatctattacagtagaaaatgtttttcctttcagactgctttttcatagtggcctatagtataaatttattcctttcacagtgtaatttatcacttttatttttcctataggattttctgccgtctcttggcaaaaatggcaaataatgatgctgttctgaagagactggagcagaagggtgcagaggcagatcaaatcattgaatatcttaagcagcaagtttctctacttaaggagaaagcaagtaagaaaatttaaaattttttgaggagatacttaaaatgaattcatacattgatggagaaaaaataatgtttaccgctttaagttatttaagttttacttagaagtttctgttatatgtagaaaaatatcaaacctgaatttctaccttcaggacttcagttggctttggttttgtttgtttaaatgtattttattttcagtagtcaatgtcagaatagaaatttcaaaatcttttgctgtcactagtagaaataaatgctttcctacgttttgtaagctaatggcttacaaaaacctgtatttactctccagaaactttatcaatttttttctaattttaacataccactttgtttctttttttatagtgtttctcgagattttaaaattatttttcttaaaaattcttactctctttttattaaaaagatgaagagattggacatagtcattgctcatatgatataatatatgttgtaaaccaaattttgtcttctgtaggtggccatttcctagcctcttgataagcattttagttttgccagtttgaaaatctttctacttattcttcacctttatattattctttggtagcctatactggtagtttttagtcatattgctcccaatttaggatgaatgttttataaaatctctgttaatatcctgtaaggaaaatatttcctagaaaaataacctacctatatataattttaaaacatatcttaatcctatatataaaatagagaagagaaataaaaagaaaggtataagtagtagtaacaataatatgtatttcagtaagtaatacttcagcagaattataccactaaaggcagtgtaagagggtcacatgccccatgattcacatacatggaatcatcaagaatgcaataggtacaatgccaactagtataggtatatagtcagactgcctttgtgtaggtgtctcagataccagaagcagatagtgatatagatgatttattcaaactgatgagtgattgattagatagtattttgaataaaacaaggtacagtctactcttgatttatgtggtacttgattcatagaaaatttagggtataataagcatgcttaaaaacactttgtgtttatatataaagaatagttaaaaatctagactcaaataattattaataggatttttacttatacaaatttatgataggccactataaagttctgcaggatgtgaaacagttcttcattttgcaggagtatccagcatactgcaggacatctgacattcttggcttctgcccaataaatgccagtactaacaatcaaaaataatcctacagattttcaaaatcctacctacaaagcagtaccaaccccactgagaaccattatttttctcttatacttttgttaccccattgcacacttttaacacatacattatattttgagcaaatccttgagttatttcactcattgaatgtttgattagcttaactcagactttagcaatattcagcttcttttaaaaggtaatgactaaaaagaaagacatgagaatagtttttgcttgtgtggtaacatctcagaatttttttaaaaatatatatataatttaatataatgcttctcttttttttcagcatctgttattgacattttatcttttatttttaaaaatttttttgagacagggtcttgctctgttacccaggctggaatacagtggcactatctcaactcacactgcaggctcaatctccaagcctcgatcagtcctcccacctcagcctcctgagtagctgggaccacatgaatgtaccacaacccccagctactttttgtatttattgtagagatgggttttgccatgttgcccaggctggtctcaaactcctgggctcaagtgatcctcttgcctcagcctttgaaagtgctgggattatgggattacaggcatgagccactacacctggccacatattgacacttttgtgccagcttcttaagttatttgccattgccttttattatagccgcaatgctgaaaaggtggtaatttgatcttagttagcatcttaataggagctaggaaaatgattcataaacaaagtctttctgttttactcttatttcatatattttctccctctctctctctctctcttaaatagcatgttgttttaataaatattaaactggcataaaggcactggccaaacatttggttacactagagctagtattatcctagctgtagttatactggctgtcttcttttcaaatagtattcatacaaaacctcttttaaaaacatattttaactggatgttcttgatcctagttttgcaggcaactttgagggaagagaagaaacttcgagttgaaaatgctaaactgaagaaagaaattgaagaactgaaacaagagctaattcaggcagaaattcaaaatggaggtaattaaatatagaaaatttgagtaatccagaagttaagaagttggccagtcacaccaacagtgaggaaagaagtaagaatctgtatctaggcaacttggacaacttcataacttctaaatgactcagatttatcaataaaatgggggcatggatagaacctacttcttagagtatgagaattacatgagttaatttgtataaagcattttgaaaagtgtttggggcatagtaagttcataataaatgttagctgttcttatttgcaggtttctcggtttagtaattgattaaatgggaatcatgcctttattctttgatacctcaattatggctaaaatatgcctaattttttggcagccattttatagtctcagacagtggatatttgatagccatatacagtgaatttttcatttaaaaagagttcccatttgtggttcacaatttcatattttttgtcatatttattggtttaatatgaatgacattatttcattttctgtctcagtgaagcaaataccatttccatctggtactccactgcacgctaattctatggtttctgaaaatgtgatacagtctacagcagtaacaaccgtatcttctggtaccaaagaacagataaaaggaggaacaggagacgaaaagaaagcgaaagagaaaattgaaaagaaaggtatttttgacctttaagcatatttagctcttgactggattatcagaaaatgtcaagttttgataatgataataataatagtatcaaaagtaaagttcaactttcatgagctaggataaaattaggaacaatatgatattggaacataaaagctgggtcctaaatggtgtgtgaatattgaccagattaacggggtaaaaatgtggcattttaggcagagggactggcataagttaaaacagactgtaaaggttaagtgtagaaacccatatgtagtttggtatggctgaattttggtatctatttgtggtatagtttgagagaagtcacagataggaaactagcttaggaccagttgtgaagataggaaaagaacattccaccagtcaaaacagactgtctgaactaagatttcaagaatccatgagaactaaagtagatagaaatgtcaccatccacttaggcaacaacccttgaaatttagtcatcaaccttaacctgtccctattccctgttcttcatatctaattaaccaacaaattctattattcctgtccccaaaacatacatagaccccagctctgctctttcttttcattaggtcctacctcagttcaggttttcaacgatctttcatctgaattaatattaaagcctcatcttttctagtttatttttagccttgctgctaaagctatttattctaattgtaaatctgacttcctttccccagatatgtctaaaaagttgcctttataaataattatgaatatttctcattatacttaaacttatttactttttttttttttttttggaaaatataacatgcagagggatttatgaactaacccaagccaatttagcctctaaagcacttgccagttcctttggcaaacatcagtaacctctgttagttaaaagtaggtaggggctgtacagcctctgctatacaacttcaccactaggtggtatgattacaatgaaagcaagtcagactaactcttctagtttataaagtacgttaagaagtagacacaaaacaactatataacctgttcttgcaaatttggtggaatccatattctattctctaaggagggtgcactgttctgactcaggattaatcagtcttctagttagagaaggcaacaaggctctcctttgatggaagagggagcacacaggaccacaagaccaaatggagttataagattagaacacttctatccaatggaactttctatgataatggaagtactctatatctgcattatccaacatggtagtcaatggccacatgtggttattaaagatttgaaatgtgggtagtatgactaaactgaatttctaatttaaataattttaaatttaaatttaaataacctatgtggctggcagctaccatattagacagtgctggttatagagggctgttccataggtgtttagctgctagctaggactgccagattctgctcatgcaagggctgtggtgcccatatgatctttctagactgctacatatcttttttttttttttttttttttttttttttggagacggagtcttgctctgtcacccaggctggaatacagtggcataatctcggctcactgcaacctccacctcccgggttcaagcaattctatcttagcctcccaagtagctgggactacaggtgcatgccgccatgcctggctaatttttgtatttttagtagagacaggggttcaccatattggtcaggctggtctcgaactcctgatctcaggtgatccacctgcctcagcctcccaaagtgcggggattataggcatgagccaccatgcccagctagactgccacatatcttaattgagcgtcactcatttgtcagtgaaggatttctgaaattccttatgataattaacaaagatcttggtatagattttaatatttgcaatcatttctagaatggggattcctgataaaagtatttcaaatgcctaggaagtacattagagttttaaaatatatacaaatgtagatatattgttatactacagtatttttaaagtaaatgcatatactttatcacacaaaaatattaagatttttggcatattctggtaattttgttgtacatatttttctgtataatttggatttttaccttttgaaaaatttttgctaatttgtttatggaaaatggaatttttttaaagcttgctaatgagattaaaaattggccattattttaagttaattccatcccctctttgataaacttattgttgtatgaattatgaatacctttacacagaattctcctttcctgcttcatgcagaattattcttcactgagtttctatatttctttgtgtatgtcatgtttatcacatattcattatacatatacatgtctgtcttctttaaaagagattttgagtgccttgacaacatggactgcccatcttactgtttccagtgtcatagcactccgtatgttgaaagattaaataaatgtatagttgagaaagaatgcttccaagctacaatagcttatctctgttctttggattcaaaggtaaataaggttttattttgattttacttttttggggccagaaaagctaattgtaaacttaaagaatatgaatcctctttgcaggttacaattaactcagtagctaaaataatcatgtgttaataagagttacattttcagcaaataaataaaaatataattattaaaacataatcagaataaaatattcttatctgcttaaatagttactgtggataaccctaaaatcctaatatatcttcagagaaatctaagaaatggagaaattaattatgtacttactagtgtatataagtgaggaggaaaatatttaatgagtgaaattgcattctgctctagttcattctgtcatttgggtactggttgtggtgttctttctaaataaagtatttatcaccttccaaagagccatagtaaaagtttttagaggagtctctattatcctgtttcggggaaaggcaaactttttctgcctaaagcctttgtcacaactactcaactctgccctggtgcaaaagtatccatagatgatatgtaaatgaatgaatatggttgtcttccagtaaaactttatttatgaaaacaggcaacaggctggatttgtcccatgagccatagtttgccaacctcacacaatgtcttcaaatagaaatacaacagagaaatagctaaaataggattcaagattttatgacttggataatttttttctttgttattatttaagtgaaggtaggagataaacattctttttattttttccttttaagctcattggtatggataccatggagttttcatagtgtttttttgcttggttttatttctgatgtttacccattcataaatactttttaggagagaagaaggagaaaaaacagcaatcaatagctggaagtgccgactctaagccaatagatgtttcccgtctggatcttcgaattggttgcatcataactgctagaaaacaccctgatgcagattctttgtatgtggaagaagtagatgtcggagaaatagccccaaggacagttgtcagtggcctggtgaatcatgttcctcttgaacaggtaatctgtacaactgaaattcctgttgtgtacatacaacattttcattccctccttcttggtatctttccattataattttgtataccatacaacatgtgcccttgttaattagttcagtcgattagtttgaatgtggttaattacacaaaaaaagcataaaaccaccaaaaacctgtaaaacatctgtaaattaagatataatgcataaggataggaagaagaaaagatgtattattttatctatttttaaagtatttttacttttgtattttgcattaaaaaactattggtgtgtatatatatataaaatatatttgaaatctaagtaacaacaaaatacaaaacatcccatttttaacaaataaaggaatactattaaaaattacaagttcaatctccgtgatcccctctcctcatttttcctcaagtatgaaaatattttttgggttttagagaaataaaacttgctctcatgcttttagattggtgctttctgggtttattttacatgattttgaaaagcaaggaattataaaattccatgatgaagcagtgataaaaataatgattatgatgactattgtgttagaagtacttaatagataaatttttttcacatgctattttatttcttactatatacaactgtcagttaagtagtatcaccctcatttacagatgacgtttaggaaagttaaccaagttatgctatatatatacagagatacatatatatatatatatacatatatatataagttggttcacttttttatgtatctatagatatatactcattatacatctgtctatatagatatatatatatatactcatttatctcactctgaggctgattatctttaatccctatactgttcagctttactgtttaccattcaaggtggagttagtcatgaaacttctaactacaggtgctatgtagtttttagagccatgcatatgaccaaggtcataaattacaaactgctgggccaaggaaagaatgcaatcccaaaaagtttcagtttatctttcatagtatttcataaaatacttacacatggaattttacatgaaaatcctgatgtcttgtttcttaaaaattcagaactaagccccacccctacccttcccaaccccctgctattttcttaaggcagaaattggttaacacttagtaatggatagcccctttaggtggaagttagactctttaacacagtttcaaccattccatagttgaggtggaaggtcacttgtgattatttggtatttatctttacttttctgctagtgttatatttacggaaggttaagaagagactcgagtatctttttttaccatgtctcaaaaaaacaagggtgttacttgttttttctgtctaggattccttactcatttcctttacttatttggtagacagttgtatcataattgcatcaaattgcacttttgatccctagcctgggcttttgttttggctctctaatttcagcgttgctggaacacagtacgggtaatggatcaatattgacctatcatcaagagtacaaggaagtgatttcttctacttcctacttaacaagctcatttcttttaggtctccaatgattaattatccgagccagtgaagtttgggttttaagtgtttcataaaagaaattgataggaggttagagtatctccacttttcctttcttctggtgagtttagcaccagggactgtgctttgtgtagcttcagaaaacaaaccatggttacagtttatataatattattccctatttaaaatttaattctttctatagtgaaattagagctgggtatttggaatatgtgaaaagtattgatggtatattttatgaaggataaccttgcatgataaccgttttaaaagcaaattgatactccatgatgatacccttcagagcagtggtttctaactgttgctttttttcttataagctttcaaacctccttctcaacaaaagtttactttcttcctttttctttacttttgaataccatatttactttcttgaagaaatatggtttttaaaaaatctagtaacagtggaaagaatcgaagacagtagcagttttaaatgtcctctttctagatgtcttctatggtggtttgaatcatctacctatttcctctgtcccatggtgcttcagagatattgcaaagaatatggacttcaacattacgatagttctgcctttgtttattgctactctgctgcttgttggttttgtgaacttgaacaaatccctgtgttcattcaattatatttatagctgcaagtatttattaagcaccaagcacctaagtaaaggatacagcaacaaattaaaatacagagatagataaatttcttttttctttttttttttttttggagactcacccaggctggagtgcagtggggcagtctcggctcactgcaaccactgcctgcctcccggattcaagcaattctcctgcctcagcctgccgagtagccaggattacaggcaccaccaccaagcccagctaattttttgtatttttattagagacagggtttcactatgtgggccaggctggtctcaaactcctgacctcaggtgatccgcctgccttggcctcccaaaatgctgatattacaggtgtgagccaccacacacaagcaacaaacatatttttaaaaatagccctgcctttatgaagctcacatttgtataagggagtcagaaatattaccaaggtgtaagtaaatatttagtatgttaaatagtgataagtgccaagagaaaaatagggaaagaatctagtaagtattgaggccaggatgatattgacattttatataaagtgcccagggaagacctcaaaaagaaagtgacatttgagtaaaggtctaagaaaatgaaagcaagtcatgtgtttatctggctgaagagcatttcaggcagtcctgggagaaatggatggctgggatgttcaaggaacagcaggaggccgatatgaatagagcagggttaataactgagaaagtcatgggagatgaaatcagagataagggtgccaaatgtcttatagatcattgtaaagtttggcattttttctgagtaagatgaaagccattgtaggattttagagcaaaagaataacattggtcagcctgacattttaataggatcattctggctgctctgttgatgggaggaagatggaattaaggagatcagtgaagtttctcttatctaggaaaaaagaagtagacttggcatatgcatgtgctttttttactttttaatatttatgttatataggaccagaactgattcataactccttatgaagttaggagccctggagaaaagaaccaactgatcttcagccagcttaaattggaaaaactcctcatttgggcttcatcttttctgttcttataagttgtagactattttttctcttccagcagccatcattcacaaccataagcaaagctatttttataaacatctgtatctaacccatcaagatacaacctaaaataaaagttaaaaaaaaaaagatagtactagtaaacattctataaagtagggacacttagaattcaaaattatatactctgttttgtaggtggtacatttttctagggaaaagtttcatagctatcgtcagatccttaaaggattgcatcttactaatcctgttgctactcttaaacacttttgctgtaacttttaagttctcatatacgtgacattgtcaagttatttgaagcattcgaagagaaatattatttatgaagaccccctaattcatttcgaatttgactcttaggctcatttttttaaatcatagtatttcagagtaaatttgcatataacatttatttataaaaccatcttttatctagaatgcatctttttttctcctttgagcaatagttctcttgtatgattcattttaaacttgttgaaagaatttaaataactatatttcttacttttgctagttggagaaaaaaattaagacacttcaaatatgaagattaaagaaatttccgtttgcttccataaaaaatttgtagaactagccctacatgttagttgcatgatgcatgatgctgaaattgttaaatgatctttttttttttttttttttttttttttttgagacagggtctcactcttgcccaagctggagttcagtggcataatcaaggctcattgcagcctccaggctcaagcgatccttccacctcagcctcccaagtagctgggactatagccacatgccaccatgcccagcgaatttttttattttttgtagagactgggttttgccattttgcccatgctggtctcgaaaaaaaaaaaacactgggctcaagcagtctgcctgcctcagcttcccaaggagctgggattataggtgtgagccaccacacccagccaattttttttaaattaaaaaataaatctagcatagctctggaaatgatcaaatgtgtagggaagaaaatgcacatgtgtaaatgtgtccatttattttaattctaatgctaggctaaatgctttattatgcatgttatgatttaatccttatgacaactcttcaatattatttctctcattttttgaggaaacaggagtgtcaactttatgcattctcattgctagtacatggcagctgaaattcaaaaccaagtctgtttcactcatttattcattgagtaaatttttaactgaaattcctctgctctttcaaccataatgcgttatcaatttggaggaatttttttttcatgtttatgcaaagcttcgtaacaacaataagagactttgggcacacaaagacaaaggtacatccacaaaagtagaacatttgatacttagcatattaggtgtagcttaatgtagtctggatatgattaggcttaatctgtgtacatctttacttaccagtttatatttcacacagatgcaaaatcggatggtgattttactttgtaacctgaaacctgcaaagatgaggggagtattatctcaagcaatggtcatgtgtgctagttcaccagagaaaattgaaatcttggctcctccaaatgggtctgttcctggagacagaattacttttgatgctttcccaggtaggtatttattagtaattacttaatagtttcggaatcagttctcaaagtgatgtttgtaatgcttaaaggttaaaatcagtcctgtgtaagaatcatgagtcttacattaatgaccattattaactattattgagtttttcaagattggctcaagatgacacattgagtaaaccttgtaatcattctcctccccatgaatgtacatgttgtataaaacacctgatatggtttgactatgtccccaccaaaatctcatcttgaattgtagttcccataatccctacatgtcatgggagggacccggtgggaggtaactgaatcctgggggcaggttttacctgtgctgttctcatgatagtgaataagtctcatgagatctcatggttttataaaagggcagttcccctacgcatgctctcttgtctgctactatataagacatgcctttgctcctcctttgtcttctgccatgatcgtgaggcctctgcagccatgtggaactgttggtcaattaaacctctttcttttataaattacccagcctcgagtatatctttattagcagcgtgagaatagactaatacagtaaattgatactgggtagtagggacactgctgtaaagatatccgaaagtgtggaagcgactttggaactgggtaacaggcagagattggaacagtttggagggttcagaaaaagataggaaaatgtggaacagtttgggacttcctggatactttcagggctcaggagataggaaaatgtgggaaagtttggaactttctagagacttgttgaatggctttgaccaaaatgctgatagtgatacggacaatacagtccaggctgaggtggtctcagatagagatgaggagcttgttgggaactgaagcaaaagtgacttttgctatactttagcaaagagactggtggcattttgccctttccctagagatctatggaactttgaacttgagaaagatgagttagggtatctggcagaagaaatttctaagcagcaaagcatttaagaggtgacttgggtgctcttaagcattcagttgtattcattcacaaagacatggtttggaattggaacatgtttaaaagggaagcagagcataaaagtttgaaaaatgttcagactgaagatgcagtagaaaagaaaaacccatttctgccagctgcagaaatttgcataagcaatgaagagccaaatgttaattgccaagacaatggggaaaatgtctccagggcatttcaaagaccttcacagcagcccctcctatcacagaacctgaggcctaggaagaaaaaatggtttcctgggctgggcccagggcccccgtgctgtgtgcagcttagggacttggtgccctgcttcccagctgctgcagccatggctaaaaagggctaaggtacagctcaggcccttgcttcagagagtgcaagccctaagccttgacagcttccacatggtgttgagcctgcagaggcacagaactgaggttcgggaacctccgcctagatttcagaagatgtatggaagcccctggatgtcctggcagaaatttgctctaggggcagggccgtcatgaacctctactaagacagtgcagaaaggaactgtgggatgggacccccccacacacagaatccccactggggcactgcctagtggagctgtgagaagagggccactgtcctccagaccctagaatcataaatccactgacagcttccgcagtgtgcctggaaaagctgcagacattcaactccagcctgtgaaagcagctgggatggtggctgtgccctacaaagccacaggggtagagctgcccaaggctgtgggagcccacctgttgcatcagcatgacctgcgtgtgagacatggcgtcaaaggagatcattttggaactttgaggtttgatgactaccctgttggattccagacttgcatggggcctatgggccctttgttttggtccaatttctcccatttggaatggtgtatttacccaatgcctgtacccccaatgtattctggaagtaactaacttgcttttgattttatggctcataggcagaagggacttgtcttgtctcagatgagatgctggactgtgggcttttgagttaatactgaaatgagttaagactttggggaactgttgggaaggcatgattggttttgaaatgtgaggacatgagatttgggaggggccaggggcagaatgatatggtttggctgtgtccccacccaaatctcatcttgaattatagctcccacaattttcacctgtcgtgggagggacctggtaggaggtaattgaatcctgggggagggtttttcctgtgctgttctcatgatagtgaaaaagtctcatgagagctgatggttttataaaagggcaattcccctacacgtgctctcttgcctgctgccatgtaacacatgctcctctttaaccttctgccatgtggcggcctccactgccatgtggaactgtgagtcaattaaacctctttcctttagaaattacccaaccttggatgtatctttattagcagcatgagaacagactaacagaacaccacagagagattttgtcctaactaaagcaataatattaataccagcgtagcagaaaagtatgacgtggatagagaacagattaatgtgctgcaaaatctcttatgctgtagattgtctcatgctgcagcacagaaagacagagatgaaaagtttagatttataattataaattccatctaataatatacttgcatatgtttttactcaaattcaggatatagagaaaatatctaagttaaaatgtaatgattttaataatctaaaaggaagtttcattttgtattgcctgttttctctaataaaaatactcctgagacagatgaagcttcataatgtgtgagaaagtttcttcaaataggtctttgaagcagaagagaaaagattcttggcagatatagaataagtatttatctcatataagaggaaggacctgataaaaagaaaaacagttagaaattaagactgcatttaaaggatatttatttgactagagtaattgggaaaggcagatataaatgaagataaatagaattaggtaaaagaacaatttggagacatatttgtagaaatgactgaggatttgtgtgtgtgtgtgagcgaattattttgtaatggtgcaataaaattaaactaaggttttttgggtttttttttttccaacttgtattttaggctcaagggatacagatttcttatattggcaaattgtatgtccttgaagtttagtataggaatgatcccatcacccaggtagtgagcatagtacctaataggtaattttagaaccctcaccccactcccgacctccctcctagtagtactcagtgcattttgtttccatcttcatgtctgtgtatacgcaatgtttaggtttagctctcacttataagtgaagacatactgtatttgatttcctgttcctgtgttgggttacttaggacaatggcttccagctgcatccattttgctgcaaaggatattaatttctttttttaaggctgcatggtattccatagtacatgtgtaccacatttttttaatccaatccactgttgatggacactagagttgattgcatgtctttgctattgtgaatagtgctgcagtgaacttacaagtgtatttgtctttttggtagaatattctatttttctttgagtatatacccagtaatgggattgctaggtcaaatggtagttctgttttaagttctttgagaaactccaaactgcttttcacagtggctgaactaatttgcattcccttttctcttccacctcaccaacatcttatttttgttttttgtcttagtaatagccactgtgactggtatgagatggtatctcattgtggttttgatttgcacttctgtgatgttgagtgtttttgatatttgttggcgacatatatgtcttctgttgagaagtgtcttttcatgttctttgtccatgttttaatggagttatttgttttttgcttgttgaattaagttccttatggattctagatattagagttttgttggatgcatagtttgcgaatattttttcccattctttaggctgtctgtttactctgctgatagtttattttgcagtgcagaagctcttcagtttaatcagctcccacttgtcaacttttatttttgttgcaattgcttttggagacttcgtcataaattctttgccaagggtgatattgagaaggatatttcctagaatttttgccaagggtgatattgagaaagatatttcttagattttcttctaggatttttaagttttaggtcttatatttaattctttaatccatcttgagttaacttttgtatatggtgaaatgtaagggtcctatttcattcttctgcatatggctagccagttattccagcaccatttattgaatagagagtttttttcccattgcttgttttgttgacttgctgaaaatcagatggttgtaggcatgcagctttatttctatgtcctttatcttgttgcatttgtctgtgtgtctatttttgtaccagtacccttctgttttggttactgtagccttgtagtatagtttgaagttgggtagtgtgatgcctccagttatgttctttttgcttagaattattttggctatttgcactctttcctcattccacgcaaattttagaaaatttttttctaattctgttataaatgatgttgtatgtagtttgatagtaatagtattaactctgtagattactttgggcagtaaggcaattttaacaatactgatttttccaatccatgagtgtacaatgtttttccatgtgtttgtatcatctgtgatttctttcagcagtattttatagttctccttgtagagatctttcacctccttcattaggttcattcctagatatttcattttttgtgtgcctattgtaattgggattgtgttcttgatttgactctcagcttgaactttagtgtatagaaatgctgctgatttttgtgcattgattttgtatccagaaactttactaaagtcatttatcagctctgggagccttttggcagagtctgtagggttttttaggtacagaatcataaatcagtgaagacagataatttgacttcttcttttcctatttggatgccttttctttctcttgcctgattgctctgtgtaggactcccagttctatgttgaataggggtgatgaaagtgggcatccctgttttgttccagttttcaagggaaatggttccagcttttgcccattaggtattatgttggctatgggtttgccatagatagctcttattattttgaggtgtgttcctttgatgcctagtctattgagggttttatcataaagggaggtagattttatttaaagctttttctgtatctgttgagatgattatataatttttggtcttaattctatttatgtggtgaaccacatttattgatttgcatatgttgaaccagccttgcatcccagaaataaagcctacttgattgtggtatattgctttttgatgtgctgctgtatttgatttgccagtattttgttgatgacttttgtgttagtgttcatcagagatattggcctaaagttttcttttttccttgtggtctctgacagtttttggtgtcaggctgatgctggcttcacaaggaaggagctcctcttgctcagttttttggaatagtctcagtaggattggtaccagttctttgtacatctggtagaattcagctgcgaatctatccgatccagggctttttttttttttttttgagacggggtctggttctgtaacccaggttggagtgcagtggcgttatcttggcccactgcaatctctgccttttaggctcgagccaacctcccacctcagcctcctaagtagctaggactatgggcatgcgccaccacaccaggactttttttaattggtaggtttttattactggttcagtttgagaactcgttattggtctgttcatgtttttactgtcttcctagtacaatcttgggaggttgtgtgtttctaagaatttatcaattttctaatttgtgtgcaaagagatgtttttaatagtctctgaggttcttttgtatttctgtgggattggttttaatgtcacctttgtcatttctgattgcaagtagctgaattttattgaatagcaaggctgatgtgattatataggcatgttttaaaattctccgttaactgtgtttaatgaaatattacaatatgaagagttttaacatggaatagtaagacagaaaatatggatgaaagcatggaataatttccttggaactcatttctactctcctaatcaaaagtagactagtctaaaaaaagcacacaggggattttctttttttttacaagtacccatgactttgaatgaatctgtgtcttgaaccttggtagatgagaaatcatagtggtctatgctctaacaacatttttttggagattacatttcgagaaaatctcagtctccatgatttctcagagatgcctaatggctttagattcatggagcatatgctcaccactctactcccaccaagcaaaactaacttgaaaacagtactacagctaggaaacaaagacaatgccaggtctttgtgagaatgcactatttatgatcaaataataagtaggaatttacagtcagacttttaatttccaagatcatgcttatttctattgatatcgagtcgtattaatagtagaaattaatagataattatgaagcataggtttaacttaaaagtccatttattaaaaatccaaattgtctatacttgattcctcctcttgaaaacccattttaatcaggtttctttccccactgtgttttgccagaactgctttgggtaagatcaccagtcactccctgtagctatatgtctagttctcagtcttattattaattaacttggcttctggcaccacactctcctggtggtcctccttcttcactggctgcccctgtcatttcctttgatgattcttccttacctccttagattcttactgttatagggcctcagaccttggatttggacctcttttttttccatgcttattcctttggcaattttacccagtcacttagataagctagatagctgccaaatgaactctttgatgtacatgttccaagggggaaggacacatatcccattcttccccctagactttcatttttccatggtatttttcatcttatttgataggatttccatcctcctagttgcttaactgcttttctcaatctgtacatcttctcctcagaaaatcctagtggctctaccttctgaacataccgaaaataattattaactccaccactagcaccctaatcccaaagccaacatctcttttctgcatatttacagaagtcttctaacttatcatcctgcttttgccctccctgttcttccatttattttcaattagagcaggcagagtgatctagcagattatattactctgctcaaaactattcagaagcttttcatctcacctagagtacaagcccaggttcttacagtgatctcccattattttgttaatctcatgaactccagcttttccttgttcactccacttgagccactggctctttcccaagatagctgcatgattcgcttactcatcttattcatatctttctgaacctcagctttttcatctataagaaggggtttttagttggtatttttcttaactgggtttgtaagctttaacttttgaaacatttagccaactgcctggtattttaaattctttgctataacttttgtgcttcaatatcctcatctgtaagatgagagtaatgaatattacttacatatgtactgagaggattaaacaagttaatatatgtacagcactcagtacaatgaccagcacctagtaagcactatatacgtgttgtgtgttattatgaatgttatctagtttatatggcactttctttctagatctgagaaggttaattttgtgctgcatcacagctttttatacttagggcttatgtctgcttgcagcaagaatttacccacacaatctatattctttataagaagcctgtatgtcagtctgcttcttaactaactcattatcagtttggcaacatccttttgggccaaggttgcaaaggttgcaaatctgagtcagtgcttaggtctccctgaacagtatctctccctctagccttccagaatcctggagtgcctgctttgccacacaatatatgcacaagattatgattatagattaaggaatgatttacaaacaaaaaataaaaatcttatggatctaaggagcaatataattgaactttatttatggttattttttttccattctatttattagtttctctattgtcgaatcaaacgtccttaaaggagtaggagaaattcttattttttataccagtcactttcagtcttagtttcattacaagttctaatgtaggtgtatcattcaattaactactctgttatctctgaaagcctgcatgttagaaggcaatgttgtatgttcttgcagtttcatagtttctgaagagctaataaacaacaaaactacaatgaccaactaatttacacagttttgttattcttatatgtatatgactggaaaataaatactattttatataataagatgtcatcagaatataaaatataaatataaaatatattttatattcctaatataaaatataaatataaaatatattttatattcctaatctaaaatataaatacttccagtaattaagtaattccaagagatctcaacttaggagtcagtgaaaaaaagatctagaaggtttatatttctatcattacttaattatacttcagcaattttttttattacctccaggaaaataattgaatcatcgaagttctacagcttaagagatatgttacttttcttcattgtttcttgaactgactgattcttcattctaaatattgaacattctcagctattgaacttatattaaactttactctctacttttctgtcattaagtagaggagctgtttggtacattacttgtctttaagcctagaccagatatactctactactaatttttcttttattataaaatttatactatgagttactataaatagaggggttgtgggtattaaccacatgtaaaaaggttgtttactttctaaagtatggtttgtcagggggcagagtgctgtactagcagaacaggggctttgttgatcatgtgacattgagcaacttgtgttttctcagcctcagtttctttatacttaaaattagagtcagagttatgtgaattttaggcaacaatatatgttcctagtgcttagaaaatactagtccctgtctcattactcctttctgtttctttacatctcaccgagtagaatgggtaacaaatgaaatccaaagtagttatcatcattagctagagaaacccaaaatttaagccattctccagtattgataagaaatctttaagcactagagcagtgatctagctgctcattttgtattttgaaacatattaaagcataagctgcttctgccagttgtaaaaatataacatatcgaaatatattttcatttcttcacagttttcctttatatttaatgataaaatgagtatattaatccattcatgcactgctgtaaagaaataactgaggctaggtaatttataaggaaaagaggtttaattggctcatggttcagcgggctgtacaggaagcatggcagcatctgcttctggggagcctcagaaattttactcgtggcagtcaaagcaagtcaaagcaagagcgagcatcttacgtggcaggagcaggaccaagagagagagcggggaggtgccacacacttttaaacaaccagatctcaggataactcactatcatgaaaccagcaccaaggaggaaatctgcccctataatccaatcacctccaccaggccccacctccaacattggtgattataattgaacataatatttgggtggggacacagactcaaactatatcaatgagtaccttacattttattattttgataatttggatacaattcattaagctttattacttataaaatataagagtaaaatatgatatctttaatatacataaagaaacaacaacgattttattttaccaatcaagaatataaactgctgacataataaaaataaagtaaatgttaaaagtttgattaggtccaaaaatcagaaaatgttgccaaaacaattcactggaaatctctgtgaatagtctctttaatatttttgtatattagctgtgtaattttcttgtgctttttttctcctacacaggagagcctgacaaggagctgaatcctaagaagaagatttgggagcagatccagcctgatcttcacactaatgatgagtgtgtggctacatacaaaggagttccctttgaggtgaaagggaagggagtatgtagggctcaaaccatgagcaacagtggaatcaaataaaatgcttccactaccaaaagacattagagaaaaccttaaaagtaataaagagaaatatatttgtcacttatacctaaaatatgagtggctcatttttgcattactctcttctagacttgactagtcatttacttggtatatattgttttcattgattggggaaacactagatttttacctcggtttttgatcatttataatggagagaggaagttgcctatgttttgtaataatttattttttagcaggaatattgattagcagcttttttttctttatacacatagataactaactagattaatgtttagtttcttatttgtaggcacaggatgcatgaaatttcaagctctgggattttttgtatattgtgtatctgtatcaaaaatatcctctccttttcaaaaatgacaggttggaaaatgtttgtcagacttattaactggtcatattataataatactgataatgaccaactgctcattctgaaagccaaacataaaagctaggagaagtggcatctgaacatttttgctttgctgccagagtaaccctgactaataatacaataacagcaatttttttaaaaaactgagatttcctactggcttgaagtttttctatttagcaaaataattagtaataagttttgactaggtctaaagaatgaacacattgtaaacagttgccacagtagtttctaataaattgatcataaaagcagctatcctttttttttttaattctagcttctttttaaagattatttgggtacctaataaaggataatttatatctt

SEQ ID NO: 36191 - DNA, 14536 bp, Homo sapiens
cgactgggccaggcgccggggcaggaagggaggcggccgccgtgccattcttaaaggcgcccgagtgtaggcgacaggccgctgacggccggaaggaaaatggtgagttgccgctgggagggcgggggccggagggctgggcgagccggccagccgggttttcccggtttccggagccggcggcggcgggcagcgcccaggagggctcggcggccgcttccgctcccagcagctggccagtgcccatagctagagtacttggcctctgccgccgccaccacgcctcagggcagcatcttccagctgggcccggggtggacccgcccagcgggccatgggactagggtgcggccacgagcaggggggttggggaggccccacgccaggtccttctggttggagggcttcagcttctgagctgtaggttggagggaaaggggtctgccccatcggagggctccctcaattcctgctttccctgccagggccgtggccaggttccaggggttggtgggccccgagcatcttccacctggcggcgttttgggggaggactcgaattccgattgaattctctcggcctcaccttagcttctttctctctgctcctttccctagcttcctacagaggatttctccttatctttgctttcctatggcagttggaaacctttcgacccaaagctttggcactgggccttaaagtaattgtcaataactttagttttgttggttctgggggctgtggcttctgttcttacatgggatggaccccaagcataaaaataaagtggaaaattaaataaatcgccatcaaggatcttttggatccatcccattaggttttaaaatatgggtaaatttcattagaaacaacaaaacactgctctctgtgaccatccactcaattctcagcccactttcatcgaatagatcttgtcatggtcactgaatcgaatggattcttttcagttttcgtcttctctgaccttttagctgcattccagagtgttatactctcttgtttttgaagcattctcttccttcattcttcccctttggcttctgggatacagagctcctcctacttctcctattggtccatctgtttccctttcagactattctcctttccctggacaatgctcgaaggagtcccaggtttcatcctaatccttcattttccattctgtattcttcatcctaaactatggcttcagttaccatctatattcagatgacttgtgaatttacagctcagaagaccttgcttctgagatccaatccagatctgtatgtacttttttttctttgagtcggagtttcactcttgtggcccaggctggagtgcaatggcgggatctcggcccattgcaacctccgcctcccaggttcaagcagttctcctgcctcagcctcccaagtagctgggattacaggcatgtgccaccacgcccggctaattttgtttttttgtttgtttgttttgagatggagtctcgctctgtcgcgttggttggagtgcagtggcgcgatctccgctcactgcaagctccgcctccctggttcacgccgttcgttctcccgcctcagcctcccgagtagctgggactacaggctcccgccaccacacccggctaattttgtttttgtatttttagtacagacggggtttcaccgtgttagccaggatggtctcgatctcctgacctcgtgatccacctgcctcggcctcccaaagtgctgggattacaggcgtgagccaccgcgcccggccctaattttgtatttttagtagagacggggtttcaccatgttagccaggatggtctcgatctcctgacctcaagtgatccacctgccccggcctcccaaagtgttgagattacagacgtgagctaccgcgcctgaccccagatctatatattaatatttcaatatttagttaccattcccctgggaagcttttcctccacttggtctcctcaaagccacctcagtttgtccaaagtagaactcatgccctttctcctcaaacctagtcttctgtctgttatacaagacaatctgttataccagccagaagcctagtatatctggtaacccttttttttgcttactcacaccccacccccacccccaatatccaatctgtcaccacctcctttgtagtggttaagagagtgagttaagataggctgcctgggttgaatcctggctccactagctatgtaattggggaaagatacttaacctctctaaaccttagtttcttgcaaaatgggagtaataatagtatctgtttcgtgagattgttttgaacataaaaggaaatctatgtaaaggatataacagtgtttctctcatagggtctgatacatgttaactattattaggactaaatgggaattttttgctattgagttgtttgagatccttgtatattctgattattaatcctttgttgagtggagaatttgcagatattttctcccattctgtaggttgtctcttcactcgttgttttctttcctctcagaagctttttagcttgatatgatctcatttgtctattttgctttagttgtctgtgcttttgaggtcttactcaaaaaaatctttgcccagaccaatgtcctgaagcaattgcccagtgttttcttctagtggttgtatagtttcagatcttacatttaagtctttaatccattttgatttgatttttgtatatgctgagagttggggtctgtttgtttttgtttttttgtttttgtttttgagatggagtctcgctctgtcgccaggctagagtgcagtggtgcaatctcggctcactgcaacctcagcctcccgggttcaagcgattctcctgcctcagcctcccgagtagctgggattacagacgcttgccaccacgcccagctaatttttgtatttttagtagagacggggtttcaccatgttagccaggctggtctcgaactcctgacctcatgatccgcccgcctcggcctcccaaagtgctgggattacaggcgtgagccactgtgcccggcccggggtctggttttattctgcatatagctatctggttttcccagcaccatttattggagagagtgtcctttccccagtgtatgtttttggcatcattgtccaaaatgagttggctataaatgtgtagatttacttctgggttctctattctgtttcattggcctgtgtgtgtggttttatgccaggatcatgctgttttggtaactattgttttgtagtatattttgaagtactgctttgttctttttgctgagggttgctttggctattcacagtcttttgtggctccttacaaattttaggatcttttctctcttgcttttaagaatgtcattggtattttgatggggattgcattgaatctgtagatcactttgggttagtatggacattttaacaatattatgtcttgtaatccatgagcttggaatctttccatttttgtatgttctcttcaatttctttcatctgtgttttataattttcattgtagagatctgtcacttctttggttaaatttattcctaaattttttatagctattgtaagtgagattgctttcttgatttctttttcagattgtttcctgttgttgtatataaatgctactgatttttgtatgttgattttgtatcctaaactttactgaaatcatttatcagttctaatagttttttttttaatggagtctttagctttttctaaatataagatcatgttgtcataaacaaggataatttgacttctttttttctaacttggatgtcttttatttctttctcttccctaactgctctggctaggactcccagtactatgttgaataaaagtggtacaattgggcatccttgttttactccagaacttagagtaaaggctttcagtttttccccatttagtatgctgtcagctgtgggtttgtcatatatggcctttattgttttgaggtgtgttctttctatacccaatttgttgagggtttttatcatgaaaggatgttgaattttatcaaatgttttttcagcatctcttgaaatgatacgatttttgttattctgttaatgtaatgtatcacatttattgatttgcccatgttgaaccattcttacatccctgggataatcccacttgatcacggtgaatgatctttttaatgtgttgttgcatctggttttctagtattttgttaaggatttttgcatctatgttcatcaagcatattgacctatagtttttttttgttgttgtatacttgtctggttgtggtatcagggtaatgctgttcttgtagaatgagcttggaggtatgttctccccttcaatttttttgaatagtttgagtagaagtggtgttttaaatctttggtagaattcagcagtgaagccctcagatcctgagtttttctttgatgggagactttattactgtttcagtctcattactcattattggtttgttcaggttttctatttcttcatggttgagtcttggtagattgtgtgtgtccaagaatttatccattgcttccaggttttccattttgttatagtgttcataatagtctctaatgattctttgtatttctgtggtatcaatcgcaatgtttctttttgtctctgcttttatttcttttgcacattcttagtagctcctttttatatctctataatcatttaattataatataaaatattattggtctttactcttatggggtttttaacacttttgttgcttatattttttttcccctgtaattgtgaggacaaaaaataatttattaattctaagtataatcagattattttcttgttcttccttcactgtgtaaaaatagtatgcttgactccctttctaacagcagacagtgattcttgactttccccatattcttcccttcctctccagttctgatgacattgcacattattatgtgtgtggtttttgagacattcattagccaaagagaaagttaaaatataccttacatatatgagatgaacaaatttgtaggattaagcaatgtagatccaaaggttggttgattttaaagttcttttaagtgttcatgtatttaatgctttcacttaattgacatttgtgaatgtcagtatgcattataaaggtattaggtttcataactttaacatgtacatatattgaagtcatggcattttatgtgtgttttttttcttttatagagtgagtctttggttgtttgtgatgttgccgaagatttagtggaaaagctgagaaagtttcgttttcgcaaagaaacgaacaacgctgctattataagtaagctaaaagtgattgcctcaaagttacatggtcttaatttgtttttaatcttgtagctacattgaatgaactgaaccgttggaaagcaatgttacttcctctgtttcatttccccaccaccacctttagatcactttaaaaaataagtaacagctaattctaatgtcacagaacagaggtggattgtcccacctcccccatagtccttttatcagctgcctgtacagctctggagaaggcggtcgtcttggtccttgggtaatgaggattcccatctgcagtgacccatccaacccatccttcttgggggactaaaaatagcctggccattcatcctcaaatagaaacctttgcctacacctaaaatgacaaagttcagcattgtgtacatagtgactttgggcattattccagttgtagatttgaactctggtttcaggaagagtacttttaagtggcactggcactatcttctgaaaatggaaaaagtgatttgcatattgctcctcccactgtgagctatatctgacattatgcagatttcccttgtattcataggcagtatttaatatgtaggtagtgatttagaaagatgaggaaaggatgagggggtgaaaatgtaaaactctagagaccatgcttaacagagatgcatctggcagatgtgatttaatcagaggtcatgacaacttgtcatgaattctgatttcattataaataaatactgcaatgtcgacatatggttcttaaaagtgaaaaaaaaataaaagtgaaaatgtgtgttagtgccatttactgcaaaagctgaaactatttgagattacattatatctcacaagatttactatcaaattggtgcaaaaccaaacatggtcaactttgccagactaacaggaaaggatagaggcatagagtatctaaacttattttgatttagctttggattacattagatatatttgaatgtagatatcacttctatttggttattcactttcttagaataatgataccgtgccatgaaatcctgaccttggagaagccaggaattttgaggtttctctattttgatccccgatcaggcactttttcccttgcagttctgaccatgttgcatatagaccaatcagttacagttaccctttcaggctttttcttattatctagaagttggatttgagttacaaagttctttcatatacacaggaaatgtaagaaattaacagcaagttctaaataagcaaattaggtactgggaattatgggtaaaagcttttaaaagctgacagcttgaaaagcaaagctagctaataaaccgtaaactaaaactgtgaattagttatatgcttctgtttcttgatgttttaattttagatgtccgaaaaaaaaggctgagattgtgtgggttgggcagatcagggtcacattagaatcccagcttactcatacttgatttttattttagtgaagattgacaaggataaacgcctggtggtactggatgaggagcttgaggtttgttcaatgaactaaatacaattttatagttaagtaattattatttctcaaaagatgctatattagttacatatgcttctaaaacgaatcttgaacctcctttaaatacatgctcattatgcataaaagcatgtgctaattgtgtagtttgtgatattgctaatttaactaccttgtttaaaagcattagtgaagtccagtgtaataagtggtataagttggggtcatatactgagtaagaagtgagtcaactttgtaacttgcttctaagttgcttgactagtacttaaaacctgaaaccctacaatttaaatatctggtttgtcaaattaagtaactagagtaaaaagaattcaattcttttttctgaaatcagacattgtttctttccgctaagatactggcttatgtcattcagtatttcctgacagctgggacataagcatagaatctgtgcctcccagccccatatttacttaataaatggaatgaaaccaagtgggcagaaggaggctttgattggattgagaatttagtaacctgagtttatgtataatttagtaagataaaattttattttgtagcatgtggtaataaatttataactgttagtagaatgggtgcttggtgtatctcttaaggacttatgggtaagaaaatgtttaaaagttgcttttctctgtggtgccagggcatttcaccagatgaacttaaagatgaactacctgaacgacaacctcgatatccttttcttagtgctttaaaagatttattttctttagtggtcagacctgtttgtgagctcatttgttaaacatctaaaagtatccttctgtgtcatgatgacagccaaattaaaatatgtgtgcatatactagactaagaaaaatgaaaagttggtttattcgtgggatgaataattttctttttaaaactatttcctttattataacgtgtacaataaaaattgagaaaataatctgtattaaacttgtactttaaaaagttaaattttttgagagattatgtgattttataacttatccttggaacccatttaattttgtggaaagataataatgaaggtgtggcctaaaagaataggacagaaacttgcagctcagtagctccccaggtgttggtaaatacctgtctgagagcagtaactttagtttctttaacttgagaaaaaccttcattgtgtatagttataaatatcaacatgatgatggaagagtttcatatcctctgtgctttattttctccagtcctgttggtaagtgaatttctttaaataacacatatttggcttagatccaattaagccattttatactagacaaattttctgctgtttttaaagatgaacattgttgaataacctaaattgaggagggtctgtgtctatgtgtgtccatgtgcctgtgtgcatgcatccctagaaagaatgaagcatcatctcttagaacttattttcttaggataaatttctagacgtgtaattgttgactcaaatcatacatgtattttaaggattttgaaacgtgatgacattctaatatagcagaagtattttctttttatattttaatcatataaaaatgtgaacttcacatataattgcatatatttgtgtttcttttaaatagtagttaacagtgatatgcttataatcttgagaatggtcctagagtaatttacattgggtattaaaatgggttactggtatttaaggaattcattatcaccagaacttctatcaccactgttcaggcctgcaataaaaactgcattcactgagctattctccaaacttcataatttgtataatttacttcccactcaaaatatactgcagtatatttttaacttaatatatcggcagagtgaaacttttatcagagcagatctccctgccctactggtccactaccatcccaaaaccttgtgtattttagtcatccataaaattgatcttgatatttagtgtcaaagttaagatagtgcagaaagtttttaattgtttgcaaggctctaaaagtcaggatctacaaatgtctagaatctttatttttgccaacctgtagacttgttcttgtttatttataacttaactgtctctttctgtaggcagtgtgcaatgtaagactcaaaatacaacccatatatattctgtaaactcaatagcaaaggaaatcctaaatgtgtcattttaaaaaataaaaataatgataacccatacctttctcaaaatctgtgtctcatttctacactaatctctcttttccaggatgtaagcctgaacaacagatgatgtatgctggaagtaagaataagctagtccagacagctgaactaaccaaggtggtatttatatttgactgacttgttgagacaatattttcctttagactataaagcaatagctaaaatagtctaaaggagtattttttatgcaggtgaaggttatttagaccagattagtaagttagccaaagctttttgttaactggaaatagaatgagatagaagcgtttgaaccaaagtgtattttttgaataagttgattggaagaaatcacattcaaaatataggcagtgttagaaagccactgtaactattaaatctattgagagttagtttatctgccataaggtaatttctaatagataagggtcagcattgaagtttctctgaaccctttaccatagtctaaaatgaaccgagttctgtgctggaattcagtattatgcagttaattgtattgtttccaaatataaaattgttaagaatattaataaagttagaacattctgttttatatgagaacttgctttaagatttaacatgtccctattttatggtatttttgaaagttaaaggtaagaggtacttggctctcaaactttatttaacttccacatattagtttgaattgaaaaagtatatgcacttaaggttttgaaataggatattatattgccaaaactgtgttagacagtatttcctttcaagttttattttaagaacagcatcagtattttccccttgggtgcttaataatcaactctggaatgcctttaagtgccctctgctgtttccccttagcccatgtgattgttaccactgctttatagacattactttttcctgatttgtaacacagggacactggagttgctctaacggtttgggtggttaagaaggagctgttaacggcctcaagtctgttctaatcctggggatgccctacagtgctgaagttgagacattacagtttaccagttacttttacagataatctcattgaatccttacaacagccctgtgagatattctgtagataggaaaacagacccagtggatgaatgacttgctcagggttgcataacagtaaatttagacagagctaggatttagctctgtctaggacttaggattcacatctggctccaaatcctatcctttctgctgtaatacattgcttttctatagccgttatgctttctgggcctgattcagattcttgctggagatttgtggctgatctccatctccctctgatatttccatttgacattcagactctggaagaccagcgtatgttcctcagttcctaactagattgattttagttgtgtttacttgggatgtcttctaggagataagatttacagaactgctcttttagactatttgtagatttgtgcttttgggagagttttggtttcatgttgtcttgattgctgtactttggtaactgagtacttagcatttaaaagaagtgaagttctacctaaaaggtatatctcatttacacaggttaagtcatgaacaatatgaaaggaagcagaatttggtatttaatactcaaatatataaccaaaaatagtttggtgtataatactcaaatatattttaaaaaattcaaatatttgactttttttttggagtgtcaaagtatgacccaagttttttttttttttaaaggtatttgaaataagaaataccgaagacctaactgaagaatggttacgtgagaaacttggattttttcactaatgtgaacttctgtgtttctaaagtatttatgtattaacctgaccatactggaatcagacataaatacttatttatgcctaaaaatgcactgttacttacagtttgtttcctgcagtaaagaaaaattcttcatttgtgcaaaatttgaacaaagaggaaatcatcttcatagtaatgaaactttgtaaagtgtttccttatattggtaattgttaggtggactacttttctccagggactttttgcactcttgtgactaatttctataacttatggttcggaatttgttactatttacagacaccattggaaagtggatatattagattgtgagagacaacagttgcctccttttgacaaatactggatattagcagtttatttatgaaaatagcgtattatcacttgtcaaatcattgaaattcatttggggtcaaagacttgagtgacccagtattgagccatgaataatttagtgtaacctgtattacaagtacattgatgaattctgtatcttctttggtttcctgtatctttttaatcaagtctagaaactatgttcatcagtcactcatttttaaggtcgggagttagattttatgatagaattatgactgttagcttttctccttatagcatcttagtcttagaaattggtgggttgtaataatcaagggcttcattccttttatgtcatttctagacagttttgaatctaggttaataacactttatttataaagcacctcaatgtcctgtgaacactaattattttaaatgtgttaatactgtgcctttgatttgttagctttaaagttagtttaagacttttacactgccagtattccacatttggtgaaattaatacttttttaaagggtccaaataaaataattttctaatgtgtatatctgaaatttgtaataaaatcaacttcatattttaaaaattccaactatctgcttgcattggtgaatatatggcagtcgagagttataattttgggtatacttgtggttagttttgtgccataggaaaaaattatcttaaaactttggccatagttaataacattaacacttcaatagcaatcacatcttatatcctaaatgtcagaagatattctgaactggatgcctgaatagttaactaaaccagtcttgttagatgatggtactcttggcataaagcgaggattctgatatttggcatacttgtaaaaacaaatacataagtaaccattgaacattaatttgataataggtctagagactctaaaaactaaccaaacttggtgagtgtattcttatattaagaatatcttagtcatctcaaaactagcaaaatttaaattttggcatgttttccattcatatgttctttgcattttatttttgaggtttctgtgagaagtaaagatagttggaatttttgcgatattgaatagaacatcttctgttcccaacactgtttggcttcactaatttagaagtcaggaagcaatagaaagttggagatgaggaagtgctagagtaggtgtttgttttggttcttggagggaaaagattctttattccaatttccagagagaagagaaaactcacccaggaagtttaaaaattctttaaacaggtattttgatattggagaataacatgcatataattctgtaggaatgcacatgtaatccaagtgagtggagagtgtttttaatgtttttgaatgaaggaaatgaggttttgtttcacctgttttgcagcagtaagagaaactagtgctgcaagaatgtattttttaatgaagttccttattttgtcttgcatgttttagttttgcttatttttaaatttggaggtcctccataatgtcagataatattgacctgccatacgttagcactcttagttccgctactgtctttaacaggagcaaagagctgtgataaaccatgcttttttgagcttgtctgactcctaattaataacatgtttttggcaagacaacagattgaggttagaggatcagtaggacatttttattccatctgtcctatggggaaatttacaaatcccgtgctctaaaatgttctcaaacatttatatagatttccctttcatcttactaaattttgcattgttcttttcaagtatgtttcgtatttactgtctttttttctgccatttcccaaataataactccagatttcataattccagtttttacattccgttatctttctggtacaaccattcccattcagccttaaatctgagtcctttttagcagcaacttttttcctgggatcctccttcgtggtcttctaagtcagtgttagttttgaaatttttggccctgcataagttctgcatagcatctaatgtcaaaatagaaccaactggtaatcacagtattatttagtgtggtttccatgacaacaaaaatacatacgaagaaaacttctcaggttactatgctgaaattccaaaatgtctgagttttgaatagtgatcactttgttctggtattgacgcaattatattaggaaaaaagttggttgactgtttttgtttaattgacttctaaaatgttcaaattgtctagttctaaaagtttactaaatgcctagtgcagttaaacatactcttgtttaagtgtgtgttgctaaattttttactgtcattactaaataatctgtgtggcaaaatgtgtgtcagcacttttccctccttttttatctcctattttcaggagtcaaatgtagccataaactgtatccttgtctgacactttagctaaaaatttccagttaggggagtttattgccaaattaaatttggctgttccccccaacccatatagatattaaggaaggtgtacttaaaaaatgtttggactgcttttaaaacctgagcaatgtcattaatccatatgtggactagtgatgaatagatattttcataagagtttaaatgctgatatttggtggaagtagagagtaactcatattctatcaattcaagtattcttactatggttgctttccctatttgttcaatagactgataatactggaatttatagagtttgagccattacaacttttgtgaggatgtgtttcaaacatttctggacaaatcttattttgtatttctggaagaatgtagtaatcttctagaccgcttaaaaccaatgctcccaagctgaatattcttgagaaatttgtttttattatgccatttgacatttcaaatcagtgctcatatacagtaaacttgtgatagaaattgtattttattgctttttggattataattcatataaatataattacttgaatattgtttgagatcattaacatgccagggcagttcccactgatttagatggtccaagataatctcattcaggaggcttgaaacattaatggtttagtcttgtgaattttaacagttctctgtcatcgtttaacaaaaccaacaactgacacaactccttaagctgtggtttcagtctctgctagttcatattgcatgtttattttggacagtcttttgttaagcatggtgcttgtactggtttaaataaaatgttaacatt

SEQ ID NO: 36192 - DNA, 31509 bp, Homo sapiens
tcgcacttccgtgtgccgcggcgccggagcccgaggcggctgtagcccacatctcccgagcgacccccggcgcccgcccgccgcgcggaggcccgggccacacctcactggccgcttggcccatcccagtcagcgccgcgccgaaccccgtccgcgcgcgccggggagcggcgcccccgccgctgccgccgcgacccttggcgcctgcccctgcaacgggaggtaagtgagggccgggtccgggcgcgggatcggggctaccccgagggcgcggcgcccttccttcccccttcccgccccagttcccgtttccgaaactgagaaactgagccgcggtcagcgaaagtcccgccgcgccgagacctgccggtgactccgtccccctgtccgtctgtgtgtccctccgctagacagtgggggctgaggtccttctgtctgcccgctcccggcccctccacccgcccgtgtgtctcccgctcctccgaggggcccgtccgtccctcccgactctctcccgggccctgtgtccgtccgtctgtcgccacccactctgtgttctccccctgcgcgcctctccgagacccgatccttctgtccctcgccacccgatccgtccgtcccttgccctccgcgtgctccatcgccccacccccacccacacccctacccccgcccgccgccccctcgatcccgtcctcccggagccgcgcccccggcccacgctcgccgccccctgccagtccagccgcctctccgctctaccgcggggcccaggccaggccgcccgccgggcctcgcctcccgcccctgggtccctggaggcccgacccgcgcggcgcctcctcctcgctgtctcttctttcggtctcaagagtctttctcggtcccttcatccgtctctgggctgggcgtggctccagtctccaccatcccccttcccaccccacccctccgcccctctgagacccctcccagggtggcccctgcccgatacggtctgtactcgcccccaacccagatgccactcccgttgtgggggctccaccagatgaggggaggaggtcgggggggggggtcctcctggctggtggtggagcggcagaaggagagcaccatcggaactgctcccacttccccagttccctctctcttggggcaggggagagccccaccgagccccgccttaaacctggtcagaaggatctgctgtgagtgggcggggggtccccttctctgacgcctaccctgtatgcgtggaagctgtctccttgtgctaagtcactggtatctgggtgtgtgggtatgttgtgtgtctgtgtcagcttctgtgctgtctgtcactgtgggacttgcctgtgcatgtgtgtcctttttcgcatgtgtgacttgcttgtgtgtatgtgtgtatgtctgtttgtgtcctgaggctctgtgtgtgtcttttgcaactgtgtgtaccattcttggtgtgtttgttgtcaccagactcgtgtgtgtgtgtgtgtgtgtgtgtgtccttgcctgctagtgtgtgtgtccctgtgtgtctggaggtttcggtgttgcacactgggtatatcatggtgaccaactggccatgagtacgttagatctgttaattgtggaagcccctggtgttgggtgcctacccaccagtctcatgtgtgagtgtatctgtataagtgtgtgtatgtgtgtgtactcacgtgtggctctccctctgccactgagtttctgtgaccaggcccacctggtcactaagggaggggactgatccctggggtttcctcgttcctgctgtggagtgagctggggcttggtgagcaggccagcagagggaggctgtatggtgcatgtgtgatatgtgtggttgtgtgtgtgcgtgtgtgtgtgacagagaggtgtggtggtgtctgggcagctgtacctggctgatgggtggtgtgagggctatgcgatgggacagtgctggggtaagcctgggagtgtgtggccacggtaggagtgtgtgactggtgggacacagtctatgaaactgccggtgtatgcttggggagtgactgtgattgtggggaaccgagagtgcctgggcgtgggtgttagcggcaggagggggtgtgacaaggtgtgtggtgacagtgctgggagggaaggtgagagcccagtgtgggggtgtgtgtgtgagtgtgtgggagaccatgaggatgtgggtgtgcacatggagagggctagagggcaagtcttggggtttgtagtgttgtgaccaagacctcgggctctgtacccaagaattatttgggctccaatacttgcttgtgcctgttaagagcaagagacccaagctaggcctctcaaggctgagtgtccttatctgcagaatggagagagtgaggacaaaagttcctgtgttaaaggtcctttaacacaatcttggcccatagtgagaacacagcacatgtgaagtcttttgttgtcaccacccccagctatacggttcccattctcctgggagctggggctaaagaaagcccagacagtatccaacccaatttcctgcctgtctgttgccccttcccatctccttgaccaagcagcttgagggaggggggatgcccagacagagcccccagtacccagccctgttcagcctgcatgacagcccctccctcaccagaccttagtgtcagtagtagcgatgggggagacaggggtgggggatgattcagagctgtgactgcagggcgctgacaccatttagctggcacagtttagattaaaattagaaataatttaaagtacagacaaaaagataaagccaaggatgcctctgcccccagggaatggtgatgggggtctccagctgggggaggggttcacatctggggagcagaatctttcttagaggcttgagctggccttcagagaaaatgcttaggcctttcagccaggagacacagagtaccttgctacctttgccatttcttcctcccaggatatctccaggcctcagttttttcagctgtgtaatgggcacaatagtaatgtgagaatcacctgaactgtaaggcacaagagattaaaaaatgtcactcttcagtctgggcacggtggctcacacctgtaatcccagcattttgggaagccgaggcaggtggatcacttggtcaggaatttgagaccagcctggccaacatggtgaaaccctgtctgtaccaaaactacaaaaattagctgggtgtggtggcgcgcacctgtaatctcagctgctcaggaggctgaggcacgagaatcacttgagaccaggaggcagaggttgcagtgagccaagatcgtgccattgcactccagcctgggcgatagagtgagaccctgccacattaaaaaaaaaaaaaagtcactattcatttggcattctcaacatgagtccagcacaggagctggcacgccacatcattggaacctcagaaccacctggggagaagaggctagtagtttccccattaaaaaaactgaggctcagggaaattgcaccaggacataaagtggtggtactttgttgcaccctaggactcctaaacctgcaaggcaacctcccacagacaggagggtcaggaacaggtttttgctgtgttattggcttcctcaccaggctggaaatgtgctcagggcagggacacagtgttccagcccctaccatggagtggacaaatagtggtgcccaggaaaagttgggcccaacaccacatttcaaggaagggaaagccacatccagagagacccgaggttttaggtccaggagagactgaactgggcccgtcagccatgctgggactggtagacggggagagcctgtttggcggtgcctcccggctcagctgtttcctcctgttcctacaggtctgcagggaactggccaggcaagggggcaggcccgtttctcctggtggttggtgcgttgtagcagcagcgggagccaggactaaggacaagcaggagctgggagccccaggtaggactgagttctcttaggcagatggatggtgcaccggtgtagccttcctctctggcctctttgtcctttgctgtggaactggatggggttgggcatgcatgcagagtccttgatctggttgtgggccctgtgtgcccaggggccgcagctgtttgccctgtctatgaggggctctctgctcatgaggaacttcctgcctaacctggctgtggccccagaatgctctcaccttggagctcagaggcctggggcctaccattaatttggggcaaaaagtagtaacgcttttttggtcagttagagagggtggctcatgggccaaagattgagggtgggtgtgtcagcttttccatggccctgtatctgcctcaaactcacctcatcatcacacaaggacactgaaattccccgtgggccccacagtgggttggacactgcagggggatggaatggggtctccagctccaggtacagctgagctgtcttccacaccccaggcccctccattttccccagcttctctggagcccgagcagggctcagtccctctcttcagcttccagattcaaggggagctaggcagagtctggaacaatgctgggaaggctgcagtctctttgaatcccctcagaaagctagaaattccttgttttggggcgagccttgcctccttcagccctattaccatgaaaacattgctgtgggtgactccatactcattccaggctggtgactgggtgaccgggccccagtgaacagggtactggtggtgggtatgggtgctaatgaagctggagcctcggagtaacagtggggggatagcaaagaccgtctttcctccaggagtgctccctgagcagaccctcacagccaaccctactggctgttacgcacctataggtctgtgagtagagccataaaggctgggcttcctgggcctgactctgggttgggggcagaagggaggtcagggccttcactctggggtaggagttgggacagaacaggagcagtcttcactgggccttctgtgtattggacctgtccctaaacctggtgtggaggaagtaaagcgcctttggctgtctaggggcctctgccacctaagttctgaagagccagccctttccgtcactcagccttgttttgtaaggagtttgattagtcttggagacagcccactgtaaaccctcagacatcaccctccagctgcacagacatatgcgtgctcacacagggatatggcaagctaggctgcagtgggcatgcacacccacagactcatgagttcctgtacgtgcaccacacatgtgggcatgcaggtacacaggtgctcacatgcagccacccatggcacactcacacacacacagatgctctcccagttaccgttggcatccatgcactcaaatgcctgcccacacataccgcactgtgcccattctggggtcaggaaggggtccctggtcagagttacagcccagtcaggtcgcctgcatctggcacctgaggggcaagttccaggtgtggctgtgatctcagtaaggggggctgggccaccctggtaggtgggctctgcccatgcattcagcagccaccctgcccacctggccccaggctccaggccgaccagggattggcatgggagatgggaggcatgaatgcgggggagaggctgtgtcagctgtgccagcactgtgtgcctgctgctacagcagaggaagtaggctgtctggccatggggccaaggtgctcacagtgggtgggggtcctatcaactcctgtgtcccccacggtgtccatgcctagagggagtggagttgctgggctctagggactgagaggttggcaggggctgtctgttcacttcccaaagcctgggcctaggagagaggcccatctgttcaaggcgtttccggaggcttacttcctctgagctgcccaggaagtggttttggagtgggactgaccagccctctgtcagtggctctacgccttgctccgcccctgccttgcctgcccaggggagcagcgtctggccaccgggttaggctgactgaccaggcttttcactgccagggctgcccaggcctttttggggggctctaggagaagggcagggggcaggtcacgaagtcccctgcagtccccacaaccgtggctcctttcttgctctgagcctgtaagccgaggctcaagagcatcaactctggtaggcatggcccccttgagagaggtgatggctgggctgcatcttagtgactaggcagctcccagcagctctatgaatgaacctgggcaagtggctctgccgctcagtgcctcagtctccccctgacagatgagataatgatagcatccatcttgatgaggttgtgcggaaatgacagataacatatgcaaagtagctggcatcgtgcttagtgcattgtcagagttgaatgagtagaaactgtagttatgtaaagcatttagagcccagttcatgggaactattcaaaaaatagcaagtgggactgatgagggggtattattatctgatgggctgggcactggcccagtgttacatggccaggtggctgtggagcctggctgaggagccaggtctctgactccctcatccccctcaattctacctccagtggcagtgccctacttgttcagtaggttccatgccctccgaggagaggagctcctgttggagcagctccacccactcagcagtccagcccctgcctgctcttctccccctcactccctttcaaagggagaaaatagatctcgtgacaaatggatgcagggaggggaaaggcagtctgcagctgcctgctgccccctcagggctccccttggccctctccagctctggcctcctgcaggacattaggctgggagaattggctgggaacgagggggtggacgtaagccctcctgccagcctgcttacccttcagacccctggagtcagcctgtgggctggggcagggagtgggcatctgggactgatggaagctagaagagtagggggagctagaaaaccccctacacccatggcagctgggggcagggcccagcctgtcccagggacacgaagaaggtcagcacagttagggttgggctaagcattggccttcactgtgtggggcccagaggctggggatgaggagtgttgaggagtggtaaggacagtgatgcaaacagcaggggcctgagggctggagagcgaaaggtggatgggcctgggcgggaagtgtggttgagggtatcctgaaggcttaggagcaggacttctgcaggcatcagacagaccctggttgaatccttgctcaatatttactggctgtgcacacttgagccagggactggaccgttccccacttgcctcgtctgtgaaatgggcagatcacggggtgtggtgtcctgtgagacatgaacgatgggaaggagccactgtgtggggtggggtggagcaggaagacggaacagcaagcccagaggctcctaagcgggaaggaactggctgcttcgggaactgaaaggggtcagcgtggctggggcacaggaatgagggaaaggcagcgcctgcccgagaggtcagggaggtaacggtgatggggaggggggtggcggggggcaggctgcatggagcaggctgaggggaggagtctgggcttgtcagaggggcaatgggaggcactgggggcttgggcagggggtgacaaaatctgtctgaaaagccccgtctggtggctggaacagggggactgtcgggccggggtagaggatggagagcagtcagaagacaggtgcagagcctggggatggtggtggtgggagaagaggatttgagacttgaggacaggctgcagcggcagacgggatggccttattgtgtggggagcagggggagctgtctggcctgagccactgcctgagctcgtgcactcctagtggatgaggagcgctgggaggggaacggcgggggactggtgtgggcaggcttgagctcttctggagtcattcatgtggtgaagccagggaggcaggtggggccacaagcctgaagttcaggagggtctgggcccaaagtagagacgggagcctaaagccaggattggggaggagagggctcaacaggccttctaaggggtgggggagcatttgagaggcccacgaacaggactgggatggctgtccctcaaaggtctctgccaaggcacccaggagggcaggcttgtggtggctgagccgctgttttcacaacagctccggaagctttggatcatgtctatggccgtgttgggtaaacaggcagagcagagcaggcagtcgccaaggcctgaggctagatcagatgtctgcgtggtgtaggttgtgggctggggttgttggggtgggaggaggatcccagggtcctccagtgtcagggctggagaaagcttagaggtctccattgttgagacagggaggctggagccccgggaggggcagtagctggccagcctctgccagtggactcatgctgcctgcttcagcccagttctgcccagagcctcaggccagaacagggcaccctgcggctggggggcttaacagagcctcttttcccactttccaaggaagtctggaagacaccagagcacttgggccaagatcgcggagcacccaggcagcagatctgagctaggcctgtctaggtccaagctcgccggttcctctgtccgctgcctgctgtgggatggcgcaccatgcgggatggtcctgcctctctcccagctttctcaatatccccaaagtggggaagcatcatgtggatcctgcccagatcctggggatgactggcaaaagggttaggtggccatcttgccttctcccaaacacaaaacgattgtttccaatggtaaaccatctggaaaatcgtgggaactctgtgggagaaagaagggctaaggagtagggctcttgtactgggggctgatggaggagctgttcccatctccaaacacataccctcaccccattggaggccagatgggcagttctaggactagagctggaagttctctccccacttccccctgggtctgccccattggctttgtggctttggttgaattgctcaacctctctttcggtttctgcacagtgagcctggagctcaaggaacttgctcctggggtgcccggcttgctgccctaccaacataggttcaagccctcccctccccctgcgcgccaggcctgtgactgccacctgtgaccttcaacctccaccatagcctcagggccctgcaggcaggtgggcgggcgggcggaggcctgcccagtgatgtgcctgaccagcccactccttcccttacacactttagactttgctctggatcaagagggactttcttcgtctccctgggtggaaaggcccagcctagcctgacaccagctgcccttctgcccctcctccattccccagccattgtgcctgggggctgtggtggaaaaagctgcatttggacttcatggtgccagactctagtcagggatgtggggtccttccaggactgtatgtttgtttctgtgtctgcctggagcatctctgtgccagtgtgtacatcacagcttgtggcactccacgtgcgtgtggagcctatgtggtcgggtgtggtctgtgtgggcccgggtatctgttgagatgtgagagccggtgagtgcatgtgtgtttctgtgtgtgtgtgtgtgtgtgtgtacgtgtgcccctgtgtcatcacagcagtgtgtgtacgtacctgtggctccaactgtgtgcgtgtgtgtctaatgtcgagtggggctccctatgtgctgtttgggttggcgagtgtgcctgtgtgcacacgtgtggttattcgtggagaggcccggctgcatcccccaccctggctcctcacagaggccccttgtcctcacaggatctggctctctggctcctgccatgaaggggcctttgttcctctctcaggggtacctggggcaccgccctctgactgagcccaggactcctcatatcctagggctggctggtgactcgaggcctgtgcctggtggcctccctccaaggaggccctaccccacacaagctggcagaggtggatgtgagccgatgacagccaggctcccaagtcctgcccctctgaaccttccagaccctctggcagggcaggccattatgctcctgctgacccctcagatcgaaggcccccagccaacaggtccctgcagcctccgttctcctccagcccccctcactccctgctactcactgcctgcgtggcgcatcctacagaggtcttaccatcctttgtaatcacatatttatgtgactggctcccaccaggctgtaagttccatgggcctggtgtggcagaggttaccagtgggaaagcagctagcttcctgagaggtgggaagggtcccccagggccagccttctgagctgcctggaaggatctgtgggaattcagaaggctgttccagctgagggaacaacatctgcaaaaatatgggggctgggaaatgagacatatgttcacagagtagccagaacagggattgaggtagagagcaggacagggccagggagtgggcagtctggaaggcctggagaggtctgggctttctccaggggcagtgagagcctaggaggttcccagctgtgggaagaatgggtaggggagggaccagagatggtgacaaccgggagggagctgggtaaggggaggagaggccacaggtactggttggtctgtgtggggtgagggaggggcccaggaggagcgctggctgggggatgaggtacctgtcctgggaggagcaggtatggggagcatccctgctctgggacttggctgtgacctgagtccatagatctggttcttatctcagcacagggctgggcatgtggaggctgggggatgggccctggtggaggaaccctaaagggtcttgctagcctttcccctcccacctcctgttcctcttgctgagcccacttcctgggttgtgaaacctgcatggcctccttgccttgtttccgctgggaaggccatctaggcagccagcctcccagcccagctaccacccacctgcctacccaacctggcagctccaccatgcccggcccccttgccctgccgtgactgccggtaccagtcctgcaccctcctgctgatcacacttcctctcactgtcctttctgcccctgcctgggccttggtctcctccgccctcctttattcatccacaaggctctggcaggctacactgtggactcccccaggcagagtctgcatccttaggagggccctcactttgtgccacctgccatgcagttgtgacttccgtggcaggtgtcaggtgtgtgggggagaaggctgcagtaggtggcatgggggacatcccctgctccccgggggtctgttcaagggaaccagaccgccctatacccaccaggggctgcaactggtctttcattgcccttgctttgactgacctcagcctgtcacctcatttctcccatagacgtttctgaggcagcctccctctgctctcacacacctccccgccagcagcctgatcaagcctctttcctccagcccagcttactcctctgaccaacaggcatcattctgtggcctgtgaggcagaattgaacaccagggaaggggtggggtggaggggaccaggccggatctgggagccagggaacctcactgcaggaccttggccttagtttcctcctctgtacaatgaggagatgggcatgtcagtctctgaagacctatctcttgtggagagattgttggggtttttcacctttgacaaaaccattatccaacaagttacatgtgatgcagaaaaattagcaaatgcattcctgttcctgctggcgctcctcaggccatgtccctcaccccagcctcctgtgctggtatacatcagcacacgtgtggatgtgcagcacacatacttgtctgctggaggcaaccaggacttctgtgcccgggagctccaaacccaaggtcgctctgatcaccttgaggccagccttgcccactgccgggtactggctgggaacaggtttccatttgtcccagaggaggtgacctgccttctctggcctgacctagctactacctttccttacctctgggctgctgatctggggctcacattccctggggctgggatccagtgtgtccaagccttccctaggttttgtttttgttttatttgtttttagtttttttcagacagagtgtcactttattgaccaggctggagtgcagtggcaagatctcggctcactgcaacctctacctcccgggttcaagtgattcttctgcctcagcctcccaggtaggtgggattacaggtgtccgccaccacacctggctaaattttgtattttagtagagaaggggtttcacttgttggccaggctggtcttgaactcctgacctcaggtgatctgctcacctcagcctcccaaagtattgagattacaggtatgagccaccatgcctggcccttccctgggttttggaaatggaggctggtccaagtggcgaggtcacgggggaagaccactggtcaagcatggggtacctgtctcttggagcccttacctccctgttttctctgtcttcatgtgtgtttgtgtgtgctgatctccacctctaccgtcttccgtccatctctacccttttctctctctttgtctcttcttcccaacatggcatactggaaaggacctgggctgcaacatcgggcaggcctggatttatccttccatcacttactggctgtgtgaccttttggaaagtcactttgcttctctgagctttagtttcttcatcagtaaaatcccttctggatccgcatagggataacgtgagctaatgtaattacagaggtaatctgcgacattgtcggcctcagaaaaggactgtccttcttgtaagtggaggagccaagattcatacctagacactgacccttagtctggtgctttgtgcttcataaagctgcctctgctgtaggctggagaagcagaatagagactaggagcccttaggcagctgggaaaggcctggctggcctcagctggctccaaggagcttgtccccatggaggctgtgtggggtcgagcccccggcaccccctggccctgcagagtggccatgagtctggggctgagccagcggccttcctctggggcctccgtggcccaggtcctatttgcatgggggctataaatagtcagcacaccttgcttttgtgctgctgcttcacccccatctccctgccatacactctgagaggtagggggcagactctgactctgctgtgcagagcagggacttgtggctcagagaggcccaggacctctctgagggtcacacagtgatggaagaagatgtggggctctgggtagtacaaacagggacagagttggtggcagaacctggccagagcccatgccctggttttagtcttaggaggttgggtctgacgctatggttactgctggttagtctcagggcagcccacgaagaccatggctccccagttctcatggcactgcagcctggcagtgcaggtttagggctggggcctgctgtgtttgtggttttccctccagtggcttctaaatgtgagcagcagctgctctgagtgtggcctgagagagctggagggccacccttgggtgggcaggtcctgggctctgcctcaccctcctggggcttctctgacccactgtctcctccaccctccatgcagtcctggggtggtccccacgcatacctcctgctgggcaggccgggggtaggggaagccatggagcctgtgggctgtcagggctgggccccaagggttggtggctgggaggaggacctggctggccggtgttggagcatctggtgctcctgagtgagttgtatgttcatggagacctggtttccctttctgagcagtgggatctgtaaccaggactgtcttcccaggctgctgggcaggcggaatggatgcggtgggggatgcgagtgcgctttgtaaactgcgaagggaggtgcacagtgagggatgggtgccgcagtgaggggggtgatagtggtaagaggaaccccctccccatggcctgttgggttgattgtagcccttatcctacgtgagttctcattatccccacaaccctgagccaagagactattgctcatcaggaaatgggggggctgaggctcagaaaggtcaagtgacctgcacagagtccacagccaaggcaacgttggtgtcaggatgcagcacccaggcggcctggccatcattttgccatatgtgctgccctgagcctctctcccctaggagcccaggccacctgcaacacacttgctcctcctttatccctgtgcccctgtcccctcaaccctcatcatcctccgaggcactcagaagttgcctactgccccatctgggtctccaggttttcctaacagcagagctgcatctgctgggattaggccctggatgtgtggacacagacctgccaatcattccagacccagggagcactcacctgggtgctggatctcttggaccctcagggacaagccaggcagcaaaaggggcaagatgtccatcttgcttacgggtttgggatgctcacccagattcctgcacatgtgcgaggccaggcccacgcagcttgcttttcactccagtatcaactgagtgcccaccatgtgccacccactcccatggctgtatataatcacattcctgtagacccgtgcaacctcacacacaccgattcatgcatgctgcagcctggggagcagccagcagcagcccccaactggccctctctccctggcccaccaagaggtcaagggcagctggcctggcacacaggccacctgctggtgtcaggctgaaggcttcgggacttgggctcaggcatgagcttgcacacccactctcacatccactgagtaggagccagggccgggcaaggaatgtggtggggtctgcccctgccctgcctgggtcctgctctctgctttggcagctgctggcctcagagggctgcctggactcactgggctgggctgcagggtgaggtcagcatttgctgtgagctcatctgagctgggagctcccagcagagctggccactgctctggccaccttgtgcaggagctggaggaagtcatctggggctgggcagctgttgtgtgtgcatgcacacgtgtgtgtctgagtgtgcccctgtgtgctggcttatgttcaggatggagtgaatacatgtgcatgtgcacaaaatcgaatgagcgctccctcaaccaaggctatggagcagccttgtggggcctgggcaggagccagtgtgcacataggtgcttgcacacctgtgtgtccttcacaagtggcaacctgaggagccccttggagtcacttactgtagtgaacattaacttagagaatggtgagaaacccaggagtgtgggaggctgctgtgtatgaatctgcaaggcacattcagcgttacattcaacattaaaatacagtttgggttttttttaatttttatttttctgaggcagagtctcgctctgttgcccaggctggagtgcaatggcgcagtctcagctcactgcaacctctgcctcccaggttccagccattcttctgccctcagcctcccaagtagctgggattataggcatgcgccaccacgcctggctagtttttgtatttttagtagagatggggtttcaccatgttggccaggctggtctcgaactcctgacctcaggtgactcgcctgccttggcctcccaaagtgctgagattacaggcatgagccaccgcgcctaggcagtttgggttctttttttaagagatagggtctcactctgccacccatgctggagtgcactgcgtggcactctgctgccttgaactcttggcctcaagcgatcctcttaccttggcctcctgaagtaccaagattatgggagtgagccaccatgcccacctgttttatatttggggaaataattagtttgaaggtgcaggcaaccttccaggcaagcgagaggcactcgaccccaaggggtcaatttagaagggtcaggcacactgatgtgggcagagcctctcactgccctgatccctgaacagagtgggtgccaagttagtggaatgtcagcttttggttctgattctctgccttagggtttcagtttccccatctgaaaagtggggggtgtttatcttggcactgcttgtctgcctgggtagttatgaagaaaaaaccccaaacttagaaaatcatgaagggctgcatggggcaggatgggagaaagaggcagtactgtcctgtccccttaccaggtgacaatggcacataccaggtgcctggcatggagcaggtacccagcaatagggtacttagggagtcactgagtgactccccaaatgaatatctaggggtgacagatgcaaatgccaccagggcccaggtaggaggagtgaagagagtgcccctggcctggggtagattgatggagggcagccatcccagtgctagctggctgttgcccagtgggcccaacatcacattttccagttttaccagagacgccgcaaatccagacttacataaacctctcaatatttttctttttctttttcttttttttttttttttgagacggagtttggctcttgtcacccaggctggagtgtactggtgcgatcttggctcactgcaacctccgcctcccgggttcaagtgattctcctgcctcagcctcccgagtagctggaattacaggcatgcaccaccacacccagctaatttttagtagagatggcttttcaccatgttggtcaggctggtctcaaactcctgacctcaggccatctgcctaccttggcctcccaaagtgctgggattacaggcgtcagccactgcgcctggcaaacctctcagtttttaacactggcaactgagactagtgtgtgtgtgcatcatgtgggccaaacccaatcatagcagagccctgggggagcgggtccctgagtgctgcccgtgactgttcccgctggtcccgcccggccgcctggcctcacccctctgtgtgcacagccccactgcaggccccaccatggcgccgttcctgcgcatcgccttcaactcctatgagctgggctccctgcaggccgaggacgaggcgaaccagcccttctgtgccgtgaagatgaaggaggcgctcagcacaggtaggcctggaggctggaccctggagaggggctgggaatctgggcccagctggaaggactggagggggcctggccttgttccctgcaacctctgaaggattctgctcttcctcatccttgactccctgccccactcagctatgaaggcagaggccactgagtcgctatagggctgcaaacactggccaaattgagccctccttggaaggcttggagtttctggttcctcctccctggttgttttacccagcaatttttacatgtccatttgtgccagggcctgtgcggggcactgaggatactgtcatgctccaggactaacctggccctgccctcatggggttcatagtcaggtggggaaaccaggcacgtcaaaaagcagtgagtcctgcaatagggaagcccagagaaggcaccctctgaacctgaggtcagggaggacttcctggaggaagcacatacctcacatcattccctcttgcttttgccctggcctggtgaacccctatttgtccctcaggtctcggctgaactgttccttcctctaggaaatcttccctgacccttaggcttgaccctgtagcactaccagccttgccctcttcagtctcatcacaactgtgacttaacagttacttgaggaaggagttggtgcattcgccacccgggcctggggatccaggaggacaggccctggatgtagcttttctttcagctgtgttctgcgcctcgaatattatggctggcatgcaggagctgtcagcccatgttccctgcatgaatgcataagggcaggcgacatttaaatggagctggagcaagaggatcagaggaagagggaacagcaggaacaaaggcctggagggaggacctagcagggtgcccaaggtagttctgtgctctagaggacactggggaaccacagcaggccctcaaggcaggagagtcgggcagattctgccaggggaaggccgtggaggtctacgagggagggacagaggggccatggcccaaccttctctgcctggccttgttgcagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctgggtaaggggcgcacgagccgtgccgtgtgtgtgtgtgtgtgtgtctgtgtgtgtgtgcatgcgtgcatgtgtgtgcgtgcacacacgcgggcttggtcagtgagcacagctgaagagcaccgggccctgtgctggccaccagtccagccctgtggccaacatgtcctgggtgtgaatcctggctctgcaattcaccagattcccagcctctctgagcttctgcttccgcatctgttaagggaaggcgctactaaatgtgcctacctcagggtcagttgttcaaatgaaaggagcagctggatgtacagggcttattgcagaacctgacacatagcaggtgctaaagacggccaacttccttattgtgactactttttcctttttaattttggaaaggcaggatatgcacatagtaaaacatttttaactgcatgaaagggtgtgtccctgccccaacaccaggccaccaggcctccttcccagaggcacccattatcccagttctttttggaatcttcgcatatattctaggccttggcagccattgagggggcaacatagtgatctttaacagcaaggaggtgggagaaggggaggctgacggtctcatctacttacctgctgaaatggagactctgcacaagcatgtggccacttggccatgtgcagctgtgtgttctgggtggccacaggatgccagtgctggcagaagtcccctggggttacatgtgggatgtaaccaagatgtctccaccaggaaaggccctgtgaccattggaggctctgatcagcctcctgcgaggggtgagggggctgggatgggagagaggttaacacagggctgtactgacccttggccagtcaggcagggacacagaggggcctctggctgtgctgtctccgctcccccaagggaggatatcagtcaccaggtctaggtcttgggggaggtgaggggatagaggctcaggtcccaccctcgagactgtccaatctgcatgaggagccctcggcacagagggaggagcagcgtgtgtgcacgaggatgagtgtgtctgtgtgtctgtctctctccgcatgtgcacacgggtaggggcctccattctaagatccttgctaagggagctgcagcgggtaggggtggggaatttcccttcccgctctattccccagctatgtgtctgggctgggtgtgggctggaccctttcacttccctaaatgtaataatacccctgggtacagggtgggggtggggctcaggagtggggctcaggcggggccctgcccacactgggcagacaagtgtctggctaggccttggggggctgccttggccttgggggaccagccatgggggtgggttctgagtttggcctggcccaggctgccctcactgaccttgttctcccctggcctctggcccccaacagctggacctgcagcctcaggccaaggtgttgatgtctgttcagtatttcctggaggacgtgggtaagaactccctgggggtggagggctcccttgccgggttcagaggcagagccagcactgaggtgtagggaagctgctcccttcggcagagctgtccaggaccaccctgggagggactgtaggggtgccaccccttccagataccagggctgacttccctactccatggtcaccagattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggtgagaaccggccatgcccactggtggtggtgcagggtagtgggggccgatcccggtccccgctcactcactttgcctgggttttgcctttcaggggcctcaacaagcaaggctacaaatgcaggcgtaagtgtctccacaggccagtttgtacgtatgtacccatgtgtgctcacgtgtgccagtgcctgtgtgtatgccagtgcctgtgtgcgctcagagagtgtatgcacgtgagttttcccagtgtagatacagcagctgagttcagtgagtgctggggctggcttgctgctgctctggaaaaccagttctgcgcatctcttcccagctccgcattcagtgacggggagttggtggatggcaattgggcacagtagagtattcacgcagaaaccagcccaggccatgcaccaggcctcttttcctcggagaggcaatgataggtcctttactggcacatagtggctgcatgtgcttctgtgtagatgtgggtgtctctgagtacacaggtgtgagcacactctgtccctgagggtgtatacacgaggcgccgcaggctggagtcagactgcctgggtttgaatcccagctctaccacttcctagctatagggccttaggcaaagttacttaacctctctgtgcctcagtttcctcatctataatttttttttttttgagactgagtctcattctgttgcccaagctagagtgcagttgtgcgatctcagctcactgtaacctccctctccaaggttcaagcgattctcttgccttagcctcctgagtagctgggattacaggcgtgcaccaccatgcccggctaatttttgtatttttagtagaataggggctttgtcatgttggccaggctggtctcaaactcctgacctcaagtgactcacccacctcagcctcccaaagtgctgggattataggcgtgagccatcgtgcctggccctcatctataaattagatataactataatgtataatagggtcattgtgaagatcaaatggaataagatatgtaaagctgtattttaagtgccttccactggtagccgctctgtgtaagaagtctgttatcattattacacatgctttgtgtgtatgtacaggtgtctgttttgaggcgtgtccatgtgcatgtgtaagagagggcatttaggagccgtttgctatcccagggcttggaagaactgcccccgcttctcatattgcgatgccctgtgcccgctaacttctgcccacctccctgcccactaggactccttctttctaagcccctgcagattggcctgtcctctccgccccgtcctctccaggctcctccttcgagggctggcaggaggaagactcaagcgctgggcctctgcggggtgagggtgtgggcggtcaggagaacggtggctttgtgtagagggctagactggtcggcaggcaccagctcatagactctgcccctcccggtgctttcccttccccctcctgggcctgtgcctcttcaagaatgtaacgctgccatccacaagaaatgcatcgacaagatcatcggcagatgcactggcaccgcggccaacagccgggacactatagtgagcctgggtccggggcagggctggggatctggggggcttggccagatgggagggatttgcaccctctccccaccctccctggggagcttaccctccctccccatttttcttagtctttccttgcctctcccagtggagctctcttgggatgttgttgtgcccagggttgggggagagctaggggttgaagaagaggctggagctggcacgtgaccctcagcctgtgatacccccacctccagttccagaaagaacgcttcaacatcgacatgccgcaccgcttcaaggttcacaactacatgagccccaccttctgtgaccactgcggcagcctgctctggggactggtgaagcagggattaaagtgtgaaggtgcgtgccaccccgcccctgggctgcaggaggggcactcccagctggtgctgctgtgaattccagccacctcacgccaccctcgcctcctcacctggagacgggcacctcattcagggacctgatgagggtgaggccttggtggaccctccccactggcctgactggctctgccacttacctgctgtgtgaccacaggtgggcggctccacccctctgagccatttggaggagaaaagcaggacctagagagtccctgtgaggggccagtgggcagagggtgctgaagccaggcctggtgcacaccgacaggcgcccagacaggcctcccctgccctctgcttcacttagagatgagacagaagaccctggagggaaagcggcttaagttgaccagatgttctttaaagggtttcgaattaggtccctgtcttctggtttttcctttttctttaaatcatgaaagattggctgggcgcggtggctcacgtctgtaatcccagcactttgggaggccgaggcgggcggatcatgaggttaggagatcgagaccatcctggctaacatggtgaaaccctgtctctactaaaaaaatacaaaaaaattagcctggcgtggtggcgggcgcctgtagtcccagctgctcgggaggctgaggcaggagaatggcgtgaacccaggaggcagagcttgcagtgagccgaaatcatgtcactgtactccagcctgggtgacagagtgagactccgtctcaacaacaacaacaacaacaacaacaacaacaacaaaaatcatgaaagattgaaatgcttggccgggcgtggtggctcacacctgtaatcccagcactttgggaggccgaggcaggtggatcacctgaggtggggagttcgagaccagcctggctaacatggaaaaaccccgtctctactaaaaatacaaaattagccggatatggtggcgcatgcctgtaatcccagctactcaggaggctgaggcaggagaatcccttgaacccaggaggcagaggttgcggtgagccgagattgcgccactgcactccagcctgggcaataagagggaaactccatctcaaaaaaaaaaaaaaaagagagagagagagagagatcgaagtatttatgatggcttcagatcaatgttttcctagaaactggaacccagcagaccccactgaagccctcctttctcttgctctcctgcgcctctcctacactgccccctgcccttggctgagctctgagactgacagccccgcttctccctcaccccagactgcggcatgaatgtgcaccataaatgccgggagaaggtggccaacctctgcggcatcaaccagaagcttttggctgaggccttgaaccaagtcacccaggtgggcaggtgccatggggaccctggacacagggcagtggggtcagggacagtcaaggcttacagccactgctggggagccacagacagccaggatatatttagacccaggactctacttcgggaagatgcaactcaagaatttaggcagcagagggaggggggctttttttcataagaaattcattattcaggcagttctttacttgagggtgaacctggggaccacaggagtgggtgttggaacactttgaactaagactttgggtgtggacgtttgtatgtggggggggcttgagggatgccacaaaacctaaaggtaaaattttagaatcaatcagaaatgaagctaaatagtcaaataaaatctatcgagtgagtggttgggaaggtagggttccgtttacaaaacttctgtttgtaatcagagcctttcagaccaccaaggcttctctgggctcctggaagagtgcgtgtgtgtacacgcagcccgagtagggggcctgggctgtgcccctgttgtctcctcttggtgttaagggtggagttatacctgggagtcttccttctgggctgggagttctgataatggtctgaccatctggccccccacctctgctccctccccagagagcctcccggagatcagactcagcctcctcagagcctgttgggatatatcagggtttcgagaagaagaccggagttgctggggaggacatgcaaggtgaagctgggtccattgccccattacggtttttattccccctgaggccaaagaaaggggactgtcctcccttccattgtcaagtgagacatggaaggaaccaccggtcctggggagcgagccccttcctctctgaggccccttcccccagcctaccccaggccccgggggaggggagttgtgtagactgagaccccgatctgaggaggtgccatctctcgggcagacaacagtgggacctacggcaagatctgggagggcagcagcaagtgcaacatcaacaacttcatcttccacaaggtcctgggcaaaggcagcttcgggaaggtgagggctgtgagccgggcacctgcttcccaccccaccctggcttcttcccgcttaggtggctgaggtgggagtctgtgaatcgggctgtggcccctgccccgtcctcacctgctcagcacccgtgtctccccatcaggtgctgcttggagagctgaagggcagaggagagtactttgccatcaaggccctcaagaaggatgtggtcctgatcgacgacgacgtggagtgcaccatggttgagaagcgggtgctgacacttgccgcagagaatccctttctcacccacctcatctgcaccttccagaccaaggtgcccgggcctcctgccgtcaccaccccatgccacagccatgtcccacagctcctcagcccccctcagtcagggctgtgtctccccttcaggccacttaaggcagggccatgctttcccccctcatgcctcccagggcagagtcgtccacctcagccagggcctgtccctgctgtttcctgttggggcttggccccagtggccctcagtgagggagcctcctgcctattcctcacccctgctcaccacccttcccaccccaggaccacctgttctttgtgatggagttcctcaacgggggggacctgatgtaccacatccaggacaaaggccgctttgaactctaccgtgccacgtacgtaagggccatggtggggaagggcccagtgtggaggaagggctactggctcagagcccacttccagtctgccctccatgccttcttccctctccctagaaaagccagcctgggctagagcggcaactggggagatgtgggggtagcctgggtcggcaccacacaggaagccatgggtggcaagtgaactgcggctgggtgcgcagcgcaaatactctgggtcctggccgctccgtgggccacagccagggcagccttgcaaatggtggtcctgcatgacacaggacacaggaccctggtgcgtggcccccagacctgcttctccccattcacatgccccttaccccaaactaaccgtgtatgtgtgtgtgtgtgtgtgcatgcatgcaaacacatatgtacatgcatgtaaatgcatacactcttagagaattggctcactgagagctttcccttcagaactttctgcctgggctgccagcccccacttgcctgatacaagatgtacttgatcatgctcaggtggtccatggagttatttgcagcatttcttgctcctggaagtggggttgagggcccgaggagaagcagaggctgctcggcagagatcccggaacactttatccctctctcttgcccaggttttatgccgctgagataatgtgtggactgcagtttctacacagcaagggcatcatttacaggtgcgggggtgagggcagcgggggctcttgggaggggaggctccagccccatcatatcttctgaaatgctccaagcaggatccccccaactccagttccttctctgctggaaatcaatctttagctgggtatttgcctatgcctcccaccctggtgttagcattcctgtggccaccatttgaggctggctcagcttcaggaactaggaactcactgctcatatttgacaccatcgccccacccatccttggagccgtcagtctcgctctgaagccccatcgagtcatctaagcttctgccagaagggactccttccataaagtctcatctaataagttatgattccatcctatggtgggaactgtacacccaccaaaaaggctgaggtcaggctctgtatactgatgtgggataatgccaagatatgttgttaagtggaaaaacaacctgtgggaaagtgtatatcgaatattagcattcagcctttaaaacgtgggagggagactgagcgcgatggctcacgcctgtaatcccagcactttgggaggccaaggtgggcagatcacccgaggtcaggagttcgagaccagcctgaccaacatggtgaaaccctgtctctactaaaaaatacaaaagttagctgggcatggtggtggatgcctgtaatctcagctactcaggaggctgaggcaggagaattgcttgaacccgggaggcggaggttgcagtgagctgagatcatgccactgcactccagcctgtgtgacagaatgagactgtgtctcaaaaaaaaaaaaaaaaaaaaaaaaaaaggtgggagcgagctgcatgctgccatatgcttgtccacgcctagaattgctctaaggagagcctcatgattgagctcagtggaaggtagactttgtactgtttgccatttctagttcccatatgcattaagtatatactcaaatgactaattactaaatatagacatggtctctgcctgtgggaagtagacaaacctgaacctgggggtcacttctgctgctgactgctaggggaccctgggcgagtgacatcacctgtttgagccccatttgggcttcaggaagtagggcagtgtatgcccagcgtttagcacacagtaggggacttgcaagaagcacctgtttttaggatctctttctccttctgcttccttttctgtttctcattcccttgtacccttggggacagtcctggactaatacggctgaaaattaggacatggggggcagggttggaaggagaagaaatgtcccctgctgactcttacctgtcccctgtccttagggacctcaaactggacaatgtgctgctggaccgggatggccacatcaagattgccgactttgggatgtgcaaagagaacatattcggggagagccgggccagcaccttctgcggcacccctgactatatcgcccctgaggtgagccgatacccttccagccccccgctcagtcaggcaccttgcctccccacggtgggccagggaaggattcccaagggcagtgatgtccaagccaaagcccataggctgaggcggcctggctaggcttcgtgcccaggggcccctctcagcctcagcacctcagctcctgctgacctgctgctctccccaccgccagatcctacagggcctgaagtacacattctctgtggactggtggtctttcggggtccttctgtacgagatgctcattggccagtcccccttccatggtgatgatgaggatgaactcttcgagtccatccgtgtggacacgccacattatccccgctggatcaccaaggagtccaaggacatcctggagaaggtggaggccctgggctgggctgggctggtctgggctgggctggggcaggggctggcagacactgggctttgggtgaggagcttcctgtctctggaatggcagcctcagtggtgctgcagtcctaacatacggggtattgctctctcaccatgttcccaggaactcctgtctgagtcctgtgcatagaatcagcctgacatggtgactaagggcccagggtcaggagacagacccgaggccaaatgctggctctgcctgggactagctggtcacttaacctctcagagtttgtctccttatctgtaaaatggggctatgagcagacttgactcacagagttgttgggaagaaaatagaaacatatgatgctcagctgtgggccaggcagatagtaaataataaaaagttccaccagcagagtcgcagatgtccagcccagagcctgtcatctccgggggagctgggagcactgcaggccagagtggcctccctcagccccaccgttccccaggctgactggggctggggcaagcctggctttgcatccctgggcctgctggggatttgctgaagctccaatttcccatggcccttgggtgctaaccagggtccctgctgggttgcagctctttgaaagggaaccaaccaagaggctgggagtgaccggaaacatcaaaatccaccccttcttcaagaccataaactggactctgctggaaaagcggaggttggagccacctttcaggcccaaagtggtatgtgatcctgccctgtgctgccttcaggctgagctactcctctcctgccctccctctctcctgcatcattcacacgctttccacctctcccttcttccagcaatctccatagcatgttcagtcacagccgctgcccttgtattctcatcctctccctcctgactcagtcattcagcacacactggggactgtggatcccactgtatgcagaggaccctgttttgggaaatagagttaagacctcactttatcgctccattcaatccattttccaatacatatggggaatcctgagtccctgttgaatgcagagcacagtgctgggctgcacagcaaagtgggagatgcagtcccagaaccggaggagctctcagctagttggagagataagaaacttgcacacctatgacaatttgtgatacgagatgacagtataagagatgccccaggacacatgatccgttgctattgagtgggtctgtcagcaggaacccaggtggcagagaagagggtgggtctgagaggccccgttggaagaagtgagacaagggacagctgggaggcattccaggtggaagaggggctggttcactcacaggcccagaatctacagggctaccaaggaaccagcctgagagcagaggcaggtggggccactaagaaatttggggctgtgtggcccctctgtgaccacagttcttccttcccactccccttctgtcctttgattcccctcctccaccagggcacacagttcccactgggcagcctgtgtaatgcgccccacatttgtgctttgaggctacagagcacttcccctacaccagggacctcaaactcagacgtgtcctggctgagcatgtaactgacaggctaggccagctgcaagaaaatcacacagcctgctttcagtctcacttttgatagatttccttctccgcactaagaaacacaaagcaggtgtgatgtaccccttgtcagtggggcaggggctgtccagggggctcttagcaccaagagtgggcaggaagtgggcccagggctgctttaatctgccagttttcaaaagaagctggaaatctggatttttaggttgcattgctcaattttaaaatataagttcaggccgggcacagtggcccacaccagcactttgggaggctgaggcaggcagatcacctgaggtcaggagttcgagaccagcctggccaacatggtgaaaccccgtctctactacaaaaaatacaaaaaaaattagccgggtacggtggtgcacacctgtaatcccagctactcaggaggctgaggcaggagaatcgcttgaacccaggaggtggaggttgcagtgagccgagatcgtgccactgcactccagcctgggcaagagagtgagactccatctctaaatgaataaataaataaaaataaataaataaaatataggttcaaattccattaaaacccagtacaagccgaaatgattgtacttgccagttcagtttggctgaagggccaccagcttgcggtctttctatattaccatcccatcatatcctcaggagcagagaatcagcaaatttctcctgtaaacagcctgatagtatatattttaggcttttcaggcttgatggtctcaaagcaggcatagacagtatgtcaacaaatgggcatggttgtgtattacaaaagctttatttatggaaagtgaaatttgaatttcacctaattttcatgtcatgaaatatttttcttttgattttttttccaaccatttaaaaatgtgaaagccattcttagcttgtggtccccacaaaaacaggtggtaagtgagcctccctgggctgtgattcggtggtctctgagcaagaggctaccacctctcctaacccaggcccagagctccctggtcactttcctcatcctcttggggaaatggcagcctccttcccatggggctcctttcaggctgctaggggaggctctgtcttctgttctgggtgaggacagctctggcctggcccagccctgcagggactccagcctggggtgtctggagggccattccctaggtcctgttcgctcacccctgccctctgcttgtagaagtcacccagagactacagtaactttgaccaggagttcctgaacgagaaggcgcgcctctcctacagcgacaagaacctcatcgactccatggaccagtctgcattcgctggcttctcctttgtgaaccccaaattcgagcacctcctggaagattgaggttcctggacagatcaggctagccctgccctccacccacacctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataataggctgtatatattgctcagtagagaaaaaccatgggggactggtgatatgttgatctttttcaaaaaaatatatatatgacaaaaaaaaaaaaaaaggagcacaagctgtttgaaccaccaggtttatttgtgtgtctaaataaacaccaaatagtacc

SEQ ID NO: 36193 - DNA, 190297 bp, Homo sapiens
ggcggcggcggcggcggcgggggccgcgggccgggccgccgctccgaggtgaaggcgcgcgcccctccccgcctgcctcccgggccgcagcgatgaattccgccgagcaaaccgttacgtggctcatcactctgggggtgctggagtcgcccaaaaaaaccatctcggacccggagggctttctgcaggcgtcgctgaaggatggggtggtcctctgcaggctgctggagcgcctgctccccgggaccatcgagaaagtaagtcccggcccgcgcccccgcccgcgccccccggtccggcccgctgcggcccgggatgcgcgcggagcacctgaggccggccgcgctcgggaaacccgtgcgccctcctttgtgcgcggagcggcggcgcggccggcgccaggaccgtggcgggagctcggggggcgccattgtgtgcggggcagggggagggggccggggagcggggtcggggggaggggcggcgcgggcggcgggggtccccgggaaggagagtgcaccgcagcgaggagacggggcttctgcgccgcccgaacgctaagttgcccctccgcgtggggggccggccccgctccctggcagcagccgcatcggaaaccgcgttccgacgcggtgcggctcactccgctggctttgtgtggacagttcttgccggtggcgttgcgtgagtttcgcctcccaggttaattgaccggttgctctgtatttttaaagaggcacgcatctgtagctgagggctgcgctgtgaaacgatctactactttcccctcgagaaaattccccacctatccgagccgagaggacggcagacacagggtctaagtcctggcactcttcaaggcttgttaaaattctagatttcgttctcaggtccctccctcgttctgaacagaacctttagtcctgcaggcactgcttctcccttccggctggtggttcccaggctggagcgtgtgaaccctgacccgaatctctggaagtgattaaagtttgttttcatcgcccacaagccggccagcagggccgaggaggcaggagagtttctaaaaacgatgtctccctgtagctcaaaatactaaaatcttattcccagggtgtttcttcggggggtggggtgggggtgggggtggccaatatatagcgttaagatcaacagttatttaaaaggtgttaaatatagaaattgaagtgtaccataattaggaagaaggatttcagtttttaagtggggtgtattggcccccatacaggatgacaacaacttgtaaataaaatgccacgtaagtgacttgaaaaagtaaaatgtttaatttttttcattcacatgtacatattctcttgctacattttaaatgaggtcagaaaacattttatttaatatgaatttggcttgcattccacttttagctatttttcttacttggaacatctttatgaaaacagaatctgcatattagagtgaatggctgcctgcctgtccatgaaataaaaatgttccttaaaaatgaacctgatgtcacagtgaaattatgatttaagacaggaggactgaggagcaggagctgactttcaaggcattcaaaatactttgctgtttggatactggtacctctggtaatgaaagacagatgttgaaaagtgttgaaatgcatgcaaagttcaccaaaataggcttaaataaaattctgttccatccctaagagcaaagctttaagaagtgtcatatgctgtattgataaaaacatgtcgccatcaaagaatatgttgtttggcatattaactgtattaatattgattggccgacttcaataatcattttcttttaaattatagaaagattttcctagaaaaccgtagcgttcatttcatctctaaaacaacaaagagaagaacgaataaaatgttgagcttgcagaagccaagttgaaacaactcaacatattctaaaactacagtcatctggaaatttcttaggtcagagctgtttttgattccccctgagctccagttggtttgtgttaaactgactctgtcacaatgaaagtttaatgtgaaggcagcgtattgtagacacagttactggttctctggagttcaaaggtaggtttttggagtaaaatattagccgttttctgcctctgagatccctgtgtttcagaagttttgtgagctttttccatttgctaggcagagttatctgggtttctttctttcttttctttttctctttctttctttctctctctctctctgtctctctctctctttctttctccttccttccttccttcgagatgggttcttgctatgttggccaggctggtcttgaactccgggcctcaagggattgtcccatctaggcctcccaaagtgctgggattacaggcgtgagccaccacgcccagccagttatctgggtttttggtgttttcatgcttaccagataatctatgccacaaagcacacatgctgaataacttttacttaaatgtgggaatgtgagtctgaggatgttttttccttaaaaagaagcatttggaaacttaactgaatgttcatgtggacatgacaggggcttcgcttgacctctgctgcaggagtgccctgacagccagtgagcggagggcaagtggcctgcagccttcgcctctgcaggctcacaacctggcatgggccatgaggctggggatgagggcagaactaaaacgtggctgggtgcctcgggcttcccatatgtcttttattaagaaaccatgccctaatgtgtttcttccattacgctcatttgttctgtttcagagttaggaagagggtggagggagcagagaggacgttcacggcgtgtcagattcttctgctcatttaaaggaaactttccacccaggttcccgctttgcttttaaggtggaaggttagacagtgagaagatggaattataaactttacatgaacagttcagaaaagagacacttttcattatactggacagatgttttctgctgtaggggagaggaaaatgggattaaaaagttttcgccttctctgtatctggagatcctgcactttggttttctccaggaggggtcaggatgtttggctgggctgcccatgtcttcggcttcccacactcctcccgtgagcagaggtcatgacgtctagggagccctggaagcccttttctcacaaattcactttaaacatccctagggtatttagtcaaaggaggtgaaatcaagatacatgaattgtagaggatggaaaatttctataagactaatacaacacattaaaatcatggaaatcatgaaatgctcttttaatttcacttgtgaatgcaacaaatgaagtctcttaactcactataaaaaactcaaggaacttggttctttctctgtgtgtcccaggagaacagaacacagagaaccttcctgtgtaatccatgtgatgtgctcccgagaaccctggctaggtgtttgtggaatgtaattgaaaatcagacgctgcctcgggtcttagtgctggatgtggaggcatttgtctctcagctctggaggcccaaagtctgggattaaggtacctgcagggcctcgtgccctcagaaggctccaaggaggggtctgtcccaggccactctcaggcttctggtagttcctggcttgtggcaacacaagtccaatcttcacatgatgtccgtgctgtggtttcttctctgtgtccaaattcctcctttttagcaggacatcagtggaattgcattaggggcaccctaccccagtatggcctcatcttaaccgattacatctgcattaacttcatttctgaataaggccccatcctgagatactgggggttaggacttcaaaatacgaatgctggaggagcacagttcagctcatgacaggttgtttctacatttgaaccagatcagtttattagctattgatctgattgcacaatgccaggtgctaggggagattgcaaaacctaaataatagagtcttgggggttccagtacagaaaatgtaactcgaaagacaagaacagcatgaggcagaaggaagtcaagagtcgtaatgtcagatatggatgagaaggagcaaaagaatcaaggagctaaaaagaccagcatttgagcaggtcagacccaagactttgctgacgtgtgggtaagaatatggtttgcatttcccaaactgtaacctggcagccctaggtgattttccacaggcttgcagaaaatcagcaaatctgatgttgcataggaaaaaaggaaatacttttttctaggtaaactggagactcactttctgctcagtgtcaggattctggggttggttaggggctggggtgaggagaagcagaagtgctcacctgctagaaatgtgccttttcttaggtcctttggccctaaaaagaacgtgatgagtgatcacatgtggtggtagggtaaggttctcactcaggcccgtgacctgtagccgtcataaagacttgttgattggctaagtcacttatagagaagttataatatggtatctccagactgtgtttttaaggagacttctttaaaccctgcaaactgaataactggttatatcaagttgcttctaactaaactaccctgaatatggttccagaatagtgaattttgcaataataaacatttccttttgaagcatgtgactttatagtcctgtctcaaccctgaaccagtgtgattcttgtttgggtttcaggcctagggaagaaggtagctggaactgcatttgctggctcactaaaaagaaagcaaacaaactgaaattcaatttaaatcaggagtgcctgaagagatttcctgagaaccagactagaaactagtgtttatgttggcatcacacagacacaggagagcacacacacaagcatacacacacgcatacatgcacacttgcacatgcatgtgcacacacgaacttatgcacacacgcatgcatgcctgcacaaacatgcacatacgtaaacacatgcatgtaaatacacacacacacagacacatgcgtgtacatagacacgcacacacgcacacacagacacgtctgacgggggttgagggagtgggggaaggagtgctggcacatgtggcattccattttctcaggggcagctgctctgtgaactctccaagcccagtccaaaggatgccatctcaggacccggccctcattctattaatagaagtcactccagaatctgcctgctcgcctcctttctttaggcactgcctgcctttctatacatcttaaaagagaataagatgtctgcccagcatggcaggcagcatgctcctctcgtttgcaggcgctgtccctcgcaatacccatactgcagatgaggaccctgaggtctggcagttagctttgccccaggtcatctggctgcactcggaggcggaagattccagctcaagactgtgagctttctcatggaaaacaagactgattctgccacctatactgaacttaggggaagattcgcaaccactgccttcagaaatttacaaaccagatcaggaaaggagacggaggcagcagtgtaactgagcacccaggggggacaaaagtgaggactggaggggctggctcaggtcaccggccacaggggcagagtgggagccctcaggagtgcctggagccactgcaggtgtctcacttctcgggacatctggaagcagctctgcccttcagtagacagaccccaaaggcacccagggtagggccccttgccctgggggaacctgcagaagctcctgcagaagtctgtgtctgggcctttctccccggccgcagaacgtgtgttccgtgttcctgtaccatccaataactcactgtagtttctgggcttccctactctgtagggcttaccagatttccacttagtccaagatttcaaactgtgtgcatctacaccacacacacttttaaaattcaagtactatgtacacacgaacatctctctccctttagaggccactgatcactctaaaatgtaaagagtggaggcgatgggggctgtgaggtgagtgggggcagagccgtttgttcttgtgtagggtggattttagccgtttggattggagtcttgtgtaggcttgacgcccacgcgtctctcactgcacgagggaggtggcagaggcacatcatccctttgggcacgcaactctaccacgtgcatcgctgggagatgggaggactggcatcccccgaacccacgggtccctgcctggagacactgggagacccggtcctctgcgtgcttcagagtcaggcacacctggctttgttcccgcagccatttgctctgtgacttccggcacctgtctaacctctcggagtcctagtttcttcctcctaaaaatgagatgaatgatatccactggtgggggcagtgaggtcattaccagggtaaatgagtagatgtgctgggcacaaagtcattcctcagtacgcagtagttactgttttgttgattgacactgaaaaccttccccatcgtgtccagaagactgtaagccaagatttgaacctcagagccatccaaatccaggaacacgggttaattctcacaacagggcagactcttgcaactttcgggggctggcagcctctgcatcccactctggacagaccaccattgtctgggttggtgggcctgctgaacgtggcttccagggccctctggtcagcgccagatctgggcgcagctgctgagtgcacacagctgctggttggggagcgggagggctgagcgggtggactcaggtttcgcttatataaagtttcatgcatcagcagggccgggagtcagagatgggaagtgagggccagcctgccccacctggtgtctgcagagagagggctttggggccgccccggtccgactgcttcccgggtacagcttctgacttctccctcctttatcagttctgtcaagttagggtaggagaattaatctcttgatgtttttatatttctaactttagctttgaatttttaaggtttgatgcaccaggctggcagttctcaactctgtttttgcaggatggtgtcatgtctgctggggtctcaaggcgaggcggtgaggggaactgaaatggaatgtgtgcacagtgtatttcaaacacatgtatgtgaattcatttaatcatcccttttaccaggttcctattgtgtgcgtgctagtgacccaatcacacgcatggaagcgcacgcatggatgccagccataccacctcttcaggcaggtcagaagagaaatgctaggatcttgggtataaagtatttgtgagttctcaggatgaaggaatgtagagtcatccagcccagacgcctccttttgcagatggcttcactgagggcacctgcatgtggttgtgtaagctgtgtactgcccggtcttgggagaaccgttcacactgtagtctaagcaaatggctccaaggcctgtgctgggaggcggccctgggatactgtgtatagaggtcagcctcccaggacacaaagcagagtggagaagggttggggtagacgatagaagtggccccaattctccaaccctcccatgcccctggcaaagtgaccttgtagcgcctccatcaagaggtaggagtctgcttcctcacttcttgaatctgagctgtgacttgttttggccaatggactgtggcagaagtggccagtgttagttcctagcccaggccttggaaaggcttgcacttttctgcactctctcaggccctgtgtctacctccgaggagaccccagggcttgggtgctggtggggtgtgatcacatggaggagaactcagttgtccctgctaggccatcctggacctatccacagccagccaacctcaaacattgaagagagcccagccagggtcagcaagctgcctgccctgcccagagcaggcacagctgcaccagcaggcccggaccaggctgactcaagccagccactgaggtttaccatggccatagataacaaatcacacacacacacatacatgcccgtgccattcttaactaggggacatgccgatatatgtaaatacagtccatcccaatcacaagagtgcttgtacctttgtttaaaataccctctatatcctttatttccttgataatttcctctctagtattttctctattctcattttttagaaatcttattaagactaatcagagataatatctattgagtgcatactgtatgccaggcactgttctaaggactttgcccataataatggatttaaccctcctcaccaccctataagggaggtggtgacaggatcgcccccattttcagattaggaaacggagctccagagcggctggtaactggccatcgttggctggtgggctgcgccccccccccccggccccgccccctgcccctgcggctgccaggcctgctgggttgagtctctcatttgctgacctttccacttgtatgtttcttctccttctgaaagacatttccttgactttatctcccaacttttctactaacattttttattttgacctactttggctattttttttttaatttctaaaagttcttttttctcgttatctggtttctctctgtttcttccctttcagtcagtcccttcctgtttctgggaagattcctctcttcctgtgaacattcattacagtttccttgaagggtgcttccttccctgcattcactgtctctgtttcctctgagtcctcttatgcaattctttttttccatgttggagatttactgaaacatcatgtgatctttcaagtgtgaggccctcaaaatgaccaggaagtcctgtgtgactgctggggcccagggacatgcaggtctcgccatggggcagcctggtgatgcccagaagtctgaacctgttggtctcttctccagcagccgtgagtctctccagagactcctccatctgctgcctatcagagcagtgtccatcctcaccttggctcctgtccatgctggccctctccatgttctggcctctttggttcacttttccccagagaataagcctcggacccctgcaaggatggcaagaggggtggccagctgtgatggggctggggcccctaggcctgcatctgactctcagacaggtggcttgtctaccacctgggagggtgcacttgccactggctactgggatgggaccttctagtctctgctgaagccccacccatcctccgtctgctccctgccttcataatggtggcctggggataggtgtcttctagttttttttgttttgttttgttttttagacagaatctcactctgtcacccaagctggagtccaatggcacgatctcggctcactccaacggccgcctcccgggttcaagtgattctcttgcccccgcctctcgagtagctgaggctacaggtgtgcgccaccatgcccggctaatttttgtatttttagtagagacagggtttcaccatgttggccaggctggtctcaaactcctaacctcacgtgatctgcctacctcggcctcccaaagtgctgggattacaggtgtgagccagtgcgcccaaccaggtgtcttctagttttattgaagatgatgcttgtgtttcttgttctcctggctgttttggagggattttttttcaagagaagtgaggctgaaataattttactgtactgctttggacctggaatctttccatgatgagaaaaagagagagagtgagaatatatgaatgaatatccatgtcctatgccctgggtttcatatctcttcttctgagtactttaaaattactagagaaaacaaaactggaagctggttatttgaaatgttcttttttttcttgttgcttggtattttgtgcataactttattattacacttggagcagctttttttttttttaggggctggtgatcatcctatcttttctctatagaagctatatataattcagaatcccaaaaagtgtatataaaagaaacgtaagcctcgtccagtttatattaaattgcctttgtctaaaatgggcatccacagctccaagtgtgtttggatttgcgtgttctctcgccatgaagccttgttctgacagtgtgatctattagcaacgcctttaaagtggcctggttttgattatttgtaaatattatggccagtgatggcttttctccctcaattctgagtgtctcactactaatttcctgtgccagaatactttttcaccaatgtcctgtccttaaagtagcttaagttcataagggacttttaagtacccatttgtagttagcagatttttcagatgtcttttgttaggaatacagattttctgaaaaagccttttgctttctgaacacatgccaaaagattgtggctttgtcattcactttaaggaagaatgctacagtgattttgataggaaattgggagattcagaggatattcctggttctgattgtgtctgtttggctcctcaggaagagggagagcctcacctgcccatgtggaatcagtccaggcctctgtttaccttgagcaatgtcattggggcttcctctgtggtgcttaggaaagtgccttaagacctgggtttgtctcactgatctcataaagcactggtgctggtgacagatgtcttctggtggaaacacattttctggttataatcatccctatttgttaaggatttttgtttcttttgaaaataggctttaaggctgggcgcggtggctcacgcctataatcctagcactttgggaggccgaggtaggcggatcacctgaggtcaggagctcaagaccagcctggccaacatggtaaaaccctgtctcttctaaaatacaaaaattagctgggcatgatggcgggtgcctgtaatcccagctacttgggaggctgagacgggagaatcacctgaatccgagagacagtggttgcagtgagccgagatcgtgccactgcactccagcctgggcagctgagcgagactccatctcaaaaaaaaaaaaaaagcctttaacaaaatagaatatggccaaattcttgtgacttgtgacaaaggttaaacttccagaaagtgccctagaagccataattttccatgataagagactagaatggaatgtctttcagactttatcaattgatgacaaatggagaaaaataaaagttcatttatggcacttctgaccaagctcatttccctagattgaatctgagtaattgcaatgtcagctatctagggttggctcttcaaacaaataacctggagtcataagcacactgtttatgaattcctcaaatgaaattctgggagtgagacaccactcaccctgcacatagtcaaatcttttgttgcctgtaatggagcttccaccttaagaaactagaaaaataagggcaaattaaactcaaattaagtagtaggagaaagagaataataaagaacagaatggagattagaaaattactagcgagaacaaacaaaactgaaaggtggttatttgagaagaatcaataacattgataaacctgtttgtggactgattaggaaaaacggggaaaagacagaaattaccaacgtaaggaatcaccacagatcttacagatatcgaaagataataagtggatatgaaaacattgttatgccaacaatttctacaacttagatgaaatggataactttcttggaagacacgaagctcactaaagaagaaattgataactttaataaccctacatctattacagaaataaatttgtagataaaattcttctcataaagaaaattccaggccagatagtttcactggtaaattctaccaagcttttaagaaaaaaataactgtaattttacacaagctcttctaggaaataaaaattgggccaggtgcagtggctcacatctgtaatcccagcattttaggagggaggattgcttgaggccaggagtttgagaccagcctgagcaacatagtgagaccctccccccatcactacaaaaaattttaaaaattagctggatgtgcctctggtcccagctacttaggaggctgaggtgggaggatcacctgagcctgggaggttgaggctgcagcgagccgtgatcacaccactgcacttcagcctgggtgccagagtgagactctgtttcagaaaaaaaaaaaaaaaaaaaaaaaaagaaggaaggaaggaagaaagattaatagtgaggttgtacttcccaaaccattctaagtggtaagcattatcctggtaacaaaacctgacaaaaatattataagaaaagactataggccaataacccctatgaacatagatgtaaaccttcaaaaaatttagcaaatcaatttcagcattacatgtaaaagataagatatcataaccaagaagcatttatctcaggaaataaaaatcaatcaatacaattcatgatattaacaaactaaaagagaaaaatccagaggattatctcaatggatggcagaaaaagcattcaatgcaatccaatccaacgtaaactcttggtaaacactcccagtgatctaggaatagaaggaaacttcctcaacatgctaaggggcatccatgaaaacctacagcctatgtgagactcaatggtgaaagactaaaagctttccccctaagatcaggaacaagacaggggtgttcactcttaccacttctgttcaaccttacactggaggtctcacccagtacaatcaagcaagaaaaagaaaccaaagccatctagattgaaaaggaagaagtaaagctgtctttatgtgtagactatatgattgtgtaggaaattgtataggatctacaaaatagctactagaactagtaagtcagctggatgtggtggctcacacctgtaatcccagctactcaggaggctgaggcaggagaatcgcctgaacctgggagttggaggttgcagtgagccaagattgtgccactgcactccagcctgggtgacagagcgagaccctgtctcaaacaagcaaacaaacaaacaaacaaacaaacaaaaaaccagtaagtcagtttagcaaggttgaagggttaatatacaaaatcagttgtatttctatatattagcaacaaatgatcagaaattgaaacttaaaataccatttacaatagcaaagaaatgaaagaaaagacaaatgcttaggaataaatctgacaaaagataagaaaaacatgtacactctcagcaacatatattgctgagtgaaatgaaagatctaagtaaatggggctatacataacattctgggtcagaagtcttgcttttaagctgttctattcatattgatctatagattcaacagagtcacaaccaaaatcccagaattttttcagtagaaattgataaatgattctaaagtgtctatggaaaggcaaagggcctagaaacaactttgaaatggaagaagagagttggaggacttggtttccagggttttcataaaacaacagtaatggagtcagcacaacgttgcaataaagatagagaaatagatcaacagaacagaatagaggtagaattagatccttaaagacatagacaactgattttcaacaaaggtgccaagacacttggctgtccaaaggacactcttttcagtaaatgatactggaacaagtagatacccatatttttaaagatgaactttgatctatacctcttagtatacaaaaattaactaaaaatgaatcatagatctaaatgtaaagcctaaaactaaaaaactcctagaagaaaatataagagaaaacatttgtgactttggactaggcaaatattttttatatatgacaccaaaaacatgatccatagaagaaagaattccataaaagaaagagtggacaaattggacttaatcaaaacaaaaagaacttctattatttaaaagacgctgttaagagaatgaaaagacagtctatatattggaagaaaatatttgcaaatcacatgtctgtttaaggatttgtggctagaatatgtaaagaactctcaaaacttaataaagagcctaattttaaaaatgggcaaatggtttgaatagacatttcaccacaaaatatgtacagatggcaaataagcactcaaaaagaagctcaacattatcagtcattagggaagtggaaatgaaacctgcaaggagatagataccactacacacgtatcatcacggctgaaatctaacagagtgatcctcccaagtgttagcgtgtatgtgagggaaccagcactctcatgcactgacagtgggaaggtaaaattgtacaactgcttcggaaaacagttgatccgtttcttaaaggagtaaacatacatctaccaaatgtttcagctattctactttgagatgtctgcccaagaaaatggaaacgatacggccataccacgccttgcacacaagtgttcataacagctgtatttttaatagccacaaactggaaataatgcagatgttttacagttggtgaatagataaacagattgtggtatattcctgtaatggaacacggctcagcaataagaaggaatattccatgacatggatgattctcaaaattatgctgaataaaagaagccagacaagaaagtacttaatgtatgattccatttatagaagatttctagtgacagaaagtaaatcagtgctcgcttggggacaatagctggggtaggagaaagtgattgtggagtagctcaaggagacctctgcgtgaggggcagagtcattaccttgcctcttgtgacagttccatcaggttgcactatgtcaaaacttatcaaagtgcacagtttacatatgagcagtttattgcatgtcagtgatacctcaatacggcatatgacagtctttaccctgagcataattacgtttttgttgagtgtaatggagctttaactcatgttatttgctgtcccctacttttgaacctaatcgtgaatttagaaaatgtatagaattttaatgtgcaatggtaaattgtgtacttatgttttattaggggaagtgatttattgacagttcatttattgatttatttgtttattttctcatcaaatctttactatgttccaaggatagtgctaggaactggagatttcgcagaaatagactcgcatactatttagtgggggagaataacgtgaaaagaattacacgaactgattgtatcacacatgagctatgtgcgctgaaggcaagagacagatttccaaacacgcagcagaagaaactatgccccttggcagatggggccccagtggcggtttggggaaggctgtcctcaagaagtggcatttgagttgccctctgactgatgcatagctgtcgtaagaggaggggcatgcacccctacacagaggggcccttcaaggcctggggcaagaggaggcctgctttgctgggagtggcgaggaaaggcctggatgggtagtgctggaaccgaggggacgcggagagacaggcagagccaggcagcacagggctggtgggcccttagtttgcaaaggttttgatacttttcaaatttttaagggaagaatgatatgatcagttctgtgctttgaaaacaatactctagccatagcgtggagaacagatgaaatgagcccaggatggaggatgtgaagatggttatgaaactcccacggttgcccatggagagctgtgggagcctgggctggagtggaggcagtgctgacaaggagatggggatggcaccaagggagcccaggagggtgcggcggcgggcagacagggggacagtgatttgggtgactcctgggtttctggttgcacaacaggatagatggggcggtcgcctgtgctggagccctgggcgaggcttacctaggtttggggcaaggagatcaggaatggattcagggttgggtgtgtcgttggaggcatccgcatagagctgttggagcttagaggccccctggactgaagcatacacgtgggactcgtagtacagagatatgtactgaagctgaaggacttgtgaggtttcttacagggcagttaaagtgcgaacgtgagaaggccaagggccagccttgggaagggtggagatgaataaccaggtggtgctgatgagcctgaagagagaaactaaggcagggtggtcagaggccattaggagacgggcagtgacctgaggtcaggggacgagagtgctggtgtgtttctgagaggtcaggtgagtgcaattcagaagattgtctgctggcttgggcctgtgctgggtgggaaggagggtgctattcctagctgttctaggacaactggccagcacacacccagagcccacatactggagcaatgcaggcatgcccaggactgaagagggggctgggagggagcctggcagtcgcagaggggagtggaaatgttggaatagagttgtggagtatgagagaggggtggactcagtgagggggtggaccgtgagccctgtggaaacccacccatggaggggtgcatgcacctgtagcaattggcagggaactgagcgggagattagggcactcattaactgtcttgaatgtttggttaagaggaagtgatcttcagtgagggtcagcgtgtttttcttgataaaggaggctctagcaaactgtatccctttcaaccgctttaggggagaatgtctgatattttttctttcctttcccacattttaaagtgtgttcttttccttcctgatggatgcatctggtggtttaaggccaataagtgttgcgttgagcctgaacagttgtttgttactctcaaaatgtctaagactttcatctccagcttatacatgtattgatgtcaggtgtttaatatttcccctttgattcatttgatagtgaatggcttctgaggtcaggatggggacactgccaaaactagctgctctctgctgagtctctgttttgcaggtgacatttgatagtctagatttgatatcattaaggtattttagggaagtcaatgtataagttttagaaagttcaggtgcatgttgaggactattgttgtgagaatgttatgaatacacttgtgtctctcctgggattgactttttctttccctttagaaaacgctcacagtgtattacatatcatgctaaatggatggagatgaagcaaatccaggggtgctcattgggaatatagttcctaaataactgcagtaaatgtaagtcatgtcctggggaattatttttctaactcaaagcatgaaaacatgaacaattcagttctgtctccatgtgtgggagaagtaaactcaccacttacttttttctttttaatccttttttttttagaggaaggtgggtagagagtgttattgggagtaggggtagggatattgagggaagggagaatgatatacacacacacatacatgtacacacataagtacacacacatctatgcatatacacacatgcatctgtacacacatgtatatatacacgtatatgcatacatatttatatatacacatgcacagatatacacatgcatatacacatatgtatgcacacatatacacatgtatatacacatgcatatatacacatatacatacatgctatctacacatttatacacgtgcatatgtacacatgtgcacgtgtatatatgtgtatatatgtgcacgtgtatgtatgtgtatatatgcgtgtatatgtgtatatatgtgtgcattatataatgcacacatatgcgcatatatacatacagtatatacacacctctatatgcacgtatctataaacacatatgcctatacacatggatatgcacatatgcagacatacacatgcacacacataaacatacttgaacacgtgcatatctatacacatgttgatacacgcatgtatatgtatgcacatatatacatacgtttcagcttatgggcggaaaatatctgggttggtttggttttcctccttttatagtcagaaatggcagagctgctcaacacgaacttttgtccatcacatacagaaatgtcagtgatgtcactgacatcagaattggcagtacatgtttttccaagttgtcttcaagtaagatggttcttccatcttttttttcttttgtctaggtggttatatggtttgtaaatttgggtgtatgtgagactgcccaaggacctgtggaaattgagtgctggacaccacccccagagttcctgatttcgtaggactgggatggggcagagaatctgcttttctttatatatatatatatatatatatatatatatatatatatatatatatatatttattatactttaagttctaggtacatgtgcacagtgtgcaggtttgttacatatgtatacatgtgccatgttggtgtgctgcacccattaactcctcatttacattaggtatatctcctaatgctatccctccctcctccccccaccccacaacaggccccggtgtgtgatattacccttcctgtgtccaagtgttctcattgttcagtgagtgagaacatgcggtgtttggttttttgtccttgcgatagtttgctgagaatgatggtttccagcttcatccatgtccctacaaaggacatgaactcatccttttttatggctgcatagtattccatggtgtatatgtgccacattttcttaatccagtctatcattgttggatatttgggttggttccaagtctttgctattgtgagtagtgccgcagtaaacatacgtgtgcatgtgtctttatagcagcatgatttatattcctttgggtatatacccagtaatgggatggctgggtcaaatagtatttctagttctagatccctgaggaattgccacactgtcttccacactggttgaactggtttacagtcccaccaacagtgtaaaagtgttcctatttctccacatcctctccagcacctgttgtttcctgactttttaatgattgccattctaattagtgtgagatagtatctcattgtggttttgatttgcatttctctgatggccagtgatgatgagcattttttcatgtgtctgttggctgcataaatgtcttcttttgagaagtgtctgttcatatccttcacccactttttgatggggttgtttgtttttttcttgtaaatttgtttgagttctttgtagattctggatattagccctttgtcagatgagtagattgcaaaaattttcttccattctgtaggttgcctgttcactctgatggtagtttcttttgctgtgcagaagctctttagtttaattagatcccatttgtcaattttggcttttgttgccattgcttttggtgttttagtcatgaagtccttgcccatgcctatgtcctgaatggtattgcctaggttttcttctagggtttttatggttttaggtctaacatttaagcctttaatccatcttgaattaatttttgtgtaaggtgtaaattttgtataaggatccagtttcagctttccacatatggctagccagttttcccagcaccatttgttaaatagggaatcctttccccatttcttgtttttgtcaggtttgtcaaagatcagatagttgtagatgtgtggtattatttctgagggctctgttctgttccattggtctgaatctctgttttggtaccagtaccatgctgttttggttactgtagccttgtagtatagtttgaagtcaggtagcgtgatgcctccagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcacaatattgattcttcctacccatgagcatggaatgttcctccatttgtttgtgtcctcttttatttcgttgagcagtggtttgtagttctccttgaagaggtccttcacatcccttgtaagttggaaggtattttgttctctttgaagcaattgtgaatgggagttcactcattatttggctctctgtttgtctgttattggtgaataagaatgcttgtgatttttgcacatcgattttgtatcctgagactttgctgaagttgcttatcagcttaaggagattttgggctgagacaatggggttttctaaatatacaatcatgtcatctgcaaacagggacaatttgacttcctcttttcctaattgaataccctttatttctttctccttcctgattgccctggctagaacttccaacactgtgttgaataggagtggtgagagagggcatccctgtcttgtgccagttttccaagggaatgcttccagtttttgcccattcagtatgatattggctgtgggtttgtcataaatagctcttattattttgagatacgtcccatcaatacctaatttattgagagtttttagcatgaagggctgttgaattttgttgaaggccttttctgcatctattgaaataatcatgtggtttttgtctttggttctgtttatatgctggattacgtttattgattttcgtatgttgaaccagccttgcatcccagggatgaagcccacttgatcatggtggataagctttttgatgtgctcctggattcggtttgccagtattttattgaggatttttgcatcaatgttcatcagggatattggtctaaaattctacagaactctccaccccaaatcaacagaatatacattcttctcagcaccacatcacacctattccaaaattgaccacatagttggaagtaaagcactcttcagcaaatgtaaaagaacagaaattataacaaactgtctctcagaccacagtgcaatcaaattagaactcaggattaagaaactcactcaaaactgctcaactacatggaaactgaacaacctgctcctgaatgactactgggtacataacaaaatgaaggcagaaataaagatgttctttgaaaccaatgagaacaaagacacaacataccagaatctctgggacacatttaaaggagtgtgtagagggaaatttatagcactaaatgcccacaagagaaagcaggaaagatctaaaactgacaccctaacatcacaattaaaaggactagagaagcaagagcaaacacattcaaaagctagcagaaggcaagaaataactaagatcagagcagagctgaaggagatagagacacaaaaaacccttcaaaaaatcaatgaatccaggagctggttttttgaaaagatcaacaaaattgatggaccgctagcaagactaataaagaagaaaagagagaagaatcaagtggacgcaataaaaaatgataaaggggatatcatcaccgatcccacagaaatgcaaactaccatcagagaatactataaatacctctacgcaaataaactagaaaatctagaagaaatggataaattcctcaacacatacaccctccaaagactaaaccaggaaggaattgaatctcttaatagaccaataacaggctctgaaattgaggcaataattaatagcttaccaaccaaaaaaagtccaggaccagacggattcacagccaaattctaccagaggtacaaggaggagctggtaccattccttctgaaactattccaatcaatggaaaagagagaatcctccctaactcattgtatgaggagaatctgcttttctaacaagttctcaggcagtgctggtgctgctggtcctggggccatgattgagaatcactgacctagcccactgagctcattagcccagcagcaccatgacctggaccagccagatggtgtgcatgacccttgaagcagacaggaggccacggtgtcctcacctgggcgtcttttccgtgcgtggcacaggctgctcactcaccttggtgtgccctccccatcctcatgcttaacaagtttcctaactagtaccttcttagttcaagacagagcagaccccgagtgctgcttcctcatgggcttttggagtatttaagcatggaggcagagagacagaaaggacatcctgcttgggttggaaggggactcggaaatttatctgaaaaattggaatcccatttgtttctgtgcataattttttaaaataaaaaagaatatgtttttttttcatacaacagaagagaaacaatctccattaagaggccaagctcaggaggtttgtacaagatttgatgaaatatgttacttaaattgaggcatgtatggagacatcagtgaaatattcaaattagggttgggaagaactatagctaaataagatattgagtcacaaaaaatgaacagaagatgaagtcacactgttttaggtaaagatgctttttaatgctgaggcttttaaagaagagtaaatcaaccatgttgcctggttgtgggaactaagggcagcctcagggaagagtctgggttgccagttcaaaaacacagctggggccaggcacggtggctcacgcctgtaatcccagcactttgagaggctgaggcaggaagatcacttgaggtcaggagttcgagaccagcctgaccaacatggagaaaccccatctctactaaaaatacaaaattagcctggtgtggtagcacatgcctgtaatcccagctactcggggggctaaggctggagaatcgcttgaactcgggaggcagaggttgcagtaagccaagatctcactatagcactccagccttggcaacaagagcgaaactctgtctcaaaaaaaacaaaaaaaaattagccgggtgtggtggctcatgcctgtaatcccagctacttgggaggctgaggtgggaggatcacttgaacccaggaggtggaggttgcagtgagccgagatcacaccactgccctccagcctggatgacagagcgagattgcatctcaaaaacaaaaaccaaaaaacacagctgggcgaacggctgctcatcaaggaagcagttcatgttgtggagttcagctgagccgtagcctctttctaactcgaaggggtggtgggttttgccatccttaaattgaggatgcccttgttttctgaaggtctgaagcagcctgcaccgctcgcaccgtcctttcggcaaaaccaaagacacattgctcaatttcagtccagcgtatgctttgcaattcagtggccaattgagggtccatttgtaaaaactgaatgtggagaaaatgatgacaattttgacaacaccccaccccaagtctggccataggagaaaacactgcatcatgtagagaaagagctgggtctggagaaccggctccagctggcacagaagctccttttctagatggttcattccctgtggctttgctgaagcctttggtgaccgtggctgctttcatgaatggcgctggaatcacctgacaaggatttccaagcagccatcatgaaaagggctcaaaaagcaatgacaggttctctggaaacaaatgaaacaatggaacatctcggcaaagaaataaaacttatgaaaaggaaattaaaagtatagaactgaatagaataatggaaataaaacactggatgggctcaaaggtacagtagagatggcagaagattgattagtgaacttgatcgaggactcatcaagggaggggctcagtgtagacaagagagaaaacagacctcagaaagcaagggctgcccagggcggcacacactgcaggacagcagacagtgtgggaacgacagcaggattcttcccttccctcgccggctccttgtctctccctctgtgtctctctgtgactctgtttctcccctttttgtctctctgtatctgtgacatcctctacctctctgtctctccctctctgtgtctatgtctctgtctctctcatctctgaactgtcagaatcacaggaggcctccagagcgtgttttgtcccccttggttgaagaatgaaagccaccctgtgaaacctgtggctcttgtgggtgcctgcgtggagcactggcgggtgcctgcgtggagcactggcgggtgcctgtgtggagcactggcgggtgcctgcgtggagcactggcggcagacaggggcctgatgtgggctgcaggagcaggccagctgcttaggggcaaacccaatttggggcctgcgattttccttagtgatagggaggcaggagctgtaaccagagcttgctctggacagcactggctgaactgatgcccatgcacagaggaaactgagccatgggcctgcaggtgggcagtcctgggagagcactgggaagcccatgggcagctggccgcaggcagagccagtggcaacaggatgcagccatcaatctcaacagggagggttgaaacttttaaggtaaaactaagacaatctttcatttgtctctcactttgtctacagtgatcatatttccaggtctttttcgggatagttcctgtcttaaacatccaattctcacattagaccaactatattactttttggtatattactttttgccatgtcagcatcactgaacttcacttttggtagccataatcaagtgatttattagagtgtcacaggcacaggtccttcgttcattaattcacaaataatataccaagtgcctgtctgtatatgccatctgttaagattcaaccgtcatccaaacagaccaaatatgctgcagctggagcgtgtattgtatagtgcagggagagattctgtaaacatcacacagaaatcaatgagacatttcatttaccagtgatatgtgtcatggaggaaaacagcaggtggcgggtgggaagtgccagcacctagggcggtggtgcaggtttacatcaggtcatcggggaggtgttactgagaagtgacatgaacagagacttgatgaatgggagcaaagaaaggaatgatgtgaagatctgggaggatggtgttgcaggcagagggaacagctagtgcgaggtcctggggtagaagcctgcctggcgagttccagaacagcagaggccagtgagagtggggagggtggtagctggctgacgaggtcaaggaaggaataagggagcgattgtgtagtacctgcttggccattcgaaggacttggccttttattattaaccttttttttgtttgttcgtttgtttgcttttttagaggcagggtctttttctattgcccaggagggagtgcagtggcagatcacagctcaatgtagccttgaactcctgggctccagtgaacctccagagtagctaggactacagcatacgtcaccatgcccagctaatttttaatgtttttatagagacagggtcttgctatgttgccccggctgatcttgaactcctggtttcaagtgattctcctgctttggcctcccaaaatgttgggattacatataagttctaggcatgaactaccacacccagcctggaccttattttttagagcagttttaggtttccagaagaactgagcaaaaagtactgagttcctatacactcccttctttcagcccacccactttcccccattattaacaccctacattagtatgatgcacctgttacaattgataagatgatactgatactttattattaactaaagttcacagtttccattagggttcactgtgtgttgtatgttctgtgggttttgacaagtgtataatgacatgtagccactgtataatatcatgcagagtagtttcactgccctgaagtcccctttactccgcctagtcatccctccctcaactcaacccctggcaactgttgatctttttaccgtccccatgttttttttttttaaattacatttactggtttattataagaatattgcaaaggctacagatgaagagacatgtagtgcgagctatgggggaagtgtcgcacagcttccatgccctccctgggtgtgcccccttcaggaacctctacgtattcagctgcctggaagctccaaaagttttatcttttccagaatgtcatatagttagaacaacacattctgtagcctttctgatcggcttctttcacttagcaatatgcatttaaggttcctccatattttttttttttatggattgatagcccatttctttctatcactgagtaatcccattgtatgatgtaccaccgttttttctccattcacctattgaagtacatcctggttgcttccaagtgttggtaattgtgaagaaagttgctataaacaaatgtgtgcagggttttgtgtggacatacgttttcagccccacgtgggtaaatataataccaaggagcacaattgctggatcatatggtaagcctacatttagctttgtaggagactgcccaactgccttctagtggctgcaccattttgcattcccaccagcaatgaatgcgagttccactgctccacattcttgccagcatttggtgttgacagttttgtggattttggccattctaataggtatgcagtggcatctccttgttttaatttacatttcttttataatatatgatgttggatatctttttatgtgcttatttaccatctgtgtatctttgttggtgtttttttcagatcttttgcccattttaaaaactaagttgttttattaatgagttttaagagttctttgtatattcagaataccagttattgattagatgtgttttgcaaatatctcctccctgttggtggcttgtcttcttgttctctcaaggacttcggcttttcctgagtgaaatggggaggttttaatggttttgagtggaggagtgacattacaggcaaattataaataatgatagtaatatgaaccaaatggaagatcagtttataagtggtttttaaaaaatgcatttcccaagtacagattgctacacatcttattcacaactatggccctattgatttcagcccaccctgctgatacttgagttttgggtaataatgatctttttgtcaacctttttattactcacagataatatgaaagtcccaactggcccatctttcatgcaagaggcttttatagcccacaagtgtccttggccaatgcttcctgccctctcttcctatcctctcacctctctctctagggcagccccaactgctatttatagagagatgtgcttaactgtggatgtcctcagctgtttccagtccccttatttcactttcttcctctgggtgaatggctccctcctgcttcaccatctcctctccaaaatgagcctgcctctttgcatgccttcaaatcccccacaagttaacatgtggatgaaaacagtttcttcctaggtggccgggttcagtcttctcttaggtggctctgagacttgaacttgcattaaacacagctttgaagcaaagactcttgagtgggaaaggccaggaacaaaacactgcatgactgcggagctcccactcttgccccctgacttcactgtgtgtggagctgggtggcagtaggacacttcagaagcaaatctgagtggtggaggcaaacaaaggcagggccgccataaaaaaccctagacgtctgagaacacaagtatgaacagcggagtagcactcgggactgcagggacaggagctgccattctcaccaaggtgccttggtcaagaataggacattgggttattggtgaggcagagtagatacaggaggcagcatcccggcagagaacagactgcttgtgctgagggtggacatgaccctgcctcattttgaaactcacccagacaatgactacacagctagtacccaccttggattcactagcacatttccgtcagaggccacagccttctccataggtgtctttaacaatgggcaataagaaaataatcaccagccatgctgaagtgcactcagtgggagagggaacatgccaaagggtgggaaacaatagagcaagggagcttaacaagaaagtgatgggcagctctgattcacagaatgccatgccatcatttacagtctgtttccattaggtcacaagcatgaaggtgaaagaaaaaagacaattattccacgtgaacaggtgaaagaacaatcttcgaccaccagactcaacttgagttgtcttatgaatctgtactgctctcagttttcttgtacccagattcttcaagggcacatggaatggtggctgccgatggaagtggcgagacctcaacggtgcccaccccagctgcacttgcttcctggggatctgcatcgctgcagcctaaccttgaggggtggcagggcaagtgctgtttcccagctcactctcattcaacaattaagatacaactgctacgttttcatctaacaatactgggagaacaaaatacgactcaatggtgaaatgtattctgggttatctgatgaagttttatctttaaatattttgttatccatttttggcattgctatgaatttgggactgttgccaccaactctgagggattttaaactgcttttagagtttgtgagaaccaagcctcaggggatgcatgagtcagttgaagcactgtagtcttgttggtctctctttgacatttcatgtctctggcatatctgaatttaggttgggaactggaggtttggtacacttgtatctattactacccttcataatctggccagttccatactcatggaaaacaatttgtttgttcccagatggctgcagcatttcatttagagttgggctttgggatttcttgaagaaggaatgcaaaagagaaacatgctttaaaaaaggtttaaatttcttccagtaaacgacttgcttagtatgctgaagactttttgggggagcagcttacttatctggtatttagcagtcaaatccttggcatttctgcctgttgcttcatgttttccaatggatttggaggaagagttgtcctggagacttccaagttagctccactgacctacattttcactccatttaacattattgactgtggaatgagccagagtgccgtggaagagcataattcctgatcagaagacagctgcaatttaattagaataaagcagtgactaccatgtaattaaaaattagatgaaccattgaatgctaagcggacttctagaaggtgaacttaggatttcaaacctaccactgcatctctgcatgacatggtggagatctgccctatgaagaccccagcacgctggcagcccatctgtcttgaggactgttttgtgacgggggagtcacgttggcctgaggggaagaataatagattgggagtggtcatcgtcttcttctctaatgtatttaataatacttgcacatgggacaacattcaaagggtacaataagtagagagagaaaagcaaatttcccttgttcccttgtcctccatgcccaattctctttccccgtagggaactcttgttaagtggcatatgcttgcagagacagctccatgcatttctaaacacctacatacattttcttcttgctttttttttttaaaaacacaaaaggtagatattatccacggtgttccccacgttccctaccacaccaaacataacttggagattgtgacatatcaggatataaagctgccccttttttaaaggctgtatggtagtggtgatagtctgtttgtggaagcattagaattcatttaatctgtcctctagattgtttccaatcgtttgccattacattgtgttctaattttagatgccgccaggaagctctccaggttagggccaggcagaaaacagatagatggcacactgaacagaggtggtttatgagacgatttatgaagtgagggcaggaagaaggacaacctagaagagatgggttaatgacagaaaagtcattaactctccctgaccccgaagcgaaaggtcaagggaaggagggtttctccagccagtgagagctgtagttacaggagaggctgcctgacaggagccatggtcttccgcgagtggtgtgttggtaaatgttaaacacctggctgtctgggaggggtggccctggcgtgtaccgtttgctgatttctgtgccgtaggtacttacaccagggctttaaaggcaccagtgtgacggggtgacacccatacagcccactgtgagccagctccagcatctactgctctaggcccctgcttcctgccagggcctcctattggctcaaccccaccagaagccagagagcagggaagcctggttgatgcagtcctcagaggctggtgcaggttggtgaaatccacgggctgtgtagttttggacctgacatttcagctgtctgagtccctgttttctcatctgtaaaataccagaactacctcaaaagttttctgtgaccctttcagctaaggttctttgtttcacttactccgtgatgagtggatttggtgacctaagtgagttaggtcatttagtgcacagttgctgactgtttaacatgagacatcggtgggccctgcagttagggagcttatgtctaatgagggagatgagatgtgcacaagtaggtccagccgtgttgtaggtctagctgtggacagaaccacatgcattcagaggaagtgatctttcatacctggggtgtgagatttgatggcaaagacctggggtgaccttcattctgtggttgggagtctgcattattctccaagtaggaaaaaaacagaacacttctagagtcagtctatatataccactaggttctctaagtatggtcctgataccatcaatgtctacagggaacttgttggaaatccaaattcttgggttccaccccaccttctgaatctgtgttactccaggtgattctgatgcatgtagatgtttaagaaacactgagttataccataccagtggttcccaaacctggctgaaaatcagaatcagatgaagactttaaacatacacacacatgtgcacactgacgctaggctcctgggctgtacttcagatctatgcagaatcagaatctccctggggagataaatacttctcagatgtgactattttctactggtgatcttaattgttgagataacattgaacctgtttaattatttgccttgctgatactgcttgttcttccttctgtagtggtttttttactcaaactctttcaaagtttgagagtctttaaattctgagaggtggcagctgtcttagtcggctctctgctttggttgagggtggagatgattgttcctgccctggagtagttggtaaggacttgacatgaaaactggatagctgtggatgcttctgaagtctgaccttaatgttgctttgtgattaatttgcagcaaattttcatatcacacacactgcttatcaaatattaagtacaaaaggcatactttgaaggaaaattgtaatgattctgggactatgtctctgcctggttagagttcttgatggaaaagcctggagtttattaccacggagaatttggcacaggatttctgaaaagtgaactgggcagagttgttggtcacttgaggcctgagttttctgaatatttctggagactacatgagaaagcagacttccccacccctttgaattgtgaaggctttgctgattataaataaagctatgaacattgctgtacatggctttcagtggacctatgctttcatctctcttgggtaaatacctaggaaaggaattgccggtcttagggtagatgtatatttaactttgcaagaaacggccagttttctaagcataccatttacactcccattagtcgtgtctgggaattccagttactttacatccttgccaacacttgatatattgtcagccctttccatttgatccattctggtggggtgcagtgttatctgtggttttaatttgcatttccctaatgactaaagagattgaactgtttttcacgtgctcactgaccattcgtttgtatagcttcttcagcgaaatattaaagggactttcagccatcttgtttgtatcacaatattccaaacatgtttttccaccacagcttcacccatgatctcagctgcccttttttactcgccatccttgagaacaccctggactgccaaaatggcacacctttgagatgcagttccatttgcctcttcacccttccaactcagaggtcacctttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacacccggctaattttttgtatttttagtagagacggggtttcaccgttttagccgggatggtctcgatctcctgacctcgtgatccgcccgcctcggcctcccaaagtgctgggattacaggcgtgagccaccgtgcccagccgaggtcaccttttatgctggttaagcctctagccctgccctatctctgcagaatttaggtttccctctgccatgcttctgtagtgctgagtctacatctccgtggccacacttgccatgctgtgtgcaagcttctgtgcgtctcactctttgcattcaccgtgcttatgccatcatctgccatggagtctaagcccaatattgctggattaatttattacccatttcatcctcccagccactctgtgcaaaaagatgtgttagccttaaatcagggacaaaggcatagacccaaggggtcaagtgacttgtccagtgtgacacaacatatttgttatacagccaggcactacttactataaagttttgactctttgacattacagttttccaaacaagtatgttttaggtacagtgttctttgacctagcttgctacaggtacccatgtacatgtacagaaatatttttcaagggatatgcaggcacaggatggttttaagggaatccacttccagaccctcaacttacatacacagtcacctaaaactgactagccttagaaggtgccaagccatggaagacatgaagctggttgggccgtcccatctcctctctcatgatggccattctcccaattcatacagaaaggcagactttgcacctgtcatcttcctgaggtgcactgctgcaagatggaaaacttccaggctatgtaacaaagagacaatgagaaatattgatggtattaagaagtcaatgactttaacgactgaaatgttgctactcaggggtttccacttcttagctttcacagaaatcaaaggagacctaatcaagatgttaataaatgatttaaaatatttttaacttacgagagaccatatctggactttgtccatgtaactcagaagacttcaaagagttaagatatatcatgacaaatctccttgcgttttcaagtatttatttttgtgaacaaagtttttccgggtttgcataaaaatcctccaagacaggaaaacaagcgatgctgggccatacctcactctagcaaaaagtgatagtcattcaggggtaaattaacaaactaaaaaaaaagccctatacatttcattaaaaaaaccatttctgtccgggtgcgatggctcacgcctgtaatcccagcactttgggagtctgaggcgggcagattgcttgagcccaggagttcaagtccagcctgggcaacatagtgagaccactatctctgaaaaaaaaaaagaaaagaaaagaaaaagaaatacacttccagataaaactttgctttttatatgtaataatttataaaaatggtaacatattgttttcatcatttgtgtactcataatagttgtgttaactcagttcagaaaaaaatcatagcaattagattcttatggcttaatactcttaaatgtagagtcaattatcattatttgtggtagttatgttctagaaagttaccttgatcattgaattactgacaaatgcaacactgctctgaggagaaatatagcgttaggatccacgaagactctggccagaacattttgccaaccaatcaatacataaccttgttttatgtgtatttttgtttgaagatagcttatttaatataaatttcttacaagtactcatatgcagtatttctttataataaacactgtgtttcagttacagcattatgtactcctatgactgtactagtttaattctcagtcataagtacacacatgcacacaatacacatacatatacagtactcacataacacggaatactgtgaacatgctttatactgtatagcacagtaataacaaatacataaagtcctgaaaaaagcattaagtgaagattaagcatttaaagttttatacacattaactaaagtcttactgtaatggagctgcaggatgtgtgatggtcagtgagtgcactgtggtttaccctatcaaccttagcttgccccatgaaaatcaaaagaggctggtggaactcaccctgcacaagaggaagatgtcagtaagagcagcacattgtgatctggcagagctaccttaggagtttgtcttttgcaacttgttgatggtgttggcaactgtctctcaaactggctagaaaaattggttcagccttgtctgcctggctttttgcctcaaatctttaagcatctcagaataagggataaatgcagtggaagtgaggtgcttaaatgtgaggccacgttcaagtacagggtcacattcttccatgtcattgaaaatgttttccaaggcagaattctattctgatattttggctgctgtgagaaggacaattcttggagtcttagggtgactttcatccctgactatgctcccatgttttgccatctcatccaggtttttgtttgtgggttctactgccttctctgacaaaatttcctccacatcttcttccttcatgtcattgaaaccttctccacttatttgccttgcaatatgcattgtttttttacattgttttttatattttctgaaacaccttcaaagccttgaaaagttttcacagagtctggccaaatgttttcccagcagttattgatagtagcctgcttgatgctgtcccacgctgtgccaacataatcaataatgctgcgtatagtgagtgatttccagtagtctgtcatggtggcttccttgttggcgtcaagagcctcacaagctttacaataaagttccctcgtgtagtgtgccttgaaagtttgtattatgccctgaggggctggacgagagatgtagtattgggggcatgaaaagaacttctttgttggggtgagcattttcaagttcatcgtgcaatgaactggggcattatccaaaattaataagacccagaaagcaaggtttttgccctagagatatcgttcaacttctggaatgaagcagtggtggaaccaatcccagaatatttcagataccagccatgcttttctgttctaccgccaatggactggcatgcagttcagatttttccctttaagggctcatgggttttgggctctgtacaccatcagaggtttgcacttaaagtcgcccttggcattggtgcacaatagcaaggttgaatgctttaaagtcaggggctcgtgtgaccatttacattacataggttcatttgccaacattcttataaaacaagcagtctcatcagcattgaaaacctgctctttaccataaccctttaacccttttcacgtataacacttagcagacattttaaaaattcttccgcagcctccttatggcagaacctgccttgcctgcaagtttaaaatttgatttcatgctgtaccgccttttgaaacgtgccagccagcctgcactggctgagaagggtttaatattttcctgaccttgggtaacatggctgtaaatttctttggctttcagcctcacaacaatactgctcactacactacaaaagtccatatatgactttttttattggttgtcgtctcatgaatccacaattttagctgcttttccatcttttccatagcttcatcacacactatagatgttactttagcactttctggagcagcctcatgtacagatgtgaatgcactgtattgttgattcattaacattgaactcatggccaacagcactataactcatgcccgaacaaagcttatctaacacatgtattttctctgttaagacacatcacagccttcttgcgcttagggacattagacagcatttcagcactacgtttgggggccatttgaaacagaaatcaccatcggaaagcatagaaatttgaaaaatgtgacactaagtagagtgagaagaggacatatgtttacagaatgagaactaaaaaaaaaaggcagagcatggccttattcaagcacagctgggaacgtgtacataaggtgatccaaatttttcactgttctgcttgtgtccatatatgactgagagtgcttcaagtattgatttttgggttacacataatttttagccaagtagctgagttcataaatacagactctttgaatgatgattgactgtatttgtagaggttacttgccaaaaaagagtgtgtttcaagcataaaaatagactatatgaggatacaactttttgggtgaagtggaatgaattaaaggagaaagaattaatgtctgacttgttcagaaactttttagatggagaaatgggtattatgtttctattacacttagattctattggatatattttttataaaggatgcaatggtttaatttaaaaatgtcatcagaatgtcagaaattacatcctttacaactatttaaaactatgaagaaaaaaattaggtattacctagatatgtgataatttttgaaaattattttaaagagcaaaacggattaggaagcagctttgcttttgccattccactgaaaaaatgtacagtttcgatggaaacatgtcagcacttgcttgaaggaatttttcaactatagaaagaaaaaagcttcatttcatcccttttggcattgctgaacacttggttttgatgtataattttaaaacacctgagcaccataaaatgaaaccacagtattcctgagtagcctggtgaaatgtcgtgattttctcctacagtacagaaggacaaaaatgcctttaatgtcctcaaatgctagagttctagatgacgcattagtttaaatgtcaacgcttaatgtcttcacatgtaatttggaacataagttttcttacagttaaaataatccttagagcaaaaaacaaaataaagtttttcgtatgcctcaggcttcttaaaattttctagtaattggtactgtttctggtttccttagtttcttgccgtgggtaaggtccaaacaccttacatgtgttgctggtggccctcacaattctaccttggactaaagcactagggagtctgtaggcgccttcctgcgctcctccactgcggtggatccacaatttcttctcagctgacttactggttttcatgttaactatttcggttaatcattcatgaagcgcgtggcttatatttgggaaaacattgcaccttaatcccaacatgcataatttatgttgcttaattattttaagtcattgcattagaatagtaactgcgctctccatgagcctaggctagaaagaagggaaaaaatcccaggttctctcccaacgatcaggggttactcaagccgcccgagttctctggggcccctctgggccaggctgcgtccacttgggagaggccgaggacctggcgccaagaggcggcggtgtctgcgctaggggccgagcgggtgcgctgtgtctgcggggccaggccaaggacctggagcagggaggaggccgagcgcggagccgggccttgtcggctgcgtccgcggggctagggtagagaccgaagactggacaggaggaggcggcggtggccgcgcgcggggccaaccggtgggctccctctaccggaccgaggcccagcactgggccagaggaggtggcagctcgccggcaaagcagggtgggctgcgtccgcgggggcgaacacccgacgctatccgaagacgtcccgcgcgggccggcgggggcgcggtctgaggacgtcacttccggcgccggggctcacttcctggtgcgggaaggggcagagattggtgcagccccggaggaagaaaaaagggtgaggagaagcagcggctgagcgggttggcatctggggcagcgggctcgctccaggccgtcgggggccgctcgccagcgtcgcccgctgtgttgggagcgcgggccgtgggcgtcgctcggccttgtccgcggcgtccccgctgccggccacggcgctcagcgcttgtgctctgtattgcaggtctaccccgagccccggagcgagagcgagtgcctgagcaacatccgcgagttcctgcgcggctgcggggcttccctgcggctggaggtgagcgcgggcggccacgggccgagggaggggccgggaagacggggttgggcccggggtgggtgcttcgctccagccggacctcctgcctcctccgcgcccggatccgaccctccccggctgctcgagagtccgggatgtgtggaacggggcgttgcgggtttgggtaatggccgggaggtggcggcgcgcgggccacccccagggcagggtggagtctgcgtgtggaaccccagacattgctctcgttccagtgaggaagagtggttctggtcgctggtggtgcaggtgacacacattttcaacaaccgtttatcaggggtgtgaaccgatttcttggcacctgcctcagcatgaactctgcttttagagattgtcatctaagggctggcatctaggtctgggtcaggccttagaatcctcagcaggtgatcaggcaaagtcgtgcagaaataaaatgggccagccctccgcctgcttctcccagccgcactcctttctctgctttttcttcctgagaccagaaattcggtggtttttccgtaccctcaacacttaatgtccagagaattcacattaaccagtatgtgacgtttataaaacatgctgtcggggaacatactgggcggggtctcgattccctgttgtaaaatgttgtgtcactttactaaacattgtcttttcagtctttcagtggcagtttctgggaatttaactctttcattttattttgctattgcgattcttcctacacttggggtagcactttaaatacagaaatctagctttgcttttcttgggatctgcttaagtggttgcagtcagtcctgtacttaagtcctgccgtttatgttgccactttgtcactcttaaccttagttttcttatctgtaaactgagatgggcaatatcaagctcccagataagagtacagtcggccctccgtatccaaggttacccacccgtgtattcagccaaccttggattggaaatactggaggagggggaaaccaattaaaaaaaaacaataaaaaacaacacagtataatgattatttacatatcatttataatgtactaggtagtgtatgaaacctagagatgatttaatgtttacgggactatgccattttatataaaagacttgagcatctgagggttttggtatccaccgggatcctggaaccaattccctgctgataaaaagggacaactgtatatgaaagcatctttgtagaacctgttatgtaggataacccaacagaggtttcccttcccgaagaatattttgctataggtttctcggaaaacctagaacatcaaatctgtgagggcaggttacatggaaagtttatttaattgaattagacatgtaggaattcatagattaaagtattactggcgttgtttatgattgtaaacacaaagaaatttattgttggtagtatttcatgttggcaaggaaattattacacgtaagtgaaagtgctaggggagattccaagaaacttagggccttttcaaaggggaaaaagacagtgtttcagtagtctttccctgataccctttgtcgtatcagctttgtcatttgtaatccagctgccttattggctgtgataatatgccttgctagtggcaggttttactttttcttcacctttgtgagggattttattatattatcctcttgaaactactgagttttgtttacgttaacatacttttgaaactcaattggcacattaagattatctgactttagtgtaaaactttttaaaaaagttttgttttaaagtaaattgaggctgggtgtggtggctcacgcctgtaatcccagcactttgggaggccgaggcgggtggatcacatgaggtcgggagttcgagaccagcctggccaacatggtgaaaccctgtctatacttaaacaaacccaaaaacaaaaattagcccggcgtggtggcgtgcacctgtagttccagttactcaggtggctgagacaggagaatcccttgaaccccggaggcagaggttgcagtgagctgagattgccactgcactccagcctgggtgacagagcaagactccctcaaaaaaaaaaaaaaaaaaaaaagtaaattgaatgttaaaaacttaccgtttttagttttccaaaggttgctgacatttcatacagtaactattgtttttataattaagagtttatttgaaggttttctggaagagagttttcactaacatattccaagcatctacaatagtgcttggcacataataggctttcaataaatatttgttactaatagaatgaacttgaggttgtaagtgatagcaagtgagtttcattttaaagtaaaaaattagttttgacttattttgtgctatttttaaagagtaaatatctcttccagtaaatttaagcaagaggcaaatgttagcattcttcaagcttagtgtgagtcacacttgtaattacctaggagataataaaaatgaaaatatgaaaacagcacatgaaaaacctgataaattgttcagtcattgtgttttttgggaagttaccctgagaagtcattttgtatgctatgcatccagctctggcttccagccttgtaaggtgatgtgaagggacagggctgggccctgaaggacttggtcatctcccatgcgggccacagtgcagcaatttcccagtgtttaagaattgcttagggagtcaggagggaagggccttgcacttgtgaaatatgttgtgggatttacacatttcattttcacaaaattctgaaaggtgggaaattgataagaaatgttttgaaactacagacacaaaacttaaaactaatagcttaaattctagattagcttttgttctatagttgtaaatgtcaaggtgcttttcttccaggggttagtttagactgaattgtgtttgtaacagattgtttttggtgtatatattcttatttactgtcagtttaagctctgctaagatttgttaaagggaaaaaggaagtaaacttggttaatatgtcagctgttttggtgcatgccctccttaattacctgtagaaaatcagatattatcccccaattgttttgattatgaaaatatttttataaattggttttaaaggaatattgtgtgagtcgcatttattggtaaactttgagaagcactgggttttaagctggaaaactttgaaatttggaaaattaaaaaaatttaattactgttggaaagcagtgcaacttggatgacttcattttcttataacttttttacttggcatgcttaaattttttttttttttccagttagggcaaaaaacccctaggcacacaatttctatttgtatctcaaaagcaaccaaaataataattattaataagaataatgatgatgttggctgggtgcagtggctcatgcctgtaatcctagcgctttgggaggctgaggcgggtagatcaccttaggtcaggagtttgagaccagcatgaccaacatggtgaaaccccatctctactaatcacgccactgccctccagcctggacaacagagcaaaactccgtctcaaaaaaagaaaaaaaaaatgatgatgatgatgatgtttgtagaatttcacttgaggataagtaacttactgaggcaaaccaagcaagtgataggacatttctttgcattttcttaggtaaacagctacagagaaattcagagtgatttctgtttccagtattttgctatgttactgtggaattctgattcaagtgttgtagctactgtaggatgtgtatgtgtgcatgtgtgtgtgtgcacatgcttgttcactgaaaaggtcacaatgaattagcttccaagatgttcccaccctatgcaacattgtctgattaggcatctgacaactagggaagcaggtgaaatgtaactggcaaaagcagattttatgttcctaggagaaagcttgtttggttaaagccatcacgcctgtaacatgtttaccagttttttatttcaagagctgaaagttaaggatataagattccagttaattgatacattattaagctcacattaataacgtggtttcaggaatattagcaacaaaattattataataaagctatggattttaacttagttctgtttgaaagaaagatgtctactgttcttgatacttagctatattcatacataatagaaaagggtaatcttgatggatagtttgatattaatgaggcttttttgcttaagaattgactgtgggctcacatacagtgttaccatcactacttgaaaggaaaacaaaacatttcagatgaaactgggtgagcctgttctcatagttgccaagagggaataaagccaatttgtcaagtgtaaggaaaccacagctctttcttgtcatagaccatttctggaatagttatgtttgatatgatagggatggtaaccctaatatattaataattgatctttccagctccttggcactgcaactaatactaaaattatctgcaggtttcacagttgctgttcatttatttaactgtttttctggaaaagtggaaagcatccaaaggcccaggtggttcagaacagaaatctgctcttttctcatcctcacccttggaagtttttggttggcttttggtctctcagatcaacagagcatgaaatgtagaccagctagtcacataaagcttgcctcatatccagtttcttttctttaattcttatattttgtttttaaattgacaaatagttgcatgtatttatggagtaacatcattatgttatggtatatgaatgcattgtggaatgattaagtcgggaatgaacatatccgttacctcacatacttcttatttctttgtggtaagaacatttaaaatctaatcttttagcaattttgaaatatactttaaattattgttaactgtagtcacctgctgtacaatagatcactaaaatttattcctcccgtccgactgaaattttgtaccctttgactaacatctcccctttccctgtctagctcctgtttcctccttcccagcctcctcagcatctggtaaccaccattctcttgtctgcttctgtgagttcagcttttttacactttacatataggtgagatcgtgcagtatttgtctttttgtgccctgctttctcttagcacaatgttctccaggttcattcattgttgttgcaaataacaggatttcctttttttaaaagtctgactagtattctattgtgtatatatcccacattttctttattctctcatctttcagtggacacttagattgattttatatcttggctgttgtgaatagtgctgccatgaaaatgggagtgcagacatctcttcaacatactgattttagtttctttggctatatacccagtagtgggattgctggatcatatgataattctgtttttagattttggaggaacctccatactgtttcccagaatggcttcaggaatttacattcccaccaacaatgtgcaaggcttatcttttctccacatccttgccaacacctgtcgcctttcatctttttgataatagccattctacagttgtgagatgctctcatgatttgaatgtgcatttctctgatcattagtgatgttgaacattttctaatctgttggccatttgtatgtctttggagaaatgtctgtttgggtcctttgctcatcattttttaatcaggtttttttttgttactgagtttttaaatatattttggatattagcttcttatcagatgtatggtttgcaaatactttctttccgttctgtgagttgtctcttaattctgttttgctgtgcataatcttttcagtttgatgaaatcccatttatcttatttttgcctctgttttcggtgcttttggggtcatatccaagaactcattgtccagaccaatgtcttggagctttccatggtgcttatttctggtagtttcatagtctcaggtcttacatttaagtctttagtccattttgagttcatttttgtatgtgttgtgagacaaggttccaatttaatttttctgcatgtggatatccaattttcccagcaccatatgttgaagactgtccttttcccattgggtgttcttggcacctttgtcaaaggtctattgactgtatcatgtgagtttaattctcagctctctattctgctctgttggtctgtgtgtctgcttttatgctagtgccatgctgttttggctgctatagcttggtaatacactttgaaatcaggtagtgtgatgcctccagctttgttctttttactcaagaatgctttagttattggggttttttttttttgtgattccatgtgaatttcaggattgtttttctatatctgtgaagaataccattgtaaatttggtagacattgcattgaatctgtggatcaccttggatgttttaacagtacaggttaagcatgctgactgatacggtttgcctgtgtccacacccagatctcatcttgaattgtaatctgcataatccccacgtctagggagagacctagggagagacccaggagattatggggattacaattcaagatgagatttggagttagagatcagcctgggctacgtggcaaaacctcatttctacaaagaaaaaaaaaatctattggacagtgctggatccagtagaatcctaggagatgggatcatgggggtgatttcccccatgctgttcttgtgataacgagggagttctcaggagatctgatggttttataaggggctcctccccctttgctcctcacccttctgtctcctgctgccctgtgaagaggtgcttttcgccatgattgtaagtttcctgtggcctcaccagccatgtggaactgtgagtcatttaaacctcttttctttataaattacccagtcttgggtatgtctttgtaacagtgtgaacgtggactaatgtacatgccaaacctgaaaatccaaaatgctccaaaatctgaaattctttgagtaccaatgtgacactcaaaggaaatgctcattggagtgttttggattttcaggatttgagatgctcaactgataactataatgaaaatatccctaaatctgaaatacaaaacacttctgatgtcaacttgtgtcacttctgagaatgtgtacatgatgctgagtagcacagagcatgcttgtggcatgggtgctaaatggttagcttggcacactcacagctagtaattgtgactttgatcttcagctgatttctccttttttgattcagggttattgctcactcctggtagctgcccatgattatcaggtatttgctttgcgggggacggtatagggggagggaatgtagtgcctgaccccaacccctttcctgggttgctgtcctgtgttgccactcgccagctgtgccatcaggaaaatgggtgtcacacgtgcttgccctttgtgtctgtcgtgaggattacataaattcatgcaaaactcttagaacagtgcctggtaagttggaggtgccaaagagacaatagctgttattatcatttgcattattattctttcgtgtagttggagccatatggtatattttaaatctttacccagggttccatattcattttttaaactgcagtaaatagagctatgtaagaagaaaatgaaaagctgtataatgctaccgtttagagataccagtgttaaaattagtatttcttttttggtaattttttttttaaccattgcaaatatgtaaatatatttttaaaatatccatgacatcatagatacatgtaatgttttataacatgctttaatttgatccagtgtgagtcttttcccatgttaaataattattttactactgattttaatggctgcctcttagttcctggtaataatccccatttttggatacagaggtggattctaagtttccacggttgtgaacagtggactgtgcaatggacatttctgtaccacacccttaatccttgattttctttgtaggacaaattccctgatagggcactgcaaggccaaaggtgggggctttcaaaggctttgaacacctgctaccatacagcttccagagaacttttgccagtagcagtacatgagagtactccttcctgtcctatggatgtcctgtggacagctgtcttgaatcttttatatattttctttcccttaggaagatggaaaacttgttatggataaacattttggcttttctatcttatatcttccacagtgctttatatttctggggagattgcaaactaaaataaatgtaagtcagtcaacatttcctgcattggacttttgaaagaggatgtgaaagaaaagctgctagaattggaaataaaagttgaaaaccctagaaatttgcagtgttatcagctgttgcacaagtaaccttgcatggcactgggtgggacattcttgggccactctgtacaagctggagttctggctgtaaatgcatcttgagacggtctgcaaaggtgagagggcaggttttcattttctcactttacagtcgagagacttcagaaggagttcaggtgggcagtccagcatcgtaaggagctgggataatttagtgagtgagaggttttggaaaagaaattgccttacctgtttctgaaacactcatcttccctgtgtatttctgaaggacaagttcttttattatactgctctgcctaatgctcagttctcttttagattttttttagccaagattgtgattaggatttcacccacaagaatagttaaaaatattaacacttttgaaagaattaaaatgtgggaaccacttactgaaactcaaaacttgttgatgcaggcttaataattaattgcaataaaaacagaagtaaatctatagtctgggatgggacgcccagccaagtgttgtctttgttctagattcagacagatgaggaggtaaactgtttattgaaacttggcattgaaggtttataagcaccaaagatatgtttgaggcattctttttagctgggcacccttctatactgttgataccaagcgtgaaacggttggtcacaacatagtgtttattgactgattcattgaataagctgttgaagcttattcctgtgtaggactttagttaaggaagttaagtaaaaatattgtttgggagaagaaatgagtaactattccctgaacattttgtaggtagtttaaagaaagacagtttccattcagatactgtaattgtgttttaatttcacctggcaagaagtgtcaagagatggccctctgtcttgtaccttagtgccttgctgtactgtcttgctgggtgaacatgaagtgttctggttatccaggctgcttttctagtgtagacagctagacttcccccttcgtttcagatctttggaatgtcttctttgtctagatcagcactgtgcagtaggaatatactgggagccacagatgcgattttaagttttttagtaactactttaaaaaagtgaagcaaagttaattttagttttcatttttaaatatttatttatttatttatttatttttgagacagagtctcactctattacccaggctggagtacagtggcgtgatcatggttcactgcagcccccaccccaccaagtaccttagactacaggcatgcaccactatgcctggctaatttttgtatttttttgtagagatgaggttttgccatgttgcccaggctgatctctaactcctgggctcaagcagtcttcccacctcagcctcccagagtgctgggattataggcatgagccgctgtacctggcctaaagttaattttaataatgcattctatttaacccagtgtatccataaaattatttcaacatgtaattgatacatattaatgaggtattttagtttcttcacattaagtctataaaatcgtgttggaatttgttatggccacagcacatctcggtttgtattagccacatttcagttgctcagcagcccatctgtgagtggcccccgtattgcgtgttgcgtttggattatttaagaggctggggaaatacggtgatctttgaaatgaaatgggacccaggtttgttgagaacaaattgtgtgtctaggcattttccttgtactgttttgttgaaacctcacgatgccctgcagagaagatggcagttccccacttagcagatcaggaggctgagacttgaagtggttcagaagtcacaggtcccggctcagccagtgaagagatgcggaatttgaactgagatgcatccactccactggctgggttcttcatacaagcatgctgctgcctagtgtggcattaggtgaggtgtttgacaacatcaaggcaatactcttaggctgactcctggcaaggcccatgggcaagttctcaggagaacttacctggtgacagggcctgcctcgtgggtgtgcgactagtgttgccacacagggccctgtgcttggtttcatgctctgctgttgccatcagaaactcttaagaattttttgataaggagctttgcatttccaattcgtgctggaccctgcaattgagtacttggtctagcctgctggtattgttcttagaggtctgtgatcaataacaggattaaacagcattttctgagtgcctattatggcctaggccccattatgaagtgtgtgttaacccggtttgaaagtagctgtctcaagttgttaccaccattttcctcacacgattgcatccgtgaccccaggcaagcggaatcgggataagaataaccctcaacaatccctgctactaaagaattgcttaaagtacttcctcctgataggaagttaagataatttgttgtctctcatgcattaaaaattgccacagcttccaaggcagccaccattttacctgtcagtgataaggacccgtgataatattggctatgggttttgtttttctaaaggatccttttgggaaagccatcctctccagtgttgggatgataaaaggatgggaagtcggagtcagcttgaacttaccaatcagagaacatgtaggggttgagtggaggggaagatcctctccaaggaattggagagaactttctactcacattacgtctaactagccagaggatgggcactgggactgtatacttgtaaggttccttcaaagcctgaattgtgtgagtcagtgatgcagctactttctagatgagctaccagtttaataataggacttagccccagattcctctccctttttggcccttgacatgggacacagatcccttagtagatgttcatgcctggcccatgtgggcagccgggtaagtctttccagtgcagctggtcagttggtctcacccaagagttgcatcacttgtatctccgctggttgttcagcaagtactggcagcacttaacacgtgcagtaaagcagtgaggctgttttgccaccgtgacaatgcagttgagttttgcctaacgtgaaaatactaagtttctgtgtattctctgctacccacaaccagaaggcttggaggaacaagcgttctggtttgtttatctgcatcccttccccttgataaagcaactgtgaatttggtcttcattagctgtagtctgttgaaccgactcagtatagccagggtagaggcagaaggaagtgtcctgcacagcggtacagctgagggcttcgtgctcctgagttcgtggcacaagagagggattcagtggtcagctctgcatagtctctcattttctagcaaatagaaaccagagtggatggcctcatatgtgtaagttctcatgagactcaaatggaaattagttgtccctgaggttcttcatgcttggctgattgaactagatggtttgagagggatattttgtagattaaagggtgagattagggctggggagaacaatggtggtagagtggccttaaagaccagcctccaggaaagcctctggcagttggagtccccactccctgccattaatcatctgtcacatctggttcatcttccttttactaaccccagaatcttggcttttctctttgcccaccaccattagcccaggctgtccacatccctcacctggatcactgcagcagctcctggccagtctatccttgcttttctccagactgtttttttctgaaacgcaaggctgattttggtcattttcctcctgactctgattttacctaatgtcttagaatgaaacccatgacccttggaagagatggggaataataggaagtgaggccagggagtcgtggggagcgagatcaggtggtcctgtaggtcctgtcttttcctccaagtgatatggagcctctgagggtgtttgggcagaggggagaagggatgtgatgtaagttttaacaggatcattttggctgtgttttgagtatagactgaaagactcaagggcaaaagcacggaaaccaaagaggacaggatggcaccaatccgggtgacctcccaggtgatggtggctggaaccacagtcccgtcagcataggtagcaggagagactgaattctagtttttatcaagagggtagagatgagatgatttacagatggactagatggggtatgcaggagaggagtcaaggaggaccaagggtttggcctgagcagttagaagaagttgtctttgggatggggaagtctggcagggccagatgtgggcactcagcttcagacatgctccatcaggatatctgtgagatgcctcagtgaagatcaggtctggacttcagggatgcggcctgggctgggatatcagcttcagacttcggcacaagcaggttctgattgtgtagagtgatgttcctgttagtctgtatcatgtggaagagtgtcttaaacacatattgtgggcaggtgctgtggggaggaggacatccatgcctcaaagagaatgaaggaatacctggtgaagggctgggggaggaagtgaggagatgttagtcccagaacattttaggcccgctagacgtgcgtactgacgttgctcatttcctggccaagctgtaaccacctgagtaaacggttggtttgttcttgggtcaggtgtatccacagcagtcattcagtgcgagggtacttaggtcctctttatcgtcagaaaatcacagagaagcaccatgcaaaaataggtttgtggtcatatagcgtgaaagttggcaaagatatgatctctgggctatttgtacgtgagcttagaagaaactgaggactcgtcatcaagttgtattttatatttcttttatccaataagacttgtacatagcttaaaagataaacaatacttagagcctcaaaaggaaacacagtcctcccgcactctccttatcccagaaacacactctcagctggtgtttcttcttggtctttacttcctcctttccatattgtatcctggcactgttgtttcttatcagttttagttaataactgtctaagatgagggtgtagctctttgtatcactcctatcccccagttcaggagaatcattctttgccctgcatgtgtgacatgatatcccttggtgcaatgttagttgttttagccaatgttttttcttagttataaatgacatgtgtgcattctgagcaaacagagtgttacaggcacacgtaaagggaaatgtccactcttctctctccctcctaaataccctaaccctgcttcctgcaggagccactgttgaatgctgaggcacacacggactctttttcaggaactgaggccatgctaggaatgctcttgtgcagtttgcctatttccactgagaatgtagtgcctttcctgggggcaccactgtggtgggcagcacaccagagcgtgacagcgacataaggcgctttccggaggacagaacaccagagccaccccttcctcacaggacacttgaacagtaaaactgaaccttcttgctgtgacagtgtggagttatggcaggagagcagggtgactgtccagcctcgataatgttccctccttggcagagtgaggtccttctgctcagtttgcctcttgaggagttgggtaccaggagcctgaggagagggtcctggcttacctaggtttttcctctctcgtccaggtcatagggagactgtcagggctgagatggccagggtagctggtggaaggtgctagccctcccctgtgcctgcttctctgcctctgccgctctcccgcttggtctcatctactctgtctctgcggtgtgcgacagctgtgtgaggccccactgtgcgacagctgtgtgaggcaggggtgtgggtcccctccaggcctgcccagccacctagcagctgttgccattccaggctcagagtccccgcctcctgcagatttcttcaagcttcatgctgccttgaggataaacacgagtggagagttgacacttttccttccatgtctttatgttctcagaatgttccaagaacttggaatattaacagggaaataccagggtttctgcatagaggtggataaaataggcaagaattgttcaggttcagtcttgaaaggtaatgattgaaaagggatatccttatagattatacagttttgaaggctatgaaagggtttcagtaaattgtccattcccacccccagaaaaaaatcacagaatcacaaaacttgggtttagttttttgaagcttgagagatgatttttgaaactaaacaaaggaaatattaaagatgtaaaaatggcatagttttgtggttttgatatgttgactccaagaaagtgatgctgtgttgagagaataggttccttgatgactgatcgccagtgaagtgtttatggaagccaggagtgttggatgacatgaggagggtaggtgacattgcttctataatatgttctttgatgcctgtgccagagaggatgcagacagcaactcagtattcacaatttgaagcagaccttatcatttctcttttaatcagtagttctgaactttttggtgttcagtaattcgggaagttggcttaggtaacaaataatgacaatagtagcggttaagtttggggatgcttactgtggggttgtgccaggcagaggcaaatccgtttaacatgtactagtttacttaatccttaaaaaagtcacttggcattgttgggaagagaagaaagtcgtgtgttaggagagaattgcagaggtcgttaatgccactgtattagtctgttctcacatggctataaatacctgagactgggtaatttataaagaaaagaggtttaatgggctcatggttccacagggtgtacaggaagcatgatgttgtcatctgccctgtttctggagaggcctcaggaaacttacaatcgtggtggaaggcaaaggggaagcaggctcgtcttaactggccggagcaggagcaagggagtggggaggtgccacacaccttgaaacaaccatatctcaccagcacacactcatcatcacgagaacagcaccaaggggaaatctgcccctcacgatccagtcacctcccaccaggccccacctccaacattggggattatacttcgacatgagaaccaagccacatcagccagaggcttcttcctggtccttgcgttggtaaccaggaccttgcttgtgagacattattggaagattttttggtggaattatatttttaactttggagtcattcttactgtaaaatatatttatgctgttacagtaatgaacatttaatgatcacctctgtttgctagacaccgttctagttgctggaggtggcttggtgagtaagggaggaggggccctgctcttagggagtgtaattctagttggggagacacttaagcaaaggaatgagcgtgtgaacaaataaaactgtcatgcgcaacaactgcagaatatcagggggtgaggtgagagagcacctgagtgctgacttagattgggtgatcagagcaggcccctctgcagaggtgacgcttttagagattgggtgatcagagaaggcccctctgcagaggtgacgcttttaggatttgctctcacagccaacgtgatacaagctagccactcttctttttttgtagacagagtcttgctctgttctccctgctggagtgcagtggtgtgatttcagcccactgtaacctctgcctcctgggatcaagcagtactcatgcctcaacctctcgagtagctgagattacaggcatgtaccaccatgcctggctaatttttgtatttttaatagagacgaggtcttgccatgttggccaggctggtcttgaactcctggccttaagtgatccacccgccttggcctcccaaagtgctgggattataggcgtgagccaccgtgcctggcgcagttagtcaatcttctgaggaagaccaaacgtggacgtcagaattgctcttctgttgaccattttcttccttcttactggaatttcttcttattttatctcttatgtagggaagctgggtgagaattgatcatgttactggcgttatcaacggccttgcacaaggctgctcactcaagccttcctgcctttactgaatgcagtgctaagtggccggggaaagtgctgtgtgttacccttaggccagattcactttctggaaggttctagaaggttccttgttgggagatgatggtggctaccccaagggtctggctccgctctgggaggacttgggagaactctgatgacggatggtgcccaggcccctggaagcagagcctgctgctgtgtgtttgaggtaaaaatgggagacctgcttgttgggtacttgggacaagaagtttgatttgggaatttaatttatggcagataacagataatcagtctcagtcttttctgttgcagatataaaaagcagcagtggttatctttaatttttaaaagcattttatcctttttctgttgtttgtgtccataagaaaaatgcatgcataccaaatatccatcataaaatagggaactaagaattttgtgtgcactggattttctttttttaaaattattgtttgaaatctgttaaacaagggcttgaactcaaatgaaagaactggcttttactttaagcttaagctcaccaatgcactcttagagttacttttgttcagggctctgtataaccaaatggaattagcctgaggaaggtacggttttttccacagcattttgtttgtgatgaggaggctaagatagtttaaactgtgtgagctggcactgttgtaaccataaagatttgaggtatttgggttttggttgtagccaagcctagcttgggagctgcgtgtgcaggagtacaggtgtctgaacagagtgtggctgctcagtgctggatgaggctctttggtgacagtctttgaaagcaaattaaaaaaaataaagtgaaaagcattaaaaataatttcactttgtttatagagttacactttaatatcgctccaggttacatgcttgaatctacaagtcctttcccttcatgctttgatcttttagttgaggaagttggctcattatgtatgtgttcaatttgcatgagcaatttttatgtgatggagtaaacatcagtgtgatctttgaagttagcttggtgaatgcttttctaattggggaaagctgttaaagtttgatttcaagagaaaaaggaatgagcctctaaaaacaaagctcttctgtggctgccatggtctgaatgtttgtgtctcctccccaaattcccatgttgaaatcctaacccccaaggtgacagtattaggaggtggggcctttggaggtgactaggctcatgaatggggttagtgctcatataaaagaggcctcagagagagacctctgcccccgtgccatgtgagtttgcagtgagttcatctgtgaagaaacaggccctcaccaaatactgaatcagtccatgccttgatcttggacttcccagttccagaactgtgagaatacatttctgtggcttatgagccgcccaggttatggtattttcttacagcagcctgaacggcccaaggcagtggcagagagcatcagtacacggtaccctgagaaaacacgttcgtaatcttgacgaggggctggtactctaaatacgtaagtagctcttacaagccagtaagggagattgtaacaaaatgaattcagttctttaaatggaagcactcactgatcagtgctctaggggcctttagagcatagtctctttggaaatgtggtcctggaagtatatattctcttaatatccctaaacgaaataaattcagttctataaatggaagcactcactgaatcagtgctctaggggcttttagagcatcgtctctgtggaaatgtggtcctggaagtatatattctcttaatatccctgaagtcatggcattctccagttccaagtcacgtggtggtgccgctctctaaggctgcaggtaagttggtgatcacctcatcctgtgacagtgtcacatcctctctgactgcttctgcccttcacactttttgggaaccatttcctcaaagaaactcaagccataataaaacttggttttaaaaaaccagcctcttttcttgcagtaaatttgaactgtcatttgcacacttagtaaaaacaccctacagactgggttaatagcagagagaggggtcctggtgctgtaaaccaaggcttggcagttttctgtaaaaagctagacagtaactatcttgtgggggctggggtggggcagacctctgtcacaattattctgccgttgttgtgcgacagcagccagagttggcatgtacaaactaggcatagctgttttctagtcagacattactgatgctgcctttttctcccgattatagtagctatgtgtgtagacaggttgagcatctcaaatatgaaaatccaaaatctgaaacgctcctggtcccaagcatttcagatgagggatgctcaacctgtgtatagaaataaaaactgcagaaaagtatatgaaaaaaccattccacttgtatcattaataagttacctttattaacgtgttgctgtatttccttccagcattttttaatgccatttgctcactctcaacccacaccttttttcttttcacagagttggtgtcagagtgcacacagatcctgccagttacctcccccagagcatgttgcgtttctgggcagaaacagcctagccatggttggggtggaatgcatactgcctgggagggctggccggtctcagagcctggcagcctggaggggtggtgtgcttggctagcttgtcttgatattttgcccccttttaaagtcttccagtcacttttatcttcacagagtagcagggtcatactggggagtcagaaccaggaaaattaccaggagtttgaccaattccaggcctctgtgtctgtcttgggaggatgctccaccttcgtacctactttgtggcatcagttggagatgctctgtagcgtaagctcagccccaggatgtggagggacagggcagagtgctcactggggacacagtgtattcactgattggaagcctgtgaaatttcatccacggattgctttcccaggaggttggcaatttggaaagcacattttggatgtgctgttagggtcagctttaagtcggcttgtgtttcatggctgccaagtgagcatggagaccactgcctctccccacattgaatggagatgtctcgtgtttgaggatgtcatttgctacctgcagcacctggtcttggagggttgggaggtcagggggtgggtggggtgtgcccgtgagacaggtgcgggtgtctgtagagggatgtgggtgtcattcagttttatcaggctgcttaactgcttgtggtggtgtttgcattgcactgactgggtcaacttgtgtagtgattactatgataaaaaatttacttaattttcaagacaaatttgtgatctccgattggtattaataattcataaggtagatttccctcctttgtctggcacccagccctccccctgtactattcggataagattaatgaagcgcctgaggtaaacaaggtagaatccgtgttagcttatttcagtgtaaaaggtttgttttgaaaaaaggaatgatatttgctgctatttaaaatctaggtaatattttatagagactgctgagatattttgggattgaggataattaaaattggttactcttatttctcagagcttatactctaagatcatttactgatttttacatttaaccacactgttaaaatgtccagacggcagtgcctgtggaatccctctgttggcacctgttgtgtattggcatcttcatgtcttccgaattcttcaaggcttttttctccccctttggtccttgacagatttctgcccacccagcaaggaagaggccatcttgctgtcttctgtcatctccttgtctgtctccctttcttgctcttccttcacctttctcgcagtcttgctcttgcattttatgacttcctggtcattacaaggagctgggaaatgccatgcattatctgggcatacgtggcttagttcactaagttttcctgtagtgctattttgagttcattgtcttgccttagttaaagtagacatctggagggccactttgctccagctttgtgaaaacacaccttctgggtttgccctgctctgtgtccacaccccgtgcctcagctgtgctagcggtctggtccatctgtacgctgggggtcgtaagcagaaaggagaggaaacaccgggaggtccttgcagctcctaggaagcagtttgctgataactcagctaggcgtgcgaggactagaagttgctgacagtcctcgggttggttttgtgcagcacatgtgcttgtgcgtgtcgggtgaaacctaaaagctccatctgttgcctgtgtctcgggatcttgctgtctcctcctcaaccgtcctcctgtgttgggagcatacagcagtgtgaatttgactcttccctgttttaagttgaattaaattagattgtagcctttccacaaggtagatctgccttctgggagtgggacgagcttctctaaattgaatatttgtttgtggtaagctgcttatttcttttcgtaatagttcactgaaatagccactaaggagttgatgggataattcagcagctgtgcactgagggcccctgtgggtcccacactgtcttagaagctctagagtcaaggcccacacttgtatggttcagaatgtacagaggacagacatgttcacaacagaattcctggcgctgatggaagccatgaagaagacagagtgaggggagagtgagggaatgggagagggtgagagagcagggctgccctgtgagactcaaagcctgggagcacctctctgggggccctctcagtcagggtgttgccatgtgagtgtggggaagggcacccaggcagaagagtgcctgggcaaaggctctgagatggaattgagcctgcctgctgcaggctggagcctgcagtggggtgagtgagcttttgggggaaggactggaggccccaggggcgggcctcctaagctgctggctcctcactgggcgtcctctgctccaggcgctttgaaaggtattgccttggacgtcctcatagcagccctgggaggtgggactgcccacttctctttgtggataaggagactgaggcacaggggttgagtctttctgaatgtgttagtctgttctcacactgctatagagaactgtctgagactgggtaatttataaaggagaaaggtttaatttactcacagttaacacagggctggggaggtcccaggaaacttaacagttgtggcaaaaggggaagcaaacacgtccttctttacatggcggcaggaaggagaaatgcagagcgaagggcagggaaaagccccttattaaaccatcagatcttgtgagaactcactgtcacgagaagagcatggaggtaactgccccatgattcaattacctcccactgggccctcccatgacacgcagggtttctggaagtagaagtcaagataaagagttggttggggacacagccaaaccctatcagccacacaggtagtctgtcaccagcaccatgctctgcctaggactctgagcccccttctgtaggttgatggaagtgtggattttagtctaatgatggccagaagctgctggaggattttaagcctgatcttttacccatagaaaatgcgaccattgctgctatgtggagaatgactgtaggtgagcaagatactttttgatgtcaaattgcagtgtttgaggtgtgtaaggcagtttctgtttcctgagaattgtgcgtgatgtgcctctccccctctggcatctggctgccatttgtgtggtggatctggttagatggccggcccctggaacttgtgttttgcttcctccccagtttcttcctaggtcccactctctcctttctcttcactgtgtgctgtgccctgtggggtgacccacgtagcccctgcctgccacctgtcactgcctaaacaccctccctgggaagtttcccatcaggtagggtcatgtccaggagtgtaaccatgatgagtgggacccccgcgtgcggacgtttgtcctcctcttgtcccccatctgctcttgagctttccatttcaggcgtgtcacatgatctgagatgtccttaggtagtatttgctgactggcttatttatttatttatttttttagatggagttcactcttgtcacccaggctggagtgcaatggtgcgattttggctcactgcaacctctgcctcccggattcaagcgattctcctgcctcagcctccccagtagctgggactacaggcgtgtaccaccacgccccactaatttttgtatttttaatagagacggggcttcaccatgttggccaggctgttcttgaactcctgaccacaggtgatccacccgccttggcctcccagagtgctgggattacaggcgtgagccaccgcgcccggctgactgacttattttataaataagtggtgtgtattctgtgctaggcgtggttccagtgacttcaccgaattaactcatttaaacctgtaccagtgctgaggaagcaggcatcgctttgcgggagaaacggaggtattgagaggcctgggaactgggccagggccacacagctggtgcattgtggccggggctgaggctgggcctgttgtgatgcacttcctgtctctgtgcctgcgtgcatattgaagaaacacaaatgatgttgtgttatcgtccttttgtccctctactctcaaaggagtccacattcttcctgttgcaaactggtcaaggcccattggtcattctgggagctgagctcaggcggggtgtgagatgtgctatcagtggagtcagtgtgttctgaatgcggctggaatctaaggagcaggtctgtgctcactgaggaggggagggtcacaccccctgagaatgtgttctcagtatccctgagccgtgttggtgagtttgcaggttctcacacggtcctgctggcagtcccattaggcactgctgccccggtgccacttgtctggactagctcagctgatgacgtttgtccttgggactgtcactgggaaggcctctcactagcctcagacagagtggcccagactgggtaaaaggcatgtctttctgggtatgaaatatgtgctatcttgaatatattagctcacgtgcatttttcaacatgctattgaacaaggatgtttgatgttggccagatggtggggaaaaaagtgttaagaagggtatatgttgttattttctaaaagtccttgtgaaaaatgaagcagacagtcatgaccagtgagtgggaacagtgaagcttgaactcgcacgcagtgtggtcccgagaaccctggaatagctcacctcctcttctccatgcgcagggaattctgtgttcactcagtgcctgtcctttgacctccttcctctctcctaaacttcctgtttctcagcttgactgaggctagtaaagcagggttctttgatcatcttttagtcattgcttttctattttcatttaaaaataaagcaagaaaatgccagctgatcttgtagggatgggaagtcctcctctctctttttcttgacaggcgcttgccctgaagcactctgagttcctgaggagttcccttatgtcctgggaaccagcgagagaacaggttcccagtgagtaattacaaaaacacaaaaccctgagttcttttcagaccatatttagatgtgcagtctacatttaatgtgtttttaaaaatagcattcttatccaaaatatgtgtttttggccagatttttgtcagtttaccttgtatgttttctgtgatagtttagagaaagggagtggtcttcagttcagaggtgatacagtattcagatggaatgttcactcttgccctttagggaaggtttcaaggttagattgggtggtatccacttgggattctgagtatgcgagtgtttttaaaaaatgctgaccccagcatctctctggagagtttctgactgagttagcttggtacttagcgctgtccagctgggcatggtgaggagtgccagccatctgtcagggaggcagctgccggtacccacccagcttggaaaaggcagggaggaagccacacttttctctaactgtctcgttgtagaatgggccagcccagctatgctgagagtttgaggggaagattagtgtggcagtgactgagatctttaagaaatgtcgggccggtcagaaggattgttcatgtgggtgtttatttgcacgaaagccccacagatgatgagtgaaatgctttattttcctcctaggctacggatggtgagcggatgctagagagagccacttaatgtgccgtcccccccctttttttttgttttgaaaactttaaaagtaacaaaggttgggagactagagttcggtgaacatccgtgtgcccttctcacaggtcaccagcattctgagttcaaatgcctgttctttttttttttttttgagacagaatcttgctttgtcacctaggttggagtgcagtagtgcaacctcaactcactgcagcctctgcctcccgggttcaagcgattctcgtgcctcagccagcctagtagctgggattacaggcacgtgccatcactcccagctacttttttttgtgtgtttttagtagagacagggtttcgctatgttgaccaggctggtcttgaactcctgacctcaggtgatcctcccgccttggccacccgaagtgctgggattacaggaatgagccactgcacccggcctcaaacgcctgtttctgttttattttgccaactgtgtaagtcatgttgtagatcccatgatccttacctctgaatacttcagcatgtgtatcttaaaaataagaacattctcctacataaccatggtgtcattatcacacccagaaatttaacgttgtgttgccgtatgctatatcctataatgttatcgcttatgcaacccatattcagatatctctggtggtctcagaatgacgtttatggcttttctttctgttaaatgtaggatctgaacaagggtcatgcattacatctggtttgtctctagtttattttcctgtaggatcgtttttctgcctttatcgctttaacgttaggatttgacgcttttgaagaatccaggcttgttagtgtgtagcatgccctacagtctggacatgatttggttcaggttagacatttctggcatgaattctgcataggtaatactctgtacttcccattgggtcccagcggaaggcacttactgttagtgggctccgtcactgctggtgccacagttggtcactaggttaaagtgatgtccaccagatctcggttataagggtgcctttccctttgtgcttaatccatggatgatactttacccccaaacgtttcactgatgcttctagcatccactgcctacgtgcctgaattacttcctgttatggtggttcaggtggttctcaggccctttgatttgaggctttctttagggcctcaggctcctgttggcactggagggtggtggtgggcatctaagcccgcaagttgtgggatgtgggagaggagaaaatgttactttgctttcaagaatccaaagattctataacatttgtgaacttagtcatttacttctgaggtctgttttacttcccttacgagcttttcattaccaagcaaaaaatcagtctttgactcagactgaagccatgaactgaattttatccatgtgagcttcaggagtgaatagaaggaagttgattgacagggaaggaacacatacagataggatattttccattttatgagaagtaacggtggaaatacagaagaggtagaaatgtaagattctttaaaacatgcatgacaacagcttagtagtaacagctgctgcttccagaggagcttctcagtaccagaagccccagaaggctgtgttgtaaggcagagatagtgatcacactacaggaaggagaagctgagatgtagagaggttaaggaagatgcccagtgtctaacatttactaggtggcagagttggtatttgaatccaggtttatggtgatttcagaacttccaaattgagaattaaagatcagctccaacaagagaatgagagcagtacagttggtggaagattatagacacctggaaatttaatctttatggggaactatatactgtagtgtccataatgttctgcattttgaatttttaatacgtgtgtttatatagataatatacataatctgcatcatgcaactggaaggacatttaagatttaagatgtctgattgcaaaaatgttagtgttcaaaatgccccccatcattctgggcatgatgtgtaactcagtgaaggccgttgagtgtagtgaaagacttactacttggaaaataaattggagcaggtgaatggccactttaaaatttgagtagctcctgtccctgttgtatttgctaattgtttatctcttagtggtgaatttattcaaaattcaaacttcaacaactttatggattctgtgtgtattggttacattgtgaaatacattttttagtgtggatcatggtcaagagtttgaacattgatcacatgggggtcttagaaggatcaggacaagggaactttggaattggtaaatttgtgtattaagggtttcaagttgtcccaacttcaaattttacatccctttgctgagagaagacctggaaacctacttttgtcttgtttatggcagttgattggaatcttagtttagaactggcccctggaagaggtggaggtcattttgtaggacttggagcatgcccagaaagagatgggacaaagtcatgagatcctttgactggggcatttcttggatagatcatgttttttttaaacaacaacaacaactggggagcatagtctggatttcattgtggtggagaacttggagtatttctccaggtgctgttcatcagtttgcactcggttctgaggaagtgtcttgagctgggtgccttgccctgagggagtatagaggtgaacaagatatctgtgccctgaggcatcatggaacagtgcactgaagtggaaggaacccatgtaacctgaatagggggcagcagctgtaaatgcttcaagagaggcgcagctgtcatggggttgggactcagagaggggaagaaacattccaggtggaaacaggaaagagcttcaggtaggaagcgacctttgaaagggcagaggggccagacatcatgcaggtaatgctgctgcttggttggcctgtgagcttttcaggttgatgtgttgaactgaaccaacaaagcgttgtggatttggtgagctgtcctaaatgtggagtcaggggaaatgtgaaaagcctgcagcattgtgcatcttgactgctaggggatggaataacttgaacctgatgtttgttcagaggaagctgggagggttttattcacaagagtggccttaattcacaagaattggagaccaggagggtgagaacaccgccgttctggatcgcagcagtctcgttgatcttcacggtgtcgagcgtgctggtgtgccgcctccatacgacaggtccctgttcgccggagggttcaggacttccttgggaagcatttctgagactcttttcctctgtacctaatggagcccccgtgttctctggccagcttccttccacggggtgctgagttactgccccgtgtgtcatacagtggaccttcaagctgcctttggtggtaaaagcttgtctgcatgtgttgcatacaaaaggcttttctccagtgtgactccatccgcctttaaatctgaggagccggagaggatgagaaggtcttcccacaccttgtgcatctctgttgcttggctgtgggcatggctgggcctcttaacaatggtgtcatgcccaggggtggggggaacgtggcctggggtctgacgaataccaggaacttcagctttgatggagttggctgggctctgataaacttggagactgctcccaccttccatctcagcgtggccgctctcagctctgcccccgccatcgggagacttggactagatgtttagaaagcagttttagggttcagagaaattgggcctagcatctgtgggctcatacagatatggttcgtcatctccagtggttcaacttacatgtttttttgactttgccatggtgcaaaagcaatgcacattcagtagaaacagtgcttcgagtacccatacagccagtttttcagtattcagtacgtcacatgagctattcaacgctgtgttataaaatatgctcttgtgtgagatgattttgcccaactgtaagctaatatgagtgttctgagcaaacttaaggtagctaggctgagctgtgatgttgtgtaggttaggtgtatcaaatgtattttcaacttcacgatgtttttcagtttacagtgggtttaacaggatgtaccccattgtgagttgagcatctgggtggccctacaaggtagaaccaaggtgtaaatagtcaagagttagaggaaggcagattactagcagtcacattgcacgcacgctatgtcattgtactcgtgctagcaagttttgttaaatggcgcttattttgaaatacatatgcagtggacatgtactgggagttagaaattaagtgcagaaggcagacagctatagcattctatagcatttggatgggagtattggcaccttttttttttttaaacaaaaatgttctcagtgaaaatgtggttataagcttatttttttctatttctctcagaagctgtctggcaaatgttttgattctttggatgttttttgatggggtctaccctcaggtctcacacctccggcatcatctgtggcttcgtcttttctaatcaaacctcctttgaacttttcatgttgtctgctgaaagttacatttgcatagcatcaaatagtgcataaactacatgtacattgtcattttatcaattattataaagtcctgtggatttttacctataaaccctcttctaatccatttcttctcttccccattatggcctctttatgagggagggaatttaatatacttgctctgtctctcaccttccccacagcccctctaaatcccaatttttgctaattgtaccggttttataattttcaattttttagtagtcaccttttaactgtatttctagtatttcttgacttgtcatcttagacttctctcctgtgtaaaagatgaggagctctgtaagtctccaccaggacttgtggggaagggttgacgggggtcacttgcttatggccgggtgcgggtgggactgcattttttaaccctctctgtgtggttggggtaggatggtgttatggtgtgactctgtccccacccaaatctcaccttgaattataataatccccacctgtcaagggcgggaccaggtggagataattgaatcacgggttggtttccccgccgttctcatgatcgtgaattagttctcacgagatctgatggttttataaggggcttcccctgctttgcctggcactcattctctctcgttgtcctgtgaagaggtgccttttgccgtgattgtaagttccctgaggcctccccagctatgtgtaactgtgagccagttaaacctcttttctttataaattacccagccttgggtatttcttcatagcagcgtgagaacggactaatacagatggttattgttgaagttttttgacctactaggctgccctgtcctggtcctttggctagagaggataggtctttcttgaggcttttcttctgtacctgttggtgtttctgggttgctggcttgtttagcactcagtttggagcatttgaggcaaaaagaaaacccagagaacccgctggcatggttcccagccctgaaacccttagccggtctgcctcctctctcacattctgaggctgacgtttgttttataggcagcatccagggcttttagctgcattcagctggagggagggggagatgtgtcttctccatctttttgggagtcataggtcagttctctttgtgctatgctgttatttcctatcaggtgtggccttgatgggttcttcctgtttgtgaataaaagcccagttgactggcatcagagcggaggggactgtgcagtcctgtgtgtgggttaccggccccgtgggcttcactgtgcgggttgtgtgtctgggagcaggtggggagaaccggatggagggctctagaagcagctacacgagcagagctgagggagacactttctctgcacctgtttcctgtgtcacacttcagatgggggatagtccaggctggtggtggagctcccaggggatttcgcttctgggtagaattgtcatttttttttttcctcagagactgttgtgtgggcctagtggtgcatcaggttccggttagaatccagtgcaggccgcaggcttctctttaattagagagggtcacttcacctccggttagaatccagtgcaggcagcagcttctttttaattagagaggggtctgggtgctgagcttcccatcaggaagaaggggctgtcgtgctgaagtcctgaggtgggtcacgtgtcccttcctgtgttagaaaaccgtctttggtgctcctggggctcccttacaagtgctgttctgaactgttaggtcattcagagtccatctgcgtcctgtccccagggatctcctcaaaccctgtttagactgctcatagcctttccctttttagcactacagcgggttctttctctgttaattttttgaagctttttctttctctcatttcggtggcaccttgggagggatgggagttagataggtgtttgcagtgggccatcttgagaaacttctcaaaactggagtcttgtaactgcttgcattttgaagttaatggaatgggcgcattgcctttatagctgtaaatgttactgcttcacttactgttagcccaagccagtgtgttgcatctgcccagatccttctttgtggtatgtgctcactttctggcgacagccaggctgttctttgcaggcatgtgctcctagcagtcgaagacagaagtttgggggcctgtgtaggctgtatgggctgctgtgtgtgtgtacgtggtgagttgtgtctgagaccacccctcctcccctgggtgctgcctgatctgcctgcatgaccgctgtgggacaccactgtctctggtgtcctttcctggctggcagtgtggtggtgtgggcaaagccaggctggtgggctccgatcttggttctgcctttgtaagctttgtcacactgtcttttgggagctcgtgtgtgtgtgtgtgtgtgtgtgtgtgtgtgtgtgtgtgtgtgttttcgttttctgcctgtaagataaactggcatgcagtctacactgaggtacgggctgtgtgggccagcacagcatgccgtggtcctaagcagggaggtgtccttcctttcccctgcctgttggggctgcgcttccctgcctcgtgtggaggttgcgcccggtctgcagaaggcagagagcatcttgttgggaagagccctgcctgccttcccgttgctgtgctcctgcctccctgctctgctcctctcaccccttcctggaaactacctaaaatacttggttacttcttttttgaagatgtattctctgtcctagtgtttgggtgttgatacagtggaatccacaaaattgaataagatttgattttcattttaaagtgaaataaatcatttgggtgcatgttgggtgaaagtgccgtaattgatagcatccgtcatcagactttaattttacccctggggtgtaggagtgggtgggattaagtacaaaatctgcagaagccaggaagtgaaaacgtactgctggatttctgtttttcacatgtccccaacaatatggaccatttgcattaaacttaaatagcaccacttatttaagattcattttttactcttgttctgaaatcacaagttccatttgacagtgataggacaaaattatatttttaaactttgcaaaccacactccagagctgtgctaaaaataacaatttcttgtgtcaagaataactttctcaagttcctggaggaggcgagctgactggtggcaacgcagaccactaaagcttcagtgagcccagaaagtgtgcgctcagtcccacattgcagaggcctctccgtcagtattgagatggtggaaagtgaggagaagcaaaaagacgactacttctttccccatttcccggtctggtctttttggggtctactacgtagaggtgcatcagccagcgctaccatggaggcaggaggcattcttttgctctcgtgtcagtactgacggggttgattaaggttgctgtgcttgttggtgtgggtattgggagggtggtgtgaaagcagttgggctggaatagagctggtcagtgtgtccttttgcgtgcatttgtgtggccctagtgctacagtggtgtcccttagctctgggggactgtctgaatttttgtgctctaaattattaatacatgtttatgtgtgggtttgccagaatgctgtgtccgttattgttggctccttggacagctctccttgttctgcttcactggctgtgaaattggttcacgtggtgggctctgggtccagcgagatgcatctgaggtgttgacctggtggtgtgggcctggggctgccagtggtcctgttgcctgatgagggagaccgttcctgaaactgtggcgcacactcaggagagtaggaaagagagcggagaaagccttccggttctgagcttgtggctcttgccattcctgacttgtttgttgtgcgaaccaataatttcctttttttgtttaagccaatttgagttgggtttacttgcttgtagtggaaaggttctgacacaggatctttattatatgaagtattttcataatgtacattgtgttatatattagacatatcacacgatctattttgtgatgtagtttgctttgctgtttttattctgtggaagatattcctgaatttctacacttcctatgaatttggaagtggggtgaggcaaagtcactaatatcggggtatcagtaggggagcctttcgaatcccaaacattggagtgtccttctgtgacccgtttctttgtcaacttttgtccgctaggcagagtggctgtgacatctgacatccagtgtgaaggtgtggtcactcagctggaagagaaaaacctagcactctgagagtgggtggatctgctggtgattttcaagcaatgtcttcccgtttttggatgctcatcccttctgtagttggagccttgttctcttttccttgagtacaggtggggctgatgactcatttcttatgaaccgagcacagcctgcctgactgctgaggctagctcataggattcctgaagctgcaggccctgctttccttcctgcgtgtgccctgggatcactcgctctgtggagtccgttgtccgttctctgaggactcaggaactgaggcctcctgctcacagccacgctgtggagctgtcttggtagcacctcctcagtccctgcaaggccttaggctgccagaatcccacagcttcagctgacatctcaacgacctcccctgagacccagagccacattcacccagctaagctgccctgaacgctgacacgcagaaactgagataacagatgcttgttgtttgggccactgagttttagagtgagttgcctgtagaaatggatgagcagcatctgtgcctggaggtgaagggtggagccaagtgcatgtctgtcagagtccactgctatccatcctttccctgcctgccttcctcctacacggtgctggatcccccagaggatcagcagccgagaggcttctgcgaaagaatgtgctccttcagggccgacttgcatttgtgtctttttttcttggagatttctgtaaaacagcagccgttagcagttatgtgattactgtgtttagaatttgagaagaaagggaaaaccttgtttgccatggaatacatactgtgttgataagtcttccttattttgaataatggagaattctctgtgtcttagccagctaagagctacttacttttatcatgttgtgttaaaatgataaaagttactcttcggtgacctaactgcttcacttaatgagttttgattttgtttttgcaggatgcatttcctctccttcaggaataagttctgttggggaaattatgaaatatggacatgttaccacctcctgctagatgatggcgtattaataaacagttcctacatttcagtgttttgcacccccaaaggtttattatgtcagttatgtgttagctgcagataaggtgttgctctgctccaagtgtctttcttcagcatccaggctgatagaacagctccattttgagccttgccattctcatttaaggaaaaaggataggaggttggctggaacacctgaaggcttccaaggcttctgcttagaaccagggtgctttctttcagcttggagctggtgtctgcctcttctgtcatattttgtccggaattggttccttctggtgggttcttggtctcgctgacttcaagaatgaagccgcagaccctcgcggcgagtgttacagttattaaagatggtgtgtctggagtttgttccttcagatgttcagatgtgtcagagtttcttctttccggtgggtttgtggtcttgctgacttcaggagtgaagccgcagaccttcgcagtgagtgttacagctcttaaaggtggcgcatccggagttgattcttcctcagagtaggttcgtggtcttgctgactttaggaatgaagctgcagaccctcgtggtgagtgttaacagcttataaaggtagtgaggacccaaagaatgagcagcagcaagatttattgtgaagagcgaaagaacaaagcttccacagcgtggaaggggacccaagtgggttgccgctgctggctcgggtggccagcttttattcccttatttggcctcggccacatcctgctgattggtccattttacagagtgccgattggtgcgtttttacagagtgctgattggtgcatttacaaacctttggctggacacagagcactgattgatgcatttttacagagtgctgattggtgtgtttacagacttttagctagacacagagtgcttattggtgtgtttacaatcctttagctagacagaaaagttctccaagtccccacccgacccagaagcccagctggcttcacctctcaatccgccctctaaataggagactccaactgctgttgggaattgggcagtgaccgctctagctacttcctgctggatagggatgaagaaggggccctgaagttgtagtgtcctccagaggagaactatttaggctagtgaaagggccagtgggtttgtccaggggcccttggtagaagttgttagttgagctcatttggggttccatttgtaagaccatctgtagcttgatagccttgattctagaggaaacacatttgaggaggttaaaaatacagggcccgaaggcgagtaatagcaagatggctgccacgggacctagaaaggggagaagccatgttgcccaactccagaggttcgtataagagtttgaaaggcattgtctgacttcagaagccttttcccgtaaacaccgggcagcatctcgtactatccctgactggttagtgtaaaaacaacactcttcccctaagaaggtgcagagtcctcctttctcagcagtgaggaggtctaggcctcggtggttttggagagtcactgctgccaaagagtctatttgggattgtagagtaaggatagatttcgttatttcttgcaaactgagaaatcctttgagagtgtgtggtagtaggataatgaagtagataaactggctactccggttcctgtagcagtagccattcttaaccctataagtaggggtattagttgtatggctctgcgatgacagacttgagctttgaggggtactgataaagtctgatttcctgaggcaatgttaatgttgggacttagaaagactaaggtgcaggtgcctgtccagttggtggggaggcagatataggtcgatgttccacataagaagaatacatcttggctgggtagacagaactggttgtgtatgttaaaaaggtgtgtgagtttgttgttttcattttcccatactcctagagtacttgccaaggtagctctggtgagtggctggaaaggggtgttgggagcaaactgagtggctccctgtgttctgttttcccattggagaaaaaactgttttgtatctactaggaaccattcattagagagagtgattgaaagaggggatgagaaagcattcactagtggtgggggcgctgctgcagggggtccaggggtgaatggtcatgcagggagtatgtttgccattacaaaacctggactgtttagggaggaggtgatgattttggggggccctgagaagtggacaagccgtccgcatggagctgtttgggtgacttggaagttactatgatcagttggggcttgaagttgtgaggtgtaattacactgatggggtggtaggtgccccaggggcaggcctgataacaggttgcattggatgcataaagggacatggaaagttaagatggtattcatagtaacagggccgtgtatgcgcttttcattgcttgtgtaatagatgaggttggaaatgtaagaacgtaaaagttggattgcacgtcctgttagggtattcttggtcttatcagagatggggaagttggctaatgattgcatatttagaagttggaaagggtcttttccttcataatgagggtgataggttaagttggtagagacccaggtttttgcaggaatgggagtggctacgtaagcagagattgatagatacaaagccaacagtcatttgtgagggaaggattggactggtttaacagagagtgggttgagagtcttgtagaggtatttaggagctagtggaaggggaggggtgattgtatgaggtatccaaggaagcaggagggatagatagtcaaagagtaaataggaaggtaaagagggtgctctggaagacgagatcattttatccaggctgagttaaaggtaggagtaaattgctgtcagaaggaaggaagatagaaagaaggttgataagattaggattttcgtcctagcaggagctgtagtatatagccctatcacaaagagtatggttagtatgctgcttaatcatatgatgaaatagtaaaaggattccattaaagggttaaggagaggtgttaaagattatgtaggttttcacttatcttttttaaggaggaaggggtttttcttcaggatcagtggtaggagcctttttagtctgggatatttccttccaaaacaggagatgcaagtcctccagtggttcgcaggtgtatcaaggctggtctggctgatcttgggactcctgagctgatggtcctgcaggtttctcagcgggtgtccaaaatttaactcgggtgtggtgaatccaagattccactcctgccaccttaactgcagtgggggtagagaggattaccgagtgtggtccttcctacaaagagcccatggatggggaggtagaggggagagatttgaccaacactagatctcctggttgaaacaactctgttcccttttctctgtgacatccttcaggtaggattttaaggttttgttgatattttgccaaagaagttatatctttgacgaagttggccgtttcctgatgaagtaggacgtcatttgtgagaaaaggtcgtccatacagcatttcatatggactgagccccattttgtgaggagaattttggattctcaacaaggccatgggcaaaagagtaggctatgggagatgagtttcttgtgttagtttcctttagtgcctcttgagtgttttgtttgccttctcgaccttccctgaggattgtggcctccaggcgcagtgaaggtgatattgtatccctagcgccctggaagggtaccgagttaccacggctttaaaagctggaccattgtcgctctgtaagctttggagaagcccaaatctaggaattatttcatgaattaggactttaatcacttcctgagccttctctgtcttgcgagggaaagcctttatccaatttgtagaggtatcaacacacaccaataattattgaaatcccttcgacttaggcatatgggtgaagtctaaatgccagtcctctccgggctagtgacctattctttgttcccttagaggggacttatgatggaccaagggattattcctttggcacacctcacagactttgactacctgtcagatggtccggaggagatttggccctgtaaatagggatttggccatttgatgagtgttttcaatacccatatgaaaagtttgttggagggttttaagtattttccactggatggctttgggtataagtacctttcctccttctgtcattaaccaccccgaggggagacaactatgcccccgtgaaagtccccattctgtttcagttggggaatactggggcttaatctcttggagggggttgttccataccaagggtccttccgtaggtatttctaatgggaggttcctcctggcagcaattttggcctcagcatctgccctgcggtttccttctgccttttctccttcacttccttctgccttttctccttacactttggcagtgtaagactgccacctccttgggtttttgcactgcgtgcaatgactccataatttccttgtggtatttaatgggggttccctcagaggttaggaactccctttctttccatattgcagcatgggcatgtaggattagataagcgtacttgctatctgtatacacatttattctttttccctttcccaattccaagtctcggttaagtgccactagttcttctaactgggcactggtccctgggggaagaggcttactttcaagtgtcgttacatcactaactatggcataacctgccctttgtattccattgtccaccaatgaacttccattggtatacaggttaaggtcaggattagttaaggggacttccaagagatcatctcgggcagcataagtctggactataatttgttggcagtcatgctcgattggttcgccatcctctgggagaaaagtggcagggttgagggccacgcatgtacatatttgaagcactggtccctcaaggagtagtgcctggtatctgagtaggcggttgtctgatagccataaacttcctttggcacctagtatgccatttacatcatgagtagtccagacagtgagatcctttccttgtgttattttgatagcctctgacgctaagacggccaccgccgcaactacccttaaacagtgaggccagccttttgctactacatcgatttccttagttaggtatgccaccggttgtggggttgtcccacgagtctgagtaaggactccaagagctattcctgctctctctctgatatataaagagaagttttgtcctgtgggaaggcttaaatctggagcttgtactaggttctgctttttaaggttttgaaggctgtttctgtccctggttcccattctactagatgaatatttgccctctgggtctccttgattagagtatggaggggcctggctatctcgctgtatccggcagtccatagttggcaaaacccagtgattccaaggaacccctgcaactgttttaatgtcttagggtgaggataagccagtataggccgtactcattcctttctgagggccctggtccgtctggctaagattaggcctagatatttgacctgctataggcaaagctgggccttcaacctagatgccttgttcccttgatcagctagaaagttcaggagatctagagtagcccactgacatgaggcttctgaactggtagcccaaagtaaatcatccacatgctgaaggaccagagtgcctggacttgagaagtggcctagatcttgggccaatgcctgaccaaacaggtgagggctatccctaaacccttgggccaagactgtccatgtaagttgggatgtgtggtctgtgggatcctcaaaggcaaagagaaactgtgagtcagtgcaggggaatacagaaggcggcatccttgaggtccagaatagtgaatcattctgcttcctctggtatttgagagagcagggtataggggttgggtacaactggatatagaggaattactgcctcattgatgagtctaaggtcttgcactagtctccactgacgattgggtttttgtacccctagaattggggtgttgcagggactgctgcatttccttactaagccttgagctttcaaatgtttaacaatatcctgtaatactttatgagcttcaggccttaagggatattgcctctgataaggaaaagtggtgggatcttttagcctgatttggactgggtgggcattttttgcccttccagattgtctttccaatgcccagacttcagggttgattccctcctcaagtaggggacaacaaatgggtaacttgttccccatattcgtgtagataatagctccagctttggctaatatatccctccctaataagggtgtgggactttcaggcataacaagaaaggcaagtgaaaagagcaaagtcttccaattacaactgaggaggtgggagaaatacctggttacaggctgccccaggattcctcggatggtaacagaccttgaggatagtcgtccaggactggagattaacactgagaaggcctcgccagtgtccaagaggaagtcaatttcctggccctcaatggttaaatgtacacggggctcagtgagggtgatgacaagagctggcgcttgctctgggcaccgtcagtcctgttgttggatcatctggttgggggcttctggcccagagaaccattgcactctggggcagtgcgccttccagtgattgcctcggcatagcggacatggatgagggggtggcttctcgttggacagtcttttttaaagtgtccttgtaaaccacactgataacaagccctactgggtgattggccttttccattttctgtcttctctgaaccaccaaggtttgtctgtctgagggccatgactaaggctgctgcctttctctgatctcgcttttccttttgggcctattcctcttggtccctattatagaacactgaggttgccaggtttagtaatgcctccagattttgttcagggcccagggcttgcttttggagctttctcctgatatctgcggctgattgggtaataaacttatcttttaggatcaattgaccctctagggagtcgggtgacagggtagagtattttcttaaggcctcctgtagccagtcgaggaaggcagaaggattttcttcctttccctgagttatgctagacatcattgaataattaatgggctttttcctaactctccttagtccttctagaacacaggtcaacagatgtttatgactccagtccccatgatctgagttgagtcccagtggggatccatactggggacgacttgctgaccggtagggaatttgtccctttcttcggctgtcattctgtcatttacttgactaagataccaggtatcaccaaactctcgggctgcagctaaagctgcattcttttcattaaagactagggtttgatctaacaatagcatgacatctctccaagtgagatcgaaggtttgccctagaccctgtaggaaatctatcaggatcatctgaaaacttccccaggtctgcctggatctgctttaaatcagagagggagaaggggacatgtacccagcttgggccaaattcctctccccctacagcttgaaggggacataaccgatagcccgggggtttttgtggtcccttggagatttctttgcttatttccttctgggcaggggagattagaggaggcttatcattaataggaaggggagctatagggaggctaggatatgggggtaagctgagaggtcctcctgtgggacataaattgcaagctttgcatattctccttcaatgaaaagaaagctggacataaggtatttcaatccatttgccttccctcttacagaaaaggtcaagctgcaggatagtattgtaatttatacttccctcaggtggccatttttacccatcagagagagaatactggggccaagccatagtgcagaaaaaaataagctgcctctttttcagggtttctgggtcaaattggtccgaatggcttaggatgcatttcaagggtgagcatgttgatgcctgagtgtttcccatctgaaagacaaaaccacctgcagttttggtttgtttttctccccctgcccaagaacctataatggtccctggaccctgctgatcggaatagttgcgctcaccgacgcagcagcagaaacacctcttgcccaagaaccctggaccctgctgatgggaatagttgtgctcgccgacgcagcagcagaaacacctcttgcccaagaaccctggaccctgctgatcggaacagttgcgctcactgacacagcagcagaaacactagtttccctcctagaccacaaggaggactgaggaaggttggatttagtggcccttaccgacgcattctcgtaaaacctgcaccttgcctgtcctcctagaccacaaagaggactgagaaaaatcagatttaatgacccttactgacgcattcttgaaaacctgttaagagtcctaagcgttctcctgttagtattgggactttacttgtgtcctataaagatgttatgcccccaaaatgaagtggagggccataccctgagggagagaagggatctccagggttggaagagtgatgccttttgtcctcacttatatgaataggaaggatacaatttctgaggctccccatatcctagcttcaggaatagcttttgttaggcctgcttgtctgagtaggggtgctaaaattccagatagtaccccctatgacagggctttgggcaaaaattatgtctttctgattggcgggcccgggtgcctaaagaagggaacagagtcctgaaactagaaaagaactagagacagggagtggtttttagaagcaggactagcctcagagaagagaggtgagaggacgtttgtctgacaggcattaggacccaggaggcaagggtcaggatggataggatagatgggcgagtctcacttgggcgacataactttgagagttccgctcatggccacagggtcaaccagcttgttgttgggaccccggagttgaatggctttcctctctgttgaccgttggctcagcctggaagtacaggagaagtggaagctggtaccaggcaaaccaccgctcccaactctgaagagtcgggggttgttagccctttcccagaaagcctgacacgcgtgtctttagtccggtggctgtgctagttgcttttaactggccgacaggtgcctggtatttagcccccgaattctacggaaaaataggacagaatagcaagcaaaaggggtccgatgatactcactgcttggcgatagtcccatctgggtcgccaaaatgtgtccagaattggttccttctggtgggttcttggtctcgctgacttcaagaatgaagccgtggacactcgcggtgagtgttacagttcttaaagatggtgtgtccggagtttgttccttcagatgtgtccattccttcagatgtgtccagagtttcttccttccggtgggtttgtggtctcgctgacttcaggagtgaagctacagaccttcgcagtgggtgttacagctcttaaaggtggtgtgtccggagttttttgttcctcctggtgggttcgtggtcttgctgacttcaggaacgaagctgcagacccttgcggtgagtgttacagctcataaaggtagtgtggacccaaagagtgagcagcagcaagatttattgtgaagagcaaaagaacaaagcttccacagtgtggaaggggacctgagtgggttgctgctgctggcttgggtggccagcttttattcccttatttggccctgcccacgtcctgctgattggtccatttttacagagtgctgattggtgcatttacaaacctttagctagacacagagctctgattggtgcatttttacagagtgctgattggtgtgtttacaaacctttagctggacacggagtgctgattggttcgtttttacagagtgctgataggtgcgtttacaaacctttagctagacacatagtgctgatgggtgtgtttacaatcctttagctagacagaaaagttctgcaggtccccacccgacccagaagcccagctggcttcacctctcaatatctcattggtcagagaaagtcatgtggccaggcctgcccctgcctgtaggaagctgatgggcatcactgggctggatgtagactcctcctcgaagggcagggggagtgaatgaaagcagccatactgtctgctgcagtgagcctgggttagagaggcagaggaagttggaacatagtgtactgaatgtgaaaatttaagtttgggtcaatatcagctcttagaacttttgtctgctgaagcctttttattttagaataatactctttttgattgaagctgtcctggaaaccactgtggatatttctgctagtagtcgtcctctggtcagaggttttcatatttgggagcacaggtgactataagctccctgatgttgcctgtgcatacttgtaaggttaccctaagggccttagcctgccagatgcttgctggtgaccagccgagccccatcttcctcatgtccaaatgagtcctccttttgtcaggtgttagttcaggaggtaaacttaataataaatgtggctgctttggtgtaaccataaaatgaggaatatgctaaaatagaattcctttggaggcatggcaaaaattaaggctggaagttgagtctgggccagattgtagagcctttgatgactggttccagcatctttggcttcagtttcttctgtggggttaggagttggagtgctgggtgcccaggaacaatcagcctgggcctagagactggacagcagtggggaacgggcaccagacagtgacctcctgatatgcctgttacagatggtggccttaggtccacatttgcatgggctcacccctcttccttttttctgctccaaagtctgtgcctccattgggagcacatacagttgtcacccactctgtgaagccctttctgactcatgttacgggtacttgctttctgccgccgtggactactcggtgactcctcctcctcttcctcaacacctagggcgacttttccctaccatctttctgtgtctgtggacatcacctctctcggcccctagatgggaggggtccttaccagccttgggctgcggcctctctggggagagcccagtgccctccctgctgcatccttcattttcctcccggtcatctccaagccgagcctcctttctctggaaccaagtgtgggagatgcagttgtggtacaaaggaatgaatgcccacttgccttaactcatttttttttctcttattgtcctgtagccagctgctgaattcctcaccactcaccttcacctttctctcgttttctgttcagccagctctcttgaccctggtgcttccttgctcgaaatcatgtctttttttttttttgacaatacactgtgtcagaggaatccttgagttttacaactggaagtgactttagaggttagctgattcagcttctctcccttcccaggtgaggaacgggacacccacagctgtgtggagacttatccaccctgcaggtgccagctaaatccttcaaaatgacctttccaaaattaacgccatgttctgacatagccaaaactgtaatgtctgtcatacatgacaaggttagtattgatgtctcaacaccatctgatacgtagtctgtatttacatttccccaggtgttcccaagtacactttgtagatggtttatccaaaacggtccagtgcagggccccttctggcatctggaatctcttgatccagagcagtcttgttttccatggcccagaattgtggacagacttaatgtctggcttttgtaggtgcccagaagctgcttgttcagtgaagacatggtaaagacaatggggatgagatactgaagacatttttttcttctttggctcgggggggatttccctcagtcttaaatattaatgaagttcggccttcaattaaaaaaccatgcccttggtcgtcctccatgccattgtcttctgaacctaggacttgatccccaggcttgttggctccttccagtctctccccagtgtttgtccaaatccccatcgtcccccttgttcctgtggctgaggttctccgacctacgattgcagaaatcttcctcagatagtttctctgcgtctcactattttcttctatggtttgtatagtttagcaccttctagccattctattttatgcccaaatcgctttatatatggcctgtgtatttcacagagggcaagataattttcctaaacagtgccagctacaattcagcttcctaagaagcaatttctggaaagcactgcaagagaaacgaggtccagtaaacatactctatgagaatagagttgagaaagtcattgtactttggggcttcattttatctctaaatgagagggctgacctgtaagtcatgtagatgattcttctctctgttcagtgggctttttcttgtggttattttgcatttttaaaagtaagagttttccttggcagaatggagttatctgtaggtctgttttgataagtgagatttggtgtgcccttttctttttgaaagtgtggggcattccagttgctgcttcctgtcctcaagcatgttcccctttccctggtgaggatgagaagtctgaggtctaaggggcccaatgcagggctgtagcaagcaggtggtcagggaggctctgctccgtagtctcagccctcttccttcttccagcaccgccgtgtccttcccacaacgtgccgcattgtgttgtgcggttcagtgttagaccatgggaactcccctccccgccacttttaagaaggtatttttctatccttgtttgaatactctgggcttcttttatccctgatttggtattgtatttgattatgtagtttctattgagagcaaaataccaaaaataagctaaggaattttaatgttagttttctggtggaaaactggtaggatgatttcattttgggagtatcggatcattctattgcacatttaattcacttaaatgtaaaagtaagggtgagtgtttgaaatacgctttttcaaatggatagatcctaaagcgtattatggtgcgaagtgtgtctgtgcagccacccttgtccccagcatggtgcctgtgtggggtagtgcaggtggcaggaagtgtgcctgtgctggcattgaggcttcagctgggcaggattcctaatgaccttccttacctcaccaggagcgcttctcacgcttggctgtgtgttggagtcacttggagagggttggcattttgatttgagtctctggactccagaacactgctggagtatcctgcccttttacagccccccaggaggtcttaacatgtagctcctgctgagaattgctgctcctgaggctgaggcttccaaaaggaggcctggagacaatggaatatggtttgtacttccttccctcctgctgctccttgccattgccaagagtggaaatactgctaaagcacccagcaagtcatggtggggaatgaatgaatcccgtctaagacacttgttttaataaccctagggaacaatttagtgtgctaaatgtcatggtaattcttacatacacactgatttactttttgcagagagatttctataaaagttttgagacttccctattattcccatagtacaaaatttctctgtactcagatttttctgtttctgttttttgttgaatagatttctattttaggaaatagtctgttatctttctctagagaagcacttcaatcgaaacattttgttggctgagaatgtgcattttccccctctcaggggtaaggatttgcctcatctcattgtctagcttcctgttgagaagtgtggtgtgtgtattcacttaaactctgatgtcatattgaagcccattggtgggcagtttcagccaatcagatgcttcctgggtatccaagtaagaaagatatatagttctggaataacaggaaacttcacatttttcacatcctgttattctgggttttgtgacttgctgccttgccactatgaaggttagtagaaatttatgtatgtatttctttttgtagtatacaaaattgacaaaataaaaaatgacttgaattttcagagcactaagattagatctgtagagctgaaagacattcagatctcctatttaaaaatgttatgatgaagagaaattttatgttttgcatataaggaagctgaggcctatttaattccttttaaaaaatgcagcttaacccgtatttgttataggtggttatgtcagcctagatgctgctctcatttgagttgggatttcttcttaaataataaatattacaacaaatgtattctgtatgaaagatgattctaaagactatctgttctaaggactgttttttaaaggaaggatttagcttcatgaaatcagttatattttgtgccttttgttagaaatggcatcggtaagcacatagaatgcttagatgtgttcacagctttccttttacgttttgtggttccatctgatatttccttgtgaactttaagaaagtgacctctggttttcagctcctttcttgactcttttagtgatttggtgggtttttctcttgaggtagtttttcaaagtctggttcttctttatttatgtttaaacatctcatgactatttttacttatttggaaaattatagacagaaggcctttagctgcagatgaattttgaataatacagcaggactttttcacatttggtgtcacttttcttagcttctcttggcgtgagcttcattacagcagcatgcggtgcctgcagggtgggtggctggttggatgctggtgcacgtctccattcggatgccttttcactgtgcaccggcccctgtgctgggtgttgggagatgtacaatctgccactgcagatttttagtctagggaggcctgtagacatccaccatcaaactatcatgacacgtgttctgggggagcctggctggggacctgaccgggtgtggtgggggcagccaggctgtcaaggcagggctgtgtcaggaagcaagatgaataaggattagccaggaaagggaagggaccgaaggcaggaagaggaagaagtggggcttctggcagggtctgctagaggtgtggggagagggcaggactgacaggaggagacgacagccctggagagaaggtggggcccttgtccactgatgcttatttccggtaatctcagttagaacatatggcaacaggatacacgttttggtttttaaatgtatctttctgttattggcacctctgaaagaatttttttcttaatttttctggaacatagttgtggacgatttgactgtttatctttgcttgaggttatttggtgatcagaagccatatgtagtctttgggcagtatctgagatgagagctctgtttgttttgacatggctgtgtgtgtgcacacgcgttctagacactagttgccacatacctaggcaaaccaatgtgctttacctttccaagctccaggatggtggtgggaagtgcctgccagtggcaatgtgaccagctccatcgtggtcccagggctctagatagccctggactggaggggatgcggttgtgggcttgcctggttctggcctcagagctctgagggtggtggtctcttgtccctgcccctttcctatctgggatctgcttctcctgtctgtcctccttttaccctcacatccactctgctctctgatgtccgcattttcttttgctgctgttagctttggaatcgactgtcattttcccttattttctgtggctaggaaagaacatctgtagcacgccttgcctggggcctctgtgttaatctaaggagaggaggattgcgcaagcaccgtgcttgcttgctgaatgccagcagcccacccccccaccccgccccgcccccgtgaatgagctcacactccagaggggcaggggcgggtgttgggtagggaattggcctaatgccgaggggggaccctgcacctaagtaggagaattttgattgggttcttacctcaggactgagagactgagcgtgctggtctccctgtcgcaggttgtgcggtctccttaggatttcaggctgagcatcgtcgcgttgctgggagaacttagttcatcctgcacccaacataagactctactaattttgcttgtttaatttttcctttcagacgtttgatgcaaatgatttgtatcaggggcagaattttaacaaggtcctcagttccttagtgactctaaataaagtaacagcaggtaagactcttttttattgaactcgagggggtgggaagacatacgggctgacacctttggttttcttgttttaccaaagccaggggagcattactgaatttaaaaaataagcttttgttgcattacgttttgattgttccttttgctgtgatattttatttgccttgttagaatagaatcttctttaaatgttctggtatatatcaggtgttttcctttctgtgggtggagagatttctcacctgaacgtatagcaggagaaaagtgtctagttcttatgggaaggctcatgggctgtgttggagctagaagcacctttctctcagtttttactgagtgtatgctggttaaaatttgtatctagtgggcagaagttttgagctgtgaccatgataagggagtggctcgtggattggcctgtaaagtccacactacctgtccagggctcctgagggctgtggcacccaggtacatggtgtgtgtggtcctagcccccattagtactgaagtggagaggaggttttggggacatggtgtgcccctctcatgggccacagcgaagacaggagttgttcagacaggtcctctgagggaaggtgcatgttgtccatgatgccaaggtccccggaggaaatgctccatgagccctgaggagctctttcttggatttctgtgtggctcaaaaggaaggaactttttagttgcttttttggtcttattagagtaatttttttttcctatttaccttcacggatgttaaatatcaggtttgtgggggaaagtgccgtgtccttttcaaacagaaacctcctgagttgattttgtcggggtcgcttctcagcttcgtctggcccttcagaggggggggtgtacttgcctcactgcacattgaggagagacgggggttatgcatgctttggggctgcagttcctggctcccggaggcttcatcggtggtgcagggactgtccttggtgctgcctcccagcgcatgtgtgctctgactgctgtctggaagctgatgctgctgctgctgatgctgatgccccggcgagaggcactggcccccatccctgggagcaggggcagaccccaggcagaggtgtggctgtggctgcgtgttcacagcttgacttctgaggtttaaaggactgttcagatgaaagcatcgaggaaacaaaaatttaaatggcaggattatgaagatggatgtaactaatgaaaattgtcacattatttaatgccttctctgtctctacaatctaaaaatgatccttttaatatgaacaaacaataagaaaatcacagccgggtgtggtggctcatgcctgtaatcccagcactttgggaggccgaggcgggcggatcacgaggtcaggagatcgagaccatcctggctaacacggtgaaaccccgtctcaactaaaaatacaaaaaaattagccaggcgtggtggcgggcacctgtagtcccagctactcgggaggctgaggcaggagaatggcgtgaacccgggaggcggagcttgcagtgagccgagatcgcgccactgcactccagcctgggcgacagagcgagactccatctaaaaaaaaaaaaaaagaaaaagaaaaaaaaagaaaatcacttatctaaagttatggatgacattgaaaaggacatacatttagagtggatcactggaatttaatacaagaaatactgcaacaggtgatgtacagaagtggcatattcatgtgtcctgaccacatgggggaatctgcctgcaaactcatattcatccatgcctcagagttttgaattattttttatggaggcagggtcttgctctgtcgtccacgctggaacacagtggtgtgatctcagctcactgaagcctcagcctcctgggctcaggcagtcctcccacctcggcctcctcagcagctgggtctgcaggtgtgtgcctctgtgcctggctaatttttgcatatttgtagagatggggtttcgctgtgctgcccaggcttgtcttaaactcctgagctcaagctatctgcctgccttggcctcccgaagtgctgagattacaggcttatgccaccatgcctgtcctaaatgatgtgccttataattaacgtagatctctgtggcagatggggcaatagcacagatatgtaaaatctacaagtaatccttaatttgactctgctcccattgaatacttttttagaggttgctcacaggagcagaagatagtaactttgaatttcattgtagatgttttctctgcttttgctgtaagtgggggtgctaattaggacgaagtggctttagaacatggctttaatttgtacactcagtcttgggattgtcaaccatctaggtttgagacggtaggatttacaagtaaataagagaagtcagaatccagtagctctcaggctattagtttttacctctaccttatggaaatgtattttgtatatgttcttggtatcattggctatgtgttggatgtaaaatagatagctttgttctttacaaagacaaatttggaagttaccacataaacttggtacttttaagcttttaaactataggaatgacccctcctagatggaaggaatgctttgcttttctgtttgccctttgtttttgtttttgaagtcagtgggaaggcaatacccgtacgttttctttttgagacagagtttcgttcttgttgcccaggctggagtgcaatggcatgatcttggctcaccgcaacctccgcctcctggattcaagcgattctcctgcctcggcctcccgagtagctgggattacagacacgtggcaccacacccggctaattttgtatttttagtagaggcggggtttctccatgttggtcaggctggtctggaactcccagcctcaggtgatccaccagcctctgcctccctaagtgttaggattacaggcatgagccactgcgcctggcctcgtttctttctagatttcagctttccttgattggcaaacagtaagacaactgcagcagccacagttactgtggacattcttgggaaaattgtcattgtctttctgcttctgtctcttaaaatcatatgtgttctcaaggcatttagttgactgtaactggccttttaattggatagaagaaagcttggtgatggggaagtacagaatgtcttcaggatggccctccttgtatgagaatttcctggaaggctgtggccagcagagcactgcagaccatggccgggagccctgtagaatttgctggaaatgcccttttagctggttttgtgctgcgggttgcctgagacccctgtgttctcaagcagaatgtgctctatagagattactcgtaacctgccctcagcaggtcctgggaagtgtagggtgagggggtgacctgagaagaatttaagatcgttggagtagcaagcccccatctgtggggtcaggcaggtggcgtgaagggaggagctggatggaagggcatgggtgctgggtcctctcaggacagcccctgcccagctctgagccagctttacctgatgggatatagacctggtgtggccacatcctaaatgtgtcaagagcagtggggaatctgggtttttggtgataccttcagacttttcgatgttgaccgtttaattcagaattttataagatacgtgcaagccaatccaaacacctgggaggaagctgggacctggagacttagggttgctttcatggaagcctccctggagtttaggacatggccgggcacgtgcctctcagaacagcgattttcccagcaaagtttttcacagcctcattctctcttttttttaattgagtcacttttaagaataaattgctattatttatttgttggatggcctgtgtggagtgtcttatgaagggagatccagagaacagaactaagcctcttactgtctgtttactttgattctgtcagcaacttcatgaggtgagtagagcctgtgctgccttagtgttggggaaataatcctcacaaggttctctctggctgaaaaatacactggattttctcttttaaataagagtcttttccttctgttgcttattgcatgacacatcgtcctggaaaagtgggcatgtggtggtgatgctttggagaatcagtacttggttgttctccgctccataatcaaatttgagaggcttttttttccaggtgaagggaaaatctttaaaagttataatacatttcacaaacttttgaaaattatattagagaagaactgattaatagttatctccagataatttctggaaaggtagttggggaatgaatgcaagtcatttatgtagcaaataatttgttctttgttttctgcataaatgggctgctttgttgtggtcttttggtgtgtccctctgtgctgccctagttttaaagtctagtgtgtagtgtgggtgcgtggtatcaggcgctctcagctctctttttctgtgtgcatgctctttgcagacatcgggctggggagtgactccgtgtgtgcccggccctcgtctcaccgcataaagtcttttgactcccttggatcacagtctttgcacactcggacttcaaaactgttccagggccagtatcggagtttggtaagtttgagagattttgttacttaaatatgtttgggaaggatatgagtgtgtatggatatatctgagaagatacgtatgcctccattaatggtgttaaacagggcaaaggtagctggacttcgcctccgttgtgcctgtaatctggtttggcatttgctcattaccagatgatccagatattatgcttaatgattgcttttgagaaactcatttgtttttaggttgtattgcaagactcatgactcgatatctggagtgatgctgctttaaaaaaacacaccccttgtcatttgcatggcattatcagctatgcacatgtacagaaatattgagaataagaaatatgtatggaaaagtactcagctccgtaaagaagagatggttaaaactaaagaatctggcctttcttctcttcatgaaagcatggcttagtgtgctttactaagtcaggatttagtttacaggggagggaatcccttagaatgactgattgggacgcagagaaagaaacttagatgatcgaacagttgtcgtggagagtgaaaaaatactcgtttaaaaatgctcaggatacaggctgtgagtaaagcccatggaatgtaatagtgaagttgaaaatgagaaactcaagcagggttaaacagggctgcctgtagagtgttggggcagagccagggctgccactctgcagtcctgcacccttctctgagctgcagctggcgggcagtgacttcgattggctgctggggataccactgctttctcgcgacagtacatactttgttagaaacatagtgatcttgtaacgtgagtctagagagaaccctattctagagtcatgaagggtccatggattttcctctgccttaacatgggggagtattgctaagtaagctgatggtggtcctcaagaaataaaagttaatttagatagagtcgtgatttgtagagggaaataaattacagtggtttatgaagcatgtgtgaaaaatggaaagatatgcgaggaatgtgatttttatgtttctgaactttttgaactcaagctcgctatcattgctgtgtctcctcttagaggatccccgaggggtctgactgcttcaggcgtggtgggcggtgggctgcatggcctgagtgctgcagtcctcacagcagccccgagaggcctggctgttgctgtttcctgctttgcaggagcctgttctggaagaattctgtggactaccattgggagcattaggattccaagttaaagaggactaaacaaaccactttaaacacacttgaaatgagctctgtaaaacacatgaggaaaacataagagaaatcagctcgccttgggtaaagctgtgatttgctgtctcacccgttcactggtggcaattttcatctgatttttttttctttttgagtagaggactagattacaaatgtataattttaagtaaaataaagttaaatgtaatgtttgttggtaatgttactgagatcatagtaagtattggattaatttttcattagctgctgaaatttcgttatactagaaatagacttgcgctctctgacctgtgtgaagtctttttgggctgatgttttgattgggtgctagagagctgctttctctttgatggaatgtgcaagacctctctcagccatgctaggtaagaatgaatgtttctttacccttaggtttttctgtgtagtttatcgatagcactttgtagtagttttcttggattaaaaattaagaacttatcttgaaacaagaatggcctaacattcctttgaagctgggcagtggatgcatggagggccacctgtcactctctccttttgtgtgcatttgaacatttccatgataaaaagttaagctaaaaggcaacttgcagtttcttgaatgtcagttttgagatcatattaaacctaagctttgagattgcgtaagacgcttccatcccccaggcgaggatctgtgttctgaggggctggtgttgtttatgcccctttgctcttgtgttgctccttcattacctgcctccctttcagtgtaagaatgtgtcctccagccaccactgcagttgctggttgtttttataagcttgtttttcatctgtgaaaccgtcagccccctgcctcgggacagatttcctgtcttgggatataggcaggcttgaacagtttgatgttgcgtttactgctttgcactgcagtggaggttttcacttgtctgcggtgcccctccaccattccaaggaaagaacagtcaggggagagttcttacccacttccagaggctgaactaaatcgagctctttatccagttcggctctgtgatgggcctcggtggtgaagaatgtggtaggcgccagttgtagatttaggtatggtttttctcatagataaggcatgagttcatacttcactctttgttcgacaccgctggaattcctggtgactgctgtgcttttagtcttcaactgctggctgctgattggtacagccttgagtgctgaatgctgttctcagagtttggggatggcgtttgtgaggtgattgtccccatcatccttcatttctgggagaggtgacttgatttcttaaagtgctgcttctgcttctggaaaccagggacctgtacgtctggcacagtcctgatgctggcagctaaccttggctttggaccagtcaccgagtgtatttccaagacatgcaagaaattatatccaaatgtattgtacacattgttaaatattttcatataccatattttgtcaattcaaagacttctctttttaagtcattttaacacatctggaagtacgtgtatcttacagttgatggtatgccataatgtaattgacagtatttggtggaatataaaggcattgtctaatttttggcatcttatattggttgacatgaggaaactgaagcttagagaagatatttacccaagatcacagcactcagaaatagtaaagttggagtaaaaattgtgtctccgtcctttggcaagcatttctccttctgtaaaggaaattataggtgctcttagagagcggaggagagggtattgttggtgtgaagcagcactccagagtgtcctggttttggattgttagggtaatttcagaacatgggatacaataaagtaatcaggtgattaatatccaagatactgatgggtggtgctttggctccaggcatcagaaagaggccgttaaggagcatggtgggcatagatgactgtgcccggccaggtcgtgtgtgcctggatggggtctcttctccctttgggttagggcagtgggggaactgtcttcactcccctccagttactaaattttattgacacgtaacgtacatagaaaaccagttcatgtattgtgtgcatacagcgtgatgtattgcatgatgaagttttatacatggaacattcccgtgtaagcacccagatgaggaggcagagcatgaccagcctccaactcctcgatggagcttgcgttccccaaggtatctgctgtcctgatgtctgatggtgaagatgagttttatccatttttgtattttttttagcaatgggattctgtggcatatccttttgttgttgttgttgtaacgactggcttgtttttctcaactgaatgatttagattcccttagagtgtcatgttgagtccagacaggtaacaagctacagtttcaggagagctttttaaaaaagggaaaaaaaccccacaatgataaaatagtgatgaaatccatctcttccagcttcctgtaacactactgacagtgaacggacccctcactcagctgccgtgattttaggctgaacgtggtagtatagagtgtgtagttggaatatagccttttctaggacacccttttccagccagtcccatgcatcttgcgctctgatggagcacttcttggcatgttctaagtaacctgtcttgagagtaataggcagaaagaacattacagagcccacatgtccttcagtgtaatgactgctgaagaatggaggtatgttgcgacgtttcacctggatacctggatctgaaacagctgcctgccccctgtacccttccttggattccccgctctcttagacgccgccctttctttctggggtgttgcattgatgaagtaatgtcagtaggcgtgcctccctcacccgtaccttaagtgtagagcgtgcatgcatttgcacactcaagactgaggtggaactccgctgcctcttgatcatacctcatctcccctctgcttccattcaggcctgccctggcctcagccctggtgctggctggagcctcagggctggccaagggtgatctcgggcacctgacctgggaaggggcctgctgcgcctgcgttgctttgctcaccacagctgtgttctggcattggagctgatcaccagggtgcatgcactgtgagcctgttttccacaaggccggcgtgcccaggtgacgttggattacttacaggagagcatggtcgcgatcacagcagacagctagtgagtggagatggtggtttgcaaaaagagaacttgacatagcacagtgaactcgggtcacgtttcaccacacaagagcaaggaacacgtgacagtttctggatgggatcttcagttgcaatggcaaacttgaccctgccccttgttggtcacagggcccagagagctttgtgtctgcgctggtaattgttcgctggcgcttttgttgccaaacactgaagagaggcttcttgattaaatatgaaatatgcattaagtatttcacttatgaatttgaattactaaatacatatttataattaatacttaatctgtaaacacatttaaatagataagtattaaatatttttggaataatattacagctactccttattgaggatctgttgtgacctctttgctttgatgctttaccttttaaaaatgttttttttttcagtgatttatacattcacttaaagtcaggtgattcgctgagacctgctattaggaaaaaacagtagggacggccacttttaatttttttccactagttctttttttgttttgatttttatggtgcatagttcatctatatttatggggtacacgagctgtcttgatacagacatacaatgcgtcataatcatatcagagtaactgggggcatccgtcccctctagcatccatgacttctgagtgctggttcttaaggagtgctttctaatgcggatagttgttaagtttggtgtcctgcggggctgagggggcgatcttgctggaggattgtatttggctgtcctgctcctccgttggtgctttgtaggtatttgcctgtgtgtctctaaataaagtgccctttttttttgtttttccttaatttggggtgatatcaatgtggactcccacagagaaagaggggctggtgctgttttcctcccctggccccttgacctgcataaatgcctaggcctgtcgtccccatggctgagttccaccctggtttcactgagatcggtgttcagggtaacatgacgaggcgaataatatttggagcagagccacgttgtatgctatgactgttcttacctttctaatattttgttttcgagaattagtaattctcgtttctttgtttagttttctgtgtatgttttgcaggttgcagatctagtcttttgcgtatttctaagggtctctttgacattcaaacacattaatttttctcttctcttcccgattaactaagctcttggagcctgtgccctacttgaatctctcttggttgtgagccaggctggccgcacagctgctgcctctgagccgccttccattgtcacctgggacactccccctgactgtgtagatctcctctgcctctttcttttcagtttttttgttaattcccctgttttggagaagcacatttttaactccttcagaaagtggtgcgtgggaggtaaatttttgagatcttgtatatctgcaggtgtctgttttattaataacttttttgtctttagttttcagaagtttaatttatggtatgaattggtttgaatttctttaggtttatactagttggggttcacgcaggttcctggattggtatatttatgtcttctgtcaaatttgggatattctgagccatattttcttaccctgcttttcagctctgccctcttagactcagcttctgagactgataccagtgtttgaagttcttttatttcccacaagtccctgggactgagtgttgctggatgggggggtgatgattggcctgctagtggtagagcgggggctgtatgtcaagaagtgtgggtggtctcaggccttccctgtggctgggtggagggcagggagaagccagtgtgggcagatggaatcacctgctgccacctggtggggatagaggcctggactctgctgatgtcactggtggggatagaggcctggactctgctgatgtcgctggtggggatagaggcctggactctgctgatgtcgctggtggggatagaggcctggactctgctgatgtcgctggtggggatagaggcctggactctgctgatgttgctggtggggatagaggcctggactctgctgatgtcgctggtgttccctagagctctgaacgttctgtgcagtctgtgggacactgcgttgcaggtgggctgggctcgcttaccatcagtggtagggaagaggggtgggccggggctgaggtctgccaggcggcccttttcttgctcctgtgccggcacgagcaggcttctcctagggttgtcaggctgtgcgctttggtagttctgcatctccagcctccagagctctgtccggggcagatggaaatcaaacaggccccagcccctctgccttcctctttctgcctttcagaaatctgaaaatatgcacagtttctgagaaaaatgcgaattaaaatacgaggtactgtttcttgtcagtttggcaatattgagtgttggtggaagtttgaaatgagcacttttagatactgttgctggggatgttgcttggtgtagtttgtagaaactttttggaggacaatttagaaagatgtattaaaaagttaactgtaataaatatgtcttctgaccagaatttaatgtatagctggtttacaggtatattcaaagatagacatacaaatatttttaatgcagccttgtctacacaaggaaagtactgtatatggtatctggaaatatactggaaataatctaaaaatccactaatggagagtgggttccataatgagtggtatagtcatatagcataacattaagtgttatgtaagcaccagtaagtactgccagataaatgacatgttgtcttaacttttgtgacttgtggagaagtgcgtgtagtgtgactctgtctctgtcacatggatgtgtctgattaggcatcacagtggcagaccaggacctttgaatgctgtgaagagggtgtcctctggggctggagtggtgctggtggtggtcatggggcactggaagggaggaaactgaaatttctctaaatgtatttctactgttgggcaattatgctacctttgtactagtaaagtataatccattttataatgaagtagactgttcttggtataatttttctcccactcttcttccccttttaggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcggtaagtggccgagcctgggctgtgtgtggctttttgcgatgagcagaaagaagtaaatgtacttgacatagtgtttactctccagctggacctgtgcaaatgacctggtcttaggatacagttttttgttagatgtaatggattttcacctcagccccacattggggccctggcatcaagggctctctagttactagccagcatttcctttcatcctggcattttccagacgtgaagagaaacatctcgaatctttatcattgcagttttactgtgaaagaattgatctttttttttttttttaagagctagtgtcaggacttggagttggcagtccgcaggctgtgtttaatttttgtgactatgggtggtacttttggcagtggtgtgcaatgaagtaatttctgtcattctctttgtactagtgatagtattttacaaatgcattgcttccttatgttttgtagttgttcacattgtttcactgactttccgattttgaggcttgtgttcttatgaaagaatagtgatcctcggcacatggctatggctgccgggctgtcgtgcttcttgtggaagcgtgtgggtgggtggacagaggtggggggtgggatttgtgaagggaacaatcatgtgtgtcactttacttgcatcctgccctgtagttgaaaaacaccgttgtatactacagttcctcagattctgctggggaaagagtgacttacagagaatagctgatacacagggagctgtggaaaggacatgatacaaaattgtagctctgctctagggcttgggtgactgagcctcagagccacaggtgtttcatatggaaaatgaggatgatagttctcccttgtgcggtcttgtggggttgaattgttaaggtttatactatgtgtatggagtctggcagagtaggagctcagggaatgttaatggctgctattgtttttctaaggtagcaagaaaaaaagatttacaaatgggaatatgacaattttgatgtaaaaatattttctcagtgacctcagaaaacaagtattttaataaggcagatggcagcccttatttgtaaacttctctggtgttggaatttttaggaacagcacctgcctgttcttattgtatgtatatgtatacatatatgtaaagcagttcgccatttttaccagttctaagtgtactgttcagtagcactaggtacattcacagttttataaccatcaccaccgtttatctccagaactgtttcttctcaaactgaattctgttcccattaaacagtccccattcccctccccagcccctgccctctaccattctgctttctgtctctgaatttgattaccgttggtgcttcgtgtaagtgcagtcattttgtcttttgactgcttatttcattcagcataaagtgctggagggttttccatgctgtagcatatgacagagttaccttcctttgtaaggctgaataatatttcatcatatgtatgtacaacattgtgtgttgatgggaacttgggttactttcacctcttggctatgtgaataatgctgctaggagcatggttgtgtaagtatttgagtccttgcttttcagttcttttctgtatatacccagaagtggaattgctgggtcagatggtggttctgtgattaagtctggaggaactgccacgtggttttccccagcggctggaccatgtcgcattcccacaagcagtgcacagggttctgctgcttctgtgttctcgccaacttgtttttttttttcttaaagtaatagccatcctgttggatgtgaagttgctactgttttttgtagttgttaataatgataatttaaaaggcagtattttttattataataaatcgacttgggcagaatttttttccggctgcttgttatgttccagttaatgtataaagtactttccatttgcaacttcagttctcctcataacccttgaagacaagtattgctgggatattaagaagggggtgggttgcaagtacatgacatcctttaaaaaaatccgttcatgtgtagagcccactgagagcgcggcactggcaccatgctgaggcgtggaaatgtcaacttgatagacatcactgttaggagatgcagtttagtctgtgactcagttggatggcactggcctgcatgagccttcctggagacctagggctagggcaggcccggtccatcctgtgagcccatctcctagcccagccccaccagttggagagatctttttcctgggaaccaatgagagcagccctgggccgagaggcctgaggtggcgccagtggactttccaggaggacacttgagccagggcagaggaaggaggacctcgttcgttgctcacctttgccaaggagagttgaggttacagaactgctaagtgggacgcacctttggagtagggacagacgcttgttccagctggtctttctgactttctttaattcttaagtgaactcctcctttaagtgtgaatcctggactgactctgaaccaccacagtaagagtgcaggtgagtggggttttacttttcatgtatttctccttgtggattttttagaagtaacccagagcaaggaaattacgctgaaaagatggggtttgtggatctcaaaatcctctccagttggaagtgattttcagacacatttgaatgtcgtcagtgtcatctgccgtgggaatttgtcttgcagtatgctgttacccctgatagcccacaggaaggcatcgtgagcccccgcttttgagtggactgtgggcccttgagctggcagcagcagaggacgccctccaaaggaccggcagggcgtgtttagaaacatggctctcatgaggaacagtgctctcactttgttctacccgaagccactactcatgtcttaggcgtgtctgagcgtgtgtgcgtgcccggtttcaacgtatgtgcgtgtacatggtgtgttgccatcaaggagctctttgcaggggccacacggaatccataggtgtattagggtgctttagagggacagaactaatagtattctcctgttagttatatatatagatatagatagatatatagatatgaagggaactttattaaggggagtttattatatatacatgttatatatatataaaggggagatatatatatatctacatatacatatatacatatacatccccctattgtgggaccttgtgatcatgtaagttaatacctaataaactccctttcatatatatatagatatatatgtctatatatatctatatagatatatatgtctatatatatctatatagatatatatgtctatatatatctatatagatatatatgtctatatatatctatatagatatatatgtctatatatatctatatagatatatatgtctatatatatctatatatagatatatatgtctatatatatctatatatatgtctatatatatatctatatatatatctatatatatagatgtctatatatctatatatatagatgtctatatatctatatatagatatatatatctatatatatagatatatagacatctatatatatagatatatatagacatatatatatctatatatatagatatatatctatatatatctatatatagatacatatctatatatctatatatatagatacatatctatatatatctatatatagatatatatctcccctttatatgtatatatatatgtatctcccctttatatatatatataacatgtatatataataaactccccttaataaaccccttgatatatctatctgtatctatctatatatacagctaataggagaatattattagttctgtccctctattacttctgtccctctaaagaaccctcatacacctatggattcatatatgtatgtatatgtgtacgtgtacgtatatgtgtatatgtatacaaggtcccacgataggccatctacaggctgaggagcaaggagagccagtccgagtctcaaaactgaagaaattggaggctgatgtttgagggcaagaagcatccagcatgggagaaagatgtaggctgggaggctaggtcagtctcgccttttcacgtttttctgcctgctttatatttgctggaagctgattaggtggtgcccagcagcttaagggtgggtctgcctttcccagttcacggactcaaatgtgaatctcctttagcaacaccctcacagacacacccaggattaatgctttgtgtccttcaatccaatcaagttggcactgagtattaaccatcacaatagggtttgtgccaaactgagacctaagtaactttggaaaatttccctttttttcctgtttattttttaaaattcaagaaatgtcatttttgagcatattagtgatgcatttgctaaactttatctgatggttgaaccaaaggaataaccttctgtccctgttgttctctaattacctaagcatattgtatggaaagtcatgctagttttattttagtttatttatttttaattttattttactattttattttgagatggagtttcactcttgttgcccaggctggagtgcagtgatgctcactgcaacctttgcttcctgggttcaagcgattctcctgccccagcctcccgagtagctgggattataggcacgtgccaccatgcctggctaatttttgtatttttagtagagatagggttttaccatgttggcaggctggtcttgaacttctgacctcaagtgatccacctgcctcagcctcccaaagtgctgggattacaggcgtgagccaccacgcccagcccagtctgagtttaaccgtgggcatttgaggcaagtgtgaaaccacattttttaccgtgttactctagagcagttaagaataaaactctaggatcacaattacattcagtacagcagacttccctctcacctctggctttgcgtaatgtggttacaagtacctgcagtcaactgtggttcgaaacaggtgagaacaatacagtaagatatcttgagagaagagaccacattcacataactttagttatagtatattgttataattgttctatttcattattagttgttgttaatccattattgtacctaatttccagattaaacacacataggtatgtatagatgggaaaacatagtatatatagggttggtatatatacagagatatagctgcagtttcagacatccagtgggcagtcttgtgggtacccccgtggataagggtgggcggctatattgcattttttccagtagtttatgtggctttctgattttggaattaggtttccttttttgaagagtgtgttaaatgtattttgatttatagttaattagtgcttgatttttctgaaaacaaaattgtgccaggttccaaacttagagacttctctgaccatcatgttaggatcatttctttattcatgaaaacactgacttcctttaaattgagggtttctcttctgaattatattttaatttgatgtacaaatagttttactgagtaaacaagaactgaagtttttctctaaatggcacttttttaggctgtttatctccagataaattgaccagatggtccaattcacctctcctgcttccctggggaagtgtagccattggtggtttgccctcttgtggtcggagatggaattgttcttgtcaaggttcaccgttgtgttggtgcttttaacctgtggtgtaggatttcttgtttgaatagtccctctttgaagacagataaaatgttctaggattctgtaataacgatctttctaatgcttgtgtcaaaagcattgtatattattcctgaatatgtacagtacagtcttatggaaggtaaataattgtcacttagcatttattttctgtgcaccttttttggttaggtaaaacccatggatttctatagcattttttttttttttttgagacagagtcttgctctgttgcccaggctggagtgcagtggcataatctcagctcactgcaacctccacctcctgggttcaagcgattctcctaccccagcctcccaagtagctgggattacaggtgcccgccaccacgcccggctaatttgtgtatttttagtagagacagggtttcaccatgtcagccaggctggcctcgaacacctgaccttgtcatctgcccgcctcagcctcccaaagtgctgggattacaggcatgagccaccgcagccagcgtctacagcattttttacaggctgatatgtatttgtgtttcacacccacccacccaccctcactcttactcccttgcttcagaatttcctaaattcaagggagaagttaaggagagaagcagcaaggtccattctggaagtgagtggtgatggtggttgctgtgattggatagaagtggaggcactcagctgcatgtggcacacacggttagcagctgtgagaacacacctcgtgctctgtgtgcttccaagaccagttttctgtgtgtgcatgtggactcaggcttttttagatgattatttctaatgtgctgactttagtcattctcctatttctggacagcttattatctgttgtaaagacatttcttttaaatgctgttttgggggctggttagcttgagatgatgactgtctgtgtttggcagtgatgtgagagcttaaatgggactgtcatttgctgatccacagatctttaacgacattgccactttttaagttggtcacttttaaatattttttacttatttttgacataaagcaacacgcagctgaattttggatgtcgttattaatttagctgtggaggaacagtgtttgatgtgagtataatctgtgcggggaaaaggacaaaagtaccccagaaccttgccttccttcgtgccactggatgtgagcttgtgctgtagtccttcctcctctccggtgaggattgggtttggatgggacacatgaggctgcattacaggatggacctctcagcactattgtttcaagatgtaattgtttttaaacaagagagaagaacataaattagaagatatgggccccccgaggcaggcgtagggagcgtattatagcattatgtacaaaggggtcttggagtagatggtttggaaatgtttctggcgtgtgaaagtgaatattttcctagattggtataccgagcatgtcctcactgcaatgtggctgcctcccgttgtcggtgatgattacacatcttccgtttcaggagcacgtcccatagaccagctgacttagagtaattaggggtcaggttgttagtcttccagtattagagcttctcttttttaaaaaagttttatttgcatttatgcttaagtaattgtattacttacatgccacatgcttgtagcatgtgatagccagtagacggaagagctcatgtggggaagagcacaggccacccactcccacagccctgatccagggagaggcgttactcacctcctctcctctcctacgtagctgcctcgcaactcttcacagtatgcagagacttctctgcttagatttatagggcgtatctcactttattgcactttgcttgtttttttgtttttttttttttctcttacaaatggaaggcttgtggcaacactgttggtgccatttttccagcaccatgtgcccacttgtcccagtgcttcatttgggtaattcttgcacgatttcacagcttttcattattgtatccgttatggtgatctgtgatcagggacctttggtgttactgttagaattgttttggggtgccatgaaccatgcccatgtaagatggcagacttaattgataaatgttgtgtgtattctgactgccctactgaccgggaattccccatgtttttccccaggccactcattccctgagacacaaaaatactgaaattaaaccagtttataaccttactatggcctcttaagtgttcaaatgaaaggaagagttgcatgtctctcactttaaataaaaagctagaaacgattaaccttagtgaggaaggcatgtagaaaggtgagacaggctgaaagctaggcctgttgcaccagtcagtcgtgaatacaaatgaaaagctcttgaaggaaattataagtgctactccagtgaacacatgaatgataagcaatgaaaccaccttattgctgatatggagaaagtttgagtggtgtggatagaagatcaaaccagccacaacatttccttaagggcaaagcctaatctcttcaattctatgaagactgagaggtgaggaagctgcagaaaaagagtttgaagctaatggaggttagtgcatgaggttgaaggaaagaagccgtctccagaacatgatgaaagtgcagggtgaagcagcacgtgctgacggagaagctgcagcaagtcatccagaagatctagctgacatcatcggtgaaggtggccacaccaacaggctgactctctggtctggggttaatgtagctggtgactgagttgaagccaattctcatttaccattctgaaaatcctagtacccttaagaattatgcttaaccaactttgcctctctgcgctgtaagttagaacaacaaagcctggatggtggcacatctgcttgtgtcatggtttgctgaatattttaagcccactttagagacctcccactcaggaaaaaaagattcccttgagcatgttactgcttattgacagtgtacctaatcacccaagagctttgagggagacatacaaagaaattaatgttgttttcatgctgctaacacagcatccatactgcagctcatgggtcaaggattaatttagatttttgggtcttagcatttaaggaatacattttgtaaggccataaatagtggttcctctaatggatctaggcaaagtaatttgaaaaccttctggaaaggatttacccctttagatgctgttaagaacatttgtgatttatgggaggaggttaaaatatcaacatcaacaggagtttggaagacattgattctaaccctgatggatgaccttagggcctcaggacttcagtttaggaaggaactacctgtgtggtgggaacagcaagagaactaaaattggaagtggagcctggagatgtgactgaactgctgcagtctcatgagaaaacttgaatggatgaagagttgctccttatggctgagcaaagaatgtggtttcttgaaatagaatctacccttgctgaagtgccgtgaacattgttgaaataacaaaagatttagactgttgcaaaaagttagttgataaagtggtagcagggtttgagaagattgactcttaattttgtaagaagttgtatgtgtgtaaaatgctaccaaatagcatctcacgctccagagaaatctttcatgaaaggaagaatcagttgatactggcacacttcattgtcttgtttcaagaagtgtccatagccaccgcagccttctgcagccactgatcagtcagcagccatccatatcaaggcaagaccctctacaaagagattacagcttgctgaaggctcagatgattgttagcatttttttagaaactttttttttaactaaggaatgtactttttttaaagacagtgcaattgcaaacttaatagactacagtatagtgtaaacatagcttttatatgcagtaggaaacaaatttgtgtgactcactgtattgccatggtctgaaaccaagccctcagcaacttcagggtctccctgtgtaccccgtttgacttaccttcttcctcctactttcttctaggtttgttctttgtgattaatttgttcttctgttggtttcctctgttggtgtgctaaacgagatgctttagtcttatttgtatttcagtgacatttggcagatacctcctgatgccccattttgttccgtgaagattcaccttgacccttttctctatcctcccacattctgcctttactcacctgtatcttcctgttgcattgtcaaggttgttcacagttacaccagttacacttggctctaaagccacacccagcatccattccccaaatacttactttggtgagcactgttgtggaaactgagaaacacagcagtgggaaaaccaagagtgtcttcccagaagttatgaagcacatctgaggtgtcctgcacggcacatgaggtaagcgtgcaggtctgtgctctctgctctctactggcatccaaaaaagaggagggggcgcttttatagaatgaaagagactttagtggcacagcagccagatgtgctgcgcagacttcatttggttcctgattcaaataagctgacatcagaaagccattgttttgacacacaggaagatctgaatatagactaggcattagatactatttaaaaattattaatatcgtcaggtgtgataatggtctgaggttagggttttgagtttaaagaagaaaagctccctttgctaacactgaagtgttggtgagtggagatgacctcatctctgagacttgctgatggtgcttccagcagagaacacggcgggagcggatgaggcaggctcgatgctgaggactgctaacactgttaagagtctatacgtggtcattctctgtatgtttatgtatatttttaagtttctaaaagtttgggaaaaagtaatggcacaattataacattttcgaacaaagatcgagcgtcttagcagatcatcccttgaacaactcggaggacgtcacctgacaggagggtgcatgtggttcaggaaagcggcaggcagacactgctgagcacgggcagacacacacagacattgactctgtgaactctgagtgcgtgagtaacagccaacaaaccacgcacagagccccagcacagaaggtcggaagaggacgtgggaattccgagtttttcagggccatgtctgctctggtggttgaagccagcggtgatgattaactctggactttgctgggttggtgacacgtcacaaatgaaagcgtaaccactgaaacagagggaagcggctgggtggcttccagtcaagcggaagaggcaagtgaggactcacagaagtgtgttcttctcaaaagaggcagaaattcccagccctgtgatggtggagctgcctcggagtggggagggcattgcacctggctccccggacctggccctcgcccagctgtgcagcgttcctgtgtgtcttggtggactctggttttgctcggggctggctgtgcttcctcagcccaaggaatccagagctcttcagttccagaaaggatcttctcaaggactacttccagctcactccctgatttttctcctgaatatcttactagatgtcttattttgccctctgttttaatccgcgtattttaatctactttgcgtatctgtttgtttcactgtgctgtattatctattcctctgcctgtcagttcattaattccctcctcacggtgatactaacctgtttgtggagatttccattttagtgaccatatttatttgtagaagttttgctgcgcttcagatgttttcagtcttcatggcgccttttttattcgtcgtgattggtcctaattgcgtatctctcctgtcattttaaacgacagattacattaggtcttgattttcctcttatttctactttggggaacctggtccctttatatgccacatccactcacaccctcctggtagctcagtaccttctgtggctgatactgtttaatggtgggcttattcctgatggtgggttcctgtgtaccctgggttgtagaaatatttctacagagaggagtaacatttgcttcttaggggttcccggagacttttttgtcccaggcaggtactggtagtcctgcaagaggagagcataggttggagtggtcctgctaagcaggtgcgggctctgggttttggtttcttctaggctgtgcccccgtctgtgagcagcctgcacacttccttgctatttctctagaccagtgcatagaagcttccagacatctttgcatcagctgtgcgggttactaagggatccagttttatttgcttgggttggagcaggtctgttttcttcctgcgttgggtgtagccccagctgctggagcctggagacaggtgtgtctcccctcccctagtgagagggtttcctctttgcttttggcatgtcatcccctctttttcttttacacgtctatatttaaattttcttgttttcagcatttttcgagtttattttaagaaagggaagacttgctgccccagtcagcccttggaaaggtagcactaagctacattctcttggttccccactcctcaataccagtgaattttattaatttttagctaccagatgggccaaaaaatgctgcttttcttaggatagtagggcagttgagtattttctaatctatttcctggctgtgtgcttttctgtctgttacgaatggccgtaatttagcctcttttaatttcaatgctgttttttggtagaagctactagaaggcttcctaggctgcccgggagttacctgtgcccctgctgccccgcacccctcctgttgatggcacatttcttctggcgtgaccgccccaggagcctggacagtggtggggcaagcaaggagctttgcatcagaagccaggagtggccttgctggggtctggcagccaggggcttcctgtctcccctgcagggtctcctgacagcagacccaccttgggcgtttgtggaaattacgcttcctgattggaagcaagggcacgttgtgggtggcacacttcagcagtgccctcttgttgaaaacgaaccacagggtgttctggggaacgtgatcttgacaccttccattcagcagccagcagaattgggagctcttttttcctaggggagaaaaggcaacctgcctggacttaatctgatttgactgggtttcttctgcctgttttttatttttatgtaatgttagtaacctgaagctttttcttttgaaaacttttttcttacagttcttatagtaaattaattgaattttattaactgtggtgttgagttgtgaggtatgtcttaagtttaaaataacacagctggcaaaatcattacttttaaaataatgcagattcagggtcactgttacgaagttcacttcaccggcacacatgctgacgtgcggcttatgatcgcagtggctgtgattgaggtgtggacagtctcccctgcaatgttgttttctatcctgcctccaaattgtagatttcaaagatgaaaaagtgttgtttttcctcagatgaaaacatttcatagtgttttcttctacaattaaattcttagctgtagaaaagagattgagtaggtaagtgtgctagcaagaatagattggttttcctccttgtagctcttacagtgtagaagggatttgtttcctgtggagttttgttttccatcctgtgggcagagagaattcttgcaacttgcagcggcaccttattttgttgttttcaaccacctggaagtacttaacagtgaggcattgaaggaagatttagaaacttgacagtgaggcattgaaggaaggttgaggtaaacggctccacaggaggaggatccaaagttaaggagcatgaggttggttcggggcattctgggtttctgttgccagaagatggtgcagatcctgaggaggcagttgacgttagggacctgaagccttagagtgtttggggttgaaggcactgttttgggatatactacctcagaccccaggacactgagattgtggatgggggacgcatgggaggagaggagagcagaaggcatggactgtaggcaggtgctgctcacacaccagaggggaggagtgtgttcccgcccagtgagggggttcacatggcaggattcttgcagtggaggtgagctttgagggaaaactggtagggactaagtcctctaggaaatgctcatcagaatttcttggggaagaatgtgggaaaaaacctctccctttcctttgtccccactagccccaatttgatacactgctctgtagccctggaaaaccagtggtaaacagaatccgtagaaccaatgttagatatacagaaccaatgttagatgtacagaacgtagaatcaatgttagacctatctgcccaccccctagaactgttggtagatctaccccatggaactatgatatacacacaaccattgatagacccaccctatagaattgtgatagacacaccctatccatctaaccattaatagaaatacacacatacccataaaaccattgagagacagagggacccaccccatagaaccagtgatggacgccatacactgtctgcagaactaatggtaaagacacagacactgtctgtagaactgataatagacacacaccaccccatagaactatggagagacagacccacccgcacagccagcgatggacacacccacactgtccatagaaccagtgatagagaccccctcccgtagaaccattggtagacaggcccaccccatagagctgatgacgggcatgcatggtgccaggttttgtttggcaggtgtttcttcggcaggtgtttcttcagcacctgttatgcagagtaagtgtgtgttgaatggatgtggagtgaaagcggtgctgttttaaaacatcagaatccttgctggagtcaggactgctttaatggttttgcctggtgtggaagtgaaggcggtgtgggtttttcttgtttttgcccctgcttgagatgacttttctttctcctccttgtctcctgtgagtgatggttatttcaagccctgagccagatcttgcttgtttagagagacttttccattctgagggatctgagtccctaacttttagccctgatgttttaatattgttatgtatctgccaaaatgccttttatttgggtgacgctttatatttaccacactatggaattgtccttgtagctaaactgctttggttttggctggcattcgtggagcagtctcttagacgccttcaacttgaaactgggagaacagggtggggatggggtgctgtgattggccttggtgagccgagcctgagggactgggtttctggggcactgagggtcactgtggatggccttttccttggcttgccatttggcttgttaattcagtgaggctgctggatgagtatccttggcctgtgtgaggggctggaacttttgtcatctttagtactgatcagtaaaactatgttacattttcatttcagagaagcctgtgtctcccaaatcaggaacactgaagagccctcccaaaggatttgatacgactgccataaacaaaagctattacaatgtggtgagtaattgcagaacatttttaaactaactggtttttgactgcctgtaaaactcagcaatgtagaatgtagtgtaaagtacctagaataggaagaaggaaataaagttcattcatctgccacacaaatgtaaccaccattaaggttttggtctgtttccttctaatctctgtatttttgtaattgtatgtttttgttttaatatcatgtatatggaaatgtcccttgctcttgtcccgtaacatagtaatgtgcgtgtttccccatgccatagccagtcttcaaaaatgatatttgaaaaaatgtataatgtgatttgaaaattttatatgcattgagtgccattctgtttgtattcagagtagactgtaagtactttagacataaggcttctaatttattttttctcttaatatagtgtttcccaggattgatgtgtacatatcacatggcgtagaattaggggagcatgtctaaacgctatacgtgttaaagacaggtgtttctggatcctaaaatttgctgcttaatatgttcagtatgtgatactaaatctgtgtagtctaatgctattaaatcaaatgtatagtctcatggtactaaatctgtgtcgtctaaaccttctttgtacctaagcttatgtagcaattgcatgttctatagaaatggaaaataatttattttaaagaatttattaaaattttaaaccactcaacatgataacaacaaagtaaaccctctaaacatgtgtatgttttgaattctggggaaaatgcgcatttgttttgttatttcttcccctactcccaatcttcattttcttcttgagtagatataactatgaacccacgagacctttgaattgttggtgtgaaacagcagttgattggtgtttttgtgcagcagtcattttcttgtgagcatttcattttctgcacctgtgttgggaaacggtgaaaaggtgtggtgcaatggagtctgagcagctccaccacgtggagctgtgccaccgtcttgtgctgcggggcttgcactctcagcttcctcctgagtgcccaccttccatctgccccagcatcgtactgcaggacagactggcctggggacccactcattaataactgtttattgggcgcctgctctgtgcagctctgttaaaggcaccaggatgcacagtgaacagaatggcgggtgcctctcccctcgctgagctcgcacttgggtacgggaacacaatggtcttttgttgcctccatttttactgcttctttttcataatttgacatctgtgcaccttcttgtgagcaggtctcctcatgcatcatgccacttctcttacattagtggcaatctttgacttatttttccttgtatttggtcaactccggatccttttctgccttggaaacccttttcttttgcttcccctctttcttccctttttttcattcatcttcatttggctgcttggactctgccttccatctcaactttgtggactttgagaagatcagactccttttagcgcgtcgtgtggcccacattacccgagacacctgctttctgtcatctctcctagtgctctgcatcgccttcatcccttggcctgttgggcatttactcccaggatttggctctactaacccattcgctttttagtgtgtaatgtagcttatgtgtagttttgtgtacgtagctacagagacagtagatgggttttatgggttgtaggaaaacttgagttttaactcctggagctgccctttcctcttgcattcttgtataagacactgcttttttggggaaggcttcatgtggtgaataacacagccacaatccacagtgagattccaaagggtgtgttaccttctgttatggttcaggtccagataattctgttagaaaaagtggtcagcagtgtttaaattggtgccaagggcattctttagtttctccattaatcttgctttcattaggcactttataaaaccaggcaaccatgcttttttagaaatcctggtgggtttttctttgcattatatattctgtaatacttctcagattgaagcatagtcgatacctttttcgttttccttctctaactgtccttttacagagagaatagcctgggtattataagtgctcttttcttcaaatcagccaactctttcatacagaatgatggaaaacaccttgacctcaaaatcacatctaaattgttttctatataaagctgcatttataaatagcacatggtaaaattacagttgttatagaaataaactcatagaattcatagagaattgtcttttgatgtagtactctcattttacagcagagaaaacagaagctaaatgccttgtccaaggttatacactggttactaagccaggaatcaatttcagctttccttaattttatatttgtaaattgtacataaaaatagagaacagaatacaacacagaacaaaacatgatagataatgtgttaggcatttctacacccccttttgtagtttcgttttcacagaaaactataaggtctgggtgtttttaacctcactgaaagttgaaaacttactaaagggtaagactggtgtggaccaatggtgttaaggaaatttacatgaatgacttgtcttaacttgggatcagtataatggagttgagagaagagtattccatgcgaaagtaccaacattttgaaattaagagacaatgagacaggtatgaatgggatggatatgtgttttcctgctattgtataatagttaagatgaacaccaaaaagacactggaaagtaaaactcgtagtaatttatgtctgttattatgaaccattcagtaactatttctctctcctctccttctgggactcctgtggtgcaattagtcaaatatagacaatatttgagccattgtcttcatactgtcctttaattttttaaacatagtttcctttagttctttggacatatttataacagctgctttgaaacctttatctcctaagtccactatctgtgccccctagagacagtttccattgactgcttctttttttcttgtgtgcgtgtgtgtgtggtcacactttcttgcatgtcctatgattttttaaattgaaaactggatatcttagacctattttagcagctctggatgcttgaaatccacctcccctgggttatactgttgctgttgctgtgtcttgctcagtgactcacctagagcacttctgtagtttatcttcccatagtcactgatgtctatttttatttttttattcttgtttttatttttaattctgtctttctaggattcacttttgggtagcataatttagtattcagccaaagattcaccaaagattgtgcttaaacacctttaacagttcaggtattacggctcacacctgtaatcccaacactttgggaggcctagtagggaggattgcttgaggctaggagtttgacaccagcctgggcagcataacaagaccatgtctctagaaaaaaccaaaattacctgggctgggtggcaaatgcctgtagtcttagctactcgggaggctgaggtgggaggattgcttgagccctggagtttgaggctgcagtaagctatgattgcaccactgcacttccagcctgagctacagaacaagattgtgtccctaaaaaaccaaaaaacacctctgacggtgaggtttcactcttgccagtgatctgtatggggttggggaatgcattcaaagagagggctggggaggagcatgactttttaaaagttaaaggcagtggatgaaatgacaaaggaaaagataaatcttttaggctacctaatgagagtttaatatattccttgcctcaaacagtataagccagatcacaagttaattggaatgttatttgcatcaggtataatacaaggttatccttaatgtctgaagagctcattaagacaaatacatgaagattaatagacaaatgggaaaggttgtgaacaatttaaaaaatggtaaacactaaggctttgaaaaaaaatagttaaactcaccataaaaattttaataggcatattttctgtaatcagtgagcagagatttaaagagagaatctttagttctaatggtggaaatgtaaatccatacagagtttctcaaaagtaatatggcagttatatatagaattctggaagtgatcaagttctttaatttagggctttctctttaatttctaaatttcttgaaatccattccagagaattaacctgaaatatattcaaagatgcttgtgtaaaggcattttcagaggattatttgttatagtaataaattgcaagcaacccaaaataaacagtatgagatgaacagtaccagaatgattaagcgatcagtggtttgtccatttgtagttactaaagtgtacatgaggctttaaaaatacaaaaaacatatattttcatgttaagtgcaataacagaatatgaaattacacaggtgatatgatctcatggtattacaaagttgacatagaagatagaagacattgtgctagagaatggtttctttccagtggaggaattttagcttcccactaatgtaagggatagtgattatgggggaagtctttggcaccacagtccagaatgtgttggagatagaaacgggcctctgaggctagggaggaagccagcgtggaacatggcaggcacacaggccttgggcttggagagtgacggggaagggagaggaaatcaagatctcttaaatgcagatcttttaatttcaattagtttttgtgacacagccagccactactcttgcctctattttctcatgtacgtactgtttgaaatcagtctgttagctgtgcttagggtgcccttgttgtgtaggtagttcagataattaagatccgggcggcttgatgcagtggaaggtgtacagcctttttgttgaatcgtccatgctgcttagcctgggtggccaggagctttggccctagcttcctgagcccagttatctcatttgtaaaatgagattggtaatgctggccctgacctggtagtattaagtggactggcaactggccttaaggcctccagcaaagtgctggaccttagaggtttttgtgtgtattaagaagagtatttaagagcattgggaacagaaggcatcactgaggccaccataccattctgtttgtaaactggaatccccgtagattttgagggtgacctgtgaaagctgtagccaaggtggcctgatcatataattaaaagagacaggtttgtgacctgatgtgcccgagcttggtggatttgacagtgaaagcacactcgttgcccccatggcatggtgactggcatctttcctgatggggatcaaaggaaggggttggatgcctaggctggagagaatgatggtctggagttgcctctcggggggatgaggagcaccccgctccgtcattagagaatgaggtttcttaagtcgctgactgggaagacacagtccttatggccttccctgctcagcgatatacactatggtttgattttttaggctttctgtattagtccgttctcacgctgctgtgaagaaatacccgagactgggcaatttataaagaaaagaggtttaattgactcagagttccgcatggctggggaggcttcaggaaacttacagtcatggcggaaggcacctcttcacgaagcagtgggagagagaatgagtgccaacaggggaaatgccagatgcttataaaaccatcagatcttgtgagaactcaccatgagaacagcataggggaacgcgctgcgtgcccctgctcccccacacccccgtgccatgattcagttacctccaccctgtcccgcccttgacacatggggattattacaattcagggtgagatttgggtgggccatagagccaaaccatatcactttccctgttatttagagcattattataatactgtgaatataatgtaataggtagcatcactctttctaatctgtaagtgtataaaacggttatgtatccttagatgccatcacacacatccacgggcctttcctgtgctccagagaagccgcacacctgtcttttcctccctgctcctttagtttgcgatggccttcagatgccaggccaaggaggaaaacctgagcctcctggtgacagggtgtcttcggtctccatccatcagcagtgaccctaaaccctggcgttgcttcgtctcttcatcttctgctttgcccttggcttttctccacctcaatgaagatttctgttaaatcttttgactcctgaagtctctgcttggggcccgtaggtggagatggttaatgatgaggggccctgaggtatcagggagggtgtgcagcttgtgggatcccctcttttcctgggcggcgaggtgcctgctggcttctttcacacctggctcccattgtttttcatgggatttccttgctgtatctggactaagatgatacagatgaaggttgtcaggtaggcactagtggaatgctgacacggagaggagctcagtgtttgggaggattgagtgacttaattgcaagaaaggctgtcttgtgaaataattacctcctgactgaaggagtcatttaagaagcagctccaagtaagactctacattgggctggaaggtcgaagggtgactggctagatgccttcctactataagccaatgactggcactcttgagtaaccattataacctcgtaaaacccctttttgtgaaaaagggaaacagaccgatagacttgtccagctgcagacagtcagtggtggagcgcagctgggagcccaggtccacgtggctgcagaggccggctctacctgtcgccatgctgctgtgcaggtgccattggtggtgtctgcttccccctgtgtgctggaggctttgcaggagccattgcctataaacctttaacatttaggagaaacgtaccccaagacctgtgaatctccaaatttaaaagtaatagaataacatttatttcaaaagatacagcatcataaaagcatttatgtggtctctccaaactttttttgagaactaacgttccgaggtattggtaaggaccagcagtgctaacacaccacattaaatcagcaaccgtgtggtcggggagccactgactgcctcatgtcattgtgacccgtagaggagccagcaggagcttctgggatttcttgtcaacactccttcctcctcctcctcctcctttccgtggagtcagatgtttattacaggccacattgtgtggtgaactactgtcttgtaatgtactttttgaaaatttacttgaagtgtaaatagactggaatggagaacattaaatgatgatcttgtttctctgtagcagtggacagggaagggctgattaggtagggtggaggtagatttggaataattgtgccactttttggtttttcttcttggacttatacattaggattgggatatggaaatacagttgtatgatgataaaaatcttttatacagatgaaacaaaaaaaattaatgttctttgttctcttatgtaaatcagttatttgtttttaaaggctgttgatgacataaacatataaaacacctaccgagattggcagtggaagttgtaacccatttgtaaaatcagaaatgctaagtactcctttaatgatgcaacgaataaagtgtctgtgtctgcgaggcacagcagtgagtcctctttgttttgctgtgctctgaggcgggcagcatagggattgagtggcaccagtgtttgactgcacttgcctctccatgcctcgtgacccccgggaagctggcactggctgagctcagctctgtgggcctttcttcagcactgtgggtcgtaaaagctgccttttctttgaaaactgcctgcgtcctctgggttcccagcgttggtgggatggagctgtggcgtccaggctgtgaggtctcatggggtcctgcagcagccagagcgtgcagaagacgaggaggggaagaaaggtggtaagtggcacccccggctgcgccccgaggtcaggaaggccagcaacctcctggcagagggagtgggcaccccagctggagtcagggagccaggcctggctgtgtgtttgaggaaaagttaagtgtaacttgcattgtttggttgggagtaatacaggaattgtgtttagcaccctatttgaaaatagtgtttaagactatttgttgaattaaccaacttaactattttaacaaatgtagctttttggcagagggctctttcaagtagtttttggtgcttatgggaagctttcatttctacaaccagcgcttagtgctgtgacggacaaaaggtcattgtattttattcttctcatattcgtgctagtgatagtttctagtggctgctttcttatctcacataggaacatttttctgtttgaaaataagtatataggtcttcaggtgtgcagtgagcagtattggtaagttggtatccaatatttgtaattaggaagctaaatcatatttcctatctttaacattgaaaaggacttttctgatacgtctgtgacagatcttatttcatcttatttagctcaagatctcattatgcttggctggcttcccctgttgttctggaggacaggcctggtttcgagtagcgtctctggggtgtggtggctggcatcacggtttacctctgctcaccagacctttgacatttgtgttcgacgggaatttcgtagaaggaagacattgtggttgtggggtcagcatttcccatgaagagccagctccctgcagggcccctcgctctggctctcccacggtcgtctcccttgaatagatcccttcagggatgagcctgagttccttgtcaccagtggaagagcctctgttttttttcgcccaagtagtttagtaagtgatttaatcagatttgcatttactcaggaatgactgtattcctttctcagagtttacagtcaacagtaggcaaacagagtaacgacccgggttgtctttactaaggctgaaatttaaatttaacttgatgacttttttcttaaatgtttaaatttacatttggattatcaaaaatgatggggacagactgagcatgtttaatatctttattacttctgtacaatttcttttgtatgaataagtgagaatgtattgttagctctgggagacaaatagcacatcttgatgcatgtactagatgcgcagaaaatacgtgtaatgtgatttcctgatttaaaaagcactagctctgtaacagactcgggtgaaaaagaatggaggcagggattccactttcttcacttacgtcaggtccttcaggatcctcagcgtgctcctcagtctcatgccaaagaagacagtgtggtgcggtgcagtggcaggaggacctggggccgctgtctggctctgcttttctcagctgtttgagttgggagaagtcagcttctctaagaggaaaagttttgtgtgcagagccccttgctcggtgccaggagtgcgaggagcacctgcagttcacatccaggtgccttctcgtcccaccctgggctgggcctttgctgcagtgatagctggtggaaagcattcctacttggtttcatcagttttgcactttatatttatctgtcagtttttaagacttaaattattttggctaaatttgctacactagtacagggtattgggaaacattttaattttaaggttaatttataattattctgctatctttaaatgaagtagtaaagattgttaacattgataaacctttagtttttaataaatgtggtaataaggtgtctgagactgtcatattcactagggaaagtctgtagttcccagaaattgatttcaatttttagatgcaatctaaagagtaaactgtttttttagttgagagtaatattacatatgttaaaatacatagatttcaaaggcacagtccagtgagcttttacaatgtatatatctgttgtaaccgctacccaaatcaaaatacagaacctatgtatcaccttagacatttacgtcattctcctttccttgttgtccacgcccccatcctacccttcacctcttctctgatttctgtcaccatagattagttttgtcatctcttagacttaatacaaatgggatgatgcaggatgtccttttgggaatggcttcttttgcaccacacagtgtcgtagagattgatctgtttgtccatgcagttgtgattcttggcggcttctcctttttatctaaacagacatggcatctgatgatggaattcatgctaggtatacctgtcagatacggttggcagtaagataaagtcagttgtatggccttagtaataattcattacatgggtttaacagtcaataattgcaaagaatgatgatgatactcaacactttagtattacatagaagtaacagtgtgaattgaacaatggcgatgaactgtccaaagtgtataaatcttagtgtcaaatagcaattgaaatgtcaaataacacttattcatcatttattataggtgctacagaatattttagaaacagaaaatgaatattctaaagaacttcagactgtgctttcaacgtacctacggccattgcagaccagtgagaagtaagttagatgataaattgcattaactgtaaaatagtctaaaccttaggctgttctcttctattttcagagaatagagggttaaatagtgaaacaaaatttagtgtaccagtttgccttagacatcagctgtttattaggttaagacttcaataggacattgggatggcaaaggagaagaatataaataaaactgtttacatatgtttactgttatttttcttggctctaggttaagttcagcaaacatttcatatttaatgggaaatctagaagaaatatgttctttccagcaaatgctcgtacagtctttagaagaatgcaccaagtaagtaagatgctaaaaatttgcaacactcaggttggtataattggtatttaaaggattaagtgtgaagtaattttagaattcacatttctaaagatgcaaacttaagttattttaaatcttttgggtaaatcagcttttacagtaaaagctgtattttagactgtctagtttgtatagcaggaatcttcagagaaagactcaagaatggtgatttttaaggtgttccatggaggaagagtcgggatgaagagcctctgggagagaaaggagaatggcctgacaccaggaccactgaggggacaagtggctcagctccttgtgtgccctgagtgctgcgcagggggccttgaaggccaggtctttccccaatatcctgcagcttgcctgctgtttctggccttccagaagcagatacagtgcttctagaaataacatattaggttggtgcaaaagtaattgtggttttggattgtgaattttaaatcataactaggctcagacacatctttattaatcaagaccattccagtcaacacattttcaccagtgagaaataagttttattcttgtagcgtaaaaatctgtgcttcaggatttgacaaactcttggaaagcactttctgcatcctgctggttgtggaagcgttttccctgcaaaaagttgtcgagatgcttgaagaaatggtagttggttggtgagaggtcaggtgaatatggcagatgaggcaaaacttcacagcccaatttgttccacttttgaagtgttggttgtgtgacgtgcggtcaggcgctgttgtggagaagaattgggcccttcctgttgaccaatgccggctgcaggcattgtagttttcaaagcatctcatcgatttgctgagcatacttctcagatgtaatggttttgtggagattcagaaagttgtagtggatcagactggcacagaccaccagacagtgaccaggacctttttttggtgcaagtttggctttgggaagtgctttggaacttctcggtccaaccactgagctggttgtcgtataagaaccacttttcggcgtatgtcacaatctgattgagaaatggttcattgttgtgtagaataagagaagatgacacttcaagatgatgatttttttgattctcgctcagctcatgaggtacccacttaccgagctttttcaccttttcaaattgcttcaaatgccgatcaactgtagaacagtcaacgttgagttctttagcagcttctcgtgtagttgtaagaggatcagcttcagtgattgctctcatttggtcgttgtcaacttctgatggccggccactacgctcctcaccttcaaggccctcatctcctctgcaaaacttcttgacccaccactgcactgtgtgtttgttagcagttcctgggccaaatgcgttgttgatgttggaaattgtctccactgctttacgacttactttgaactcgaataagaaaattgctcaaatttgccttttgtctaacatttccatagtctaaaataaacagcaagtaataagtcgttagcaaaaaaaccatcaagcgagaaatacgcattaaaatgatgtataaccacatttatttaagaacatgttccaatatcaaatggcaaatttcaacaatgcagaaaccacaaatatgtttgcagcaacctgatgtaacatgctatgctgatgaactagggctttgaggctttgtcacttttccaaaattttcctttggagggacagaggcatgttctgaataatcagccatcagtttttttctgtgtgactattttattttcttggtttacatcagacattaaaggatatttgttaatttcctgccaggtgacttagaacagtagtgcacatggaagcttttaggtttcagtagtctatcaggtgaggtttctttacttgtgggtttgatgaaggtgacacattttatttttaaattatctttgatctttattcatataacccccagaaaagactacagtacattatttccttggatttcggttggtctctggtcttcccttcagcttgtgcctatttaggttttgaacgtggtgagggagtggccttccttctgtgccactagttcttgcagttcatgacagtttaccaaccatgatgaaaatactttgttcccttacctttttggctgggctttgaggttttgtcaaggcactttatactggactatcgatatggcaaggaaagctgaatgccagagtaacagaatattattagaaaccgtaagtgaatattctatagaacttaagactgtactttcaacccatctgcaggccattgtttttacttttatagcatttttggtttgcataaagtggcattacttacatgaccatgaaagaatagcttgggaatcactttgattttcttttggtgaatgaaggtcatttgctgataattcaaagtctttgtaagagttcatattgtgctcaagatggaagtaaatgcttgcctctgtttttctcattggctgtagataatgtggtctaacaaattattacagtatattttaaaaatacagtttgcagtacctctgttgggcattatatcagccctgcgaattattatcctcacattactcgttaaaaagctgaaataaaggcagtaaagtaatcgcttgaagccatgtgtttactaaggcttcagtccttatgttatctcagaatttggtatggcttaggtattattttgatcaagtttctcaaattttatgctacatgtatacgaggtgttagagttccacggggaaatggaatgtactagacgaagttttctttctcagctatttctcttctttttattatgaatattctgaaattttcatcatttccattttaagacttactttcgtctttttgtcctatatgtgaaatttctgtaccattttacagtttaccaaatgccatatatatgtagcagtttcatactcattctttttttttttttgatacagaatcttgctctgttgcccaggctggagtgcactggtgcgatctcagctcactgcaacctctgcctcctgagttcaagtgattctcctgcctcagcctcccgagtagctgggattacaggcgtgcgccaccatgcccagctaatttttatgtatttttagtagagacggggtttcaccatgttggtcaggctggtcatgagctcctgacctcaaatgaaccacccgcctcagcctcccaaagtgttgggattacaggcgtgagcaaccacgcctggccttcatattcattatttcttttgatttttttttttcgtctctacacagacttgattcgtagatgtccaggccctttcacagctgcctgttggttagacccaggagttggcaaactatgggctgggtcagattccgcctaccacctgttttctataaacaaagtttcactggcacgtgctgtactttttcattcacccattgttaatggctgtgtttgtactacagtggcagcagtggagttgtgatagaaactgtctggctcacatacctcaaatatttactccttggctttttatagaaagttggctgacccccaggtgagatgtgctttcttccttggggcctcgacctggccctaacctctccattccctgtgcgttctgaggcccatgtttgttttctcagtatttttgccatgtaggacttctgtcttccgtcttgaaaactgaagtttctatctggtgtcatttttcttcaggcagaggaacactttagttttttgtaattcaggtgtgttactgacaaacatgatcttggattttgttgtctgaaaattgctgccttcgttcctgaagatttttttttttcccatggatactgaactctgggtaacagatttgttgtttcagcatttgaaggatattgctccactgtcttttggccttcactgtatctgttgattgtatctgatgatgacctccattatattctgatcagcacaatttcagatagttgttccccgtccgcttcctagatttttgcctttattttaggtttttggcattttgacggtgattatctcgggtgtggttttctgacttctcgaacttgaaaatttatgtcttttaccaaatgtggggaatttgcgggcattatttcttcaaatattttgctgctttactgtttctactctgccttggggctccagttacacccatgtagaccttttgctggaggtcctggatttgctcgttgctttctgacctggtctctgctctgttcttcaggttgaatggcgtctgctgtgtcctaagtgttcactgtctgcctctctactctcttgttcgtccccgtgcaacaagtttttagtttgagaatttttttcagttctagaatttgtttcgcttaaaaaaagtgtttagttctctgctaagattttatatttgttcattcactacaagaatatttttctttatatcctttagcaataattagaataactgctttaaggtcccatctgctgattctttattgtgaggatgggttacgtcttcatgattctttttatttctagtgactttgaattgtgtcctgtttactgtgggttgtagactcttgatcatgttaggtttccctgaagagtattgatttgcttgtttgacaggcagttaacttggtcaggctcaaattgccaactctccctttggcagatgctcaaatctcagtccacttattttagactcagctgatctgaagttggccttgcaagttctgttctgccgtcagccagagatttgggcagaatttagagacagaattcagggtcacactcaccgtgggtttcccccagcttcccagcaactctggtagaaccaaaccctgtggatttttgttggagttttagctgttccacataacaaagttggctgccattagcttaatagttgagaaagcaggaggtgccctgcccgttcttttttccaaatgtccatccttccccagaatatacctgatgctaactaaaaagtgattcaggcaggtctcaatcgatagaggtttacgtagctgcagttgaggacgtgccaggtaacaggagcatttgtgctttttccaaagctttgagaagttcagtatttaaaggggaaagaacaagcaggaggggaaaaaagggaggctggggagcagtgaggcagatgcttaaacattgttgtgagcctccgattggcctcagtaagcctgcattttacacgggaaagggggagtagaggaaagtcagttgtgcgtttttctcagggttctctttcacgggaagggtgatttctgctcttgtccttgtctgtacctatgaagataagctggtacttgacattgccagggtgagatacaatagaactcggttttagggctagtttttagtgggggacatatgttctgatagatttaggggctcacaagaaatctccttgtgagcactttgtgaggaaggccatctggggagctatgtggccttctgtagttgtgggcacctggcgtatggatgaggccatgacacagggttgtggaatgacagctctctgttcggcaacaaaaggcagacagtgttgcacagttcagttcccaagcttcactttcccactggcatagtgagtttgggtcccaagattctgttatctttcatgctacttttgagtgcctctaggcagttactttctatatgttttttaaagtttcgatgttatttgcaggcgagtcagtttgataggagtaatttggctatagccagatttatagaacccatttccttttagtttttcaaatcacagttcttcctttcatcagctgtagagggctccttgcaagcatgctttgtctaggctttcagttcaaaacaatagaaactgcaatctgccttccatgcccttgtgccatttgctgcattagtagcggcacactgtcatttgtgttgtgaggttgtgatagctggaatgtgcccagtttgcctagagcagctttctcaggtatgcgtgcattcggcgcttgtgcacacgctgccaccacgtgcgtgatgctggctggctgctgatagagcctgtcctggtggagcttatagtctggtgagggagacagataattgaaaattgtataaatagttagaaagctacaattgcagaccttcttacgaaagaaatcatatcaggcaccaagagcaaacttcaggggaagatcactgagcactgaggggtaaatgggaggtaaccaggcaaaaaacgagaggaggtttttcctcacaccagcacttcgtcaattgtctgacactgagtttccagtggttcagttctattcggacatttgtctcccacgagactgccacatttcaaacccagctgcaaatggggtgcccaagctatatactcctacctgactgagtacagatttgagggttcccatgactcccttcaggtttgataatttgctggaatgacccatgtatgtaactcaggagagtgcttgacttcctggtaccagtttattatgaaggatgcaactcagaatgagatggatagaagaaagatgtagggtaagggatgggagcagagtttctaggccctctgggtgcagcacctccgtgctttcagcaacccaaaatctctccaagccctgtccttggtggtttctaatgtaggctctgttaggtagacatgcatgattgactagatcactggacattgctgagtggcatgatctccagccccttgtcctccctttaggttgctggttggggctgaaagttcctgtgatcatggtggtctttgtgacacctagcccccatcctgtaagctgtctaggggccgacccagagttacctcgttagcatagactcgggtatgacggaaaggggttcatgatgggtaacaaaagacacttctgtcactcagaaaattccaggggctttgggagccagggacagtttatctgatatcacaggagagagagcaccctgaggtgggcattggctgtggctggagcctgtgaatggagaggagtggaacagtaggagcccggacgggcaggcgagatcaggtcctggagactttgattggatcttaggtgactgtcaagagtagttggaagccgctgatggatttgaagcttggcagtatcatagtcggcactcttctgtaaaaggaaccgtatgctctgtgatgagtggtctgggtggggcagagggcaggaggacacagagactccagaaaggaggatattgaattttgtcgagattcttttccgtgttaaataaatatccgttaccttaaaagccactgacttataatcattcagtggtaattttgtggaggtgtttataaaagttacttagcaagtctgtttttgcttaggcattgtagttagtgcttctgggatccacggctggttgtaggcagcgtcttctcccagaaccactctgaaccaggaagtaggtcactactttcacatacactcatgcctgcatgcattcattctcccggaaccactctgaaccaggaagtgtgggtcaccaccttcacatacactcatgcatgcatgcattcattctgtttttgtttttcccccagaatgaccctatgcctagaattcttttgtagcttatatgactttttccaagcattcctttatccccaaaagggatctctttgtctgtggttgccactgtagttgatacttccaaagtgggaggagtgccctggggccttgtcctcctggggtccttgtgtggtcctggaaggtgcagcgggtgatttgcttagcactggggcagaagcctagatggcattccatagaaagcactagttaagatggcataaaagagttagtctcattataaaatatccagaagctgtagaataggacagagtgaaaaaccaccaataaactttttacccagatgtaattattgttgatactgccttccacttctctaagctttggtgtatgggagaacacatgcataattagggccaggattgagggcctgcctctagttaagataagatagtgagtgctctctcaggagagcctgcctgttgcatttgggcagtgaggtaacctgatttgacctcagtatggggcaggtgtgaatagcacaggcagaggcttctccttcctagatgtccagtacagaagacattacatgttttgctgcaaattaaatgattgcagatgtgaaaagaagttatcccagaagagagctgtagaagaattctaaccactttaatgtcattaggagagtttttcaaatactttaacggcagctcatgtctgtctgatggctgccttactataaatatgtacagtgaacttccatgtacagacctactatttattgaattcttagtgtgttcctggtattttttcagttattaactcattttatcctttaaaggaccccatgaggcaggtgtttaaagataagaaagctaggacaccaagagggtgagggatgtgcccaaggttacacaactggtaactggggcctcagatttggagacaggttgtcttcattcgaggtatgtatgtgaaaggttgattctgagagtccctgattcatagttccacctctttcagttggcagtgcttttcgcaggcctggcagcttctcaccccaccctctgctgccctaaggcagccccagcgagagcccccagccagttaggttcctctcccagggccaggcccagcagcagctggagcccaggcccccttctcctgttgggggcagggcccctgcctcactttgggacaagaaagccttagtggggagaaataagatagtgagtgctctctcaggatagcatttgaaatgcagttttccttcaaactattgttctatgtgtcggagaattccctgtactacatgatttactgtagaccctgttacagtatgatttagagagtctttggactagtctgggaatgtggaacagtggtttgtaaaaaattgcctctatgggaaaatgaattcttggaatctaatagtatcttttaaacgagtttttaaaataaaactgataagttgggaatttgcttctagtttatgatagaaaggaggttaaattctgttgaaaatagaacctcagaagccctcttatggaacatccttgttgtaccaaattttattcttacttattttgatggtgactcagtggtgttgtaatacttcccctaaagaaatactaaaatacccagtaactctccgtctctttgtttagatgccagcgcatgggctggcaaacagtggagatagcaggatttgccctgttcccgtctcagatgtacagctcttgaaatagtgagggtgcctggatcactgtaccccagagtctccaccaagcctgggactaccacactaagcttgttgtgtgtaactgttgcttggggcagctgcgaccatttcaccattcctgcttgagtgttctgggtgctttccccaccccgggtccccagcctcccccgatccctatactttgtgctgctttggcgatgttcagggccacccgatgacctctcgcaacccagttatcacagttcaaatgtctcagagcattttggctctgctgcatgccaccatgtgatacatgggacgccttttcctcatggagtttcacataggtttctgatggttctgccgtgttctctggctacctgggagatcacaggatgccacgcctgtggaggactgtgagggaagcctacccttcttgtagctcaagttgaaccattgtggtgctggttcatgggtgctattagtttagagggcaaggtggtggtgaattccatctccagtcctttactcagattgttctaatatgttgtacattttctgtaagatgatagtgaaaacagtacatcaagagaaaaattttcttctctagagactcattctcagcatatttgttgtttgaactgtttttaaataaatcggttaactgcaatgtttgtaattttcagtttctattctggtgacagtttttttaaaaatgtgattttgagtcaagttgtttgagaggatatgggtgccactaacatgaaggccgggctcagaagaggattcgggctaaggcgctgagtcactaacatgaaggccgggctcagaagaggattcgggctaaggcgctgagtcgctaacatgaaggccggcctcagaagaggattcgggctaaggcgctgagtcgctaacatgaaggccgggctcagaagaggattcgggctaaggcgctgagtcactaacgtgaaggctggcctcagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggctcagaagaggattcgggctaaggcgctgagttccgtttggggttgctgtgcatttcagttggagatgtcacaggggagggtggaagcggatactgggagctgcagacttcccacccggcctactgcatgtgtgggaagaggtgtggcccaggtaaaggttaggtttggattgacagctctcctggtcacctgcctcatgttgcttgcccatgtctgtcccagtgtcctcatctataaagcaggggtgctggtgtcacccacccagagtcttgcggaggtaaagtggcctggtacttacggaaccatctgcaaatgctcggggccctacttggcgtctggagctgagttctcctgcagcctctgttctgccagggccctccctgtgcaccatttataacttcagttgtgaaaatgtaacttcgcactggctttggagggccctgagtgagctggctggtgttcgtgaaagaagatctgttttcagtcacattggtgagggacttttttcctcacccttcccatttctgcagctttgtcttcacttgatttcactttctgcccttaaactcggggacattttatgactgtctttaactgggggatatttttcctgtggaaggtggggtcatggtgctttcttttcagtgctgcgtttctcttggctctgtcgtttggggatgtctgacaggcagttgactagccatggaatcaggttggaagtagagaatgatttaatgaacttcatgaatggtgtaatgaattggtatgatatttcattcgttgtctggatctttttaatgtcgatattttaattatttttttcctaaaatagctggaggcaacttatttttaaccgccagctagttaagccatcattgcctgtatttggaatggtagaaaacaaccaaatgtgtctttagtcttattcttatcctacactaatcagttccttgattagtaggctgtagctatggaggaggcggtagctacggcataaaccaaagaaggcaggaaggtttcacttggaaggcgatggagaaatagaccaaacgttcaggaaagaaacattttggatgattaaggaagctttataaatggcatgtagggaggcacagtgattggaactgcgggcgctttgatgtttttagccaccatgccttctttcatagagggttacctatggcatgttctccctgcccacactcaggttctgtcctgagcctgctccggttctcagttgatgcagtatgggctccaccatccctggtctttcagtgtcacaaccagttgttagctcctgcctctgaagtcagcctttctggatcagatctttcttgattgttcagcttgtcttttcgtgtttgtgccgatctctgtggagacctttagttggcgtgcttcaggaattcactggcatctcctccttcctcctcttccctgctcactcgctctcttcgtattacccacctgttgatttctttttagaaacctttagtgtatctttaactcttccttttcccccaccttgaatcatttgccgagctacctcttctgtgcctgacctgtcctgaacgctgtagttcaggtcttgtgggttttcatggtgtctgtgcgctaacctaactgggccctgacttctagttggctcctgttctgtccagcttctccaccagcactggtcctcctgaaatggttcatcccagaaactgggggtgacaccgctttattcatttattcaccagctggtcttcaagacgtttggacaggacctgttaaaattgtggcaatttttgcttcttgaaaacagctaatttagattggttccaaagttgtaataatctacagatgtccctctacagattggacctcctttttggcctctgtcctcaggccttggcttatgagcctttcttgttgctgcctggtggggctgaaagtgggattttccccccacccagctctccttactattccctttgtttggaatcacttctgcttatcttcttactaaaatcctacttaatccttcagtcccagtgaacataccaattcttagtacagccttccctttgtctcttgtgttttgattgaatgtatgtcttgattttattttaatggtaaatgcctttcaatgtattacagacatcagtagactgagttcccatttgttgacttgtatatgataggacttcagtgtagtgtatcaaagaaaatatccaatgtgtttataagtatttaatgtaattgttataatagttaaatatcatgtaatgattttgttcaaaagttaattataaagcctaagataatagggaggaggtggagcaagatagccaaatagaaacctccactgattgtcctccccacaggaacaccaaattgaacaactctccacacgaagaaataccttcttaagaatcagaatcaggtgagtgatcacggtgcctggttctaacttcatatcactgaaggagaaactgaagagggtaggaaagacagtcttaaattgctgatactactgctccctcaacttcggcagcagccacgtagcacagagagaaaacctgtgcacttcggagagggggagggctcagtagttgtgagactttgtattggaactcagtgctgccctgtcacagtggaaagcaacattgggcacagaggtagcatttagaccagtcctagccagaaggctagtccctggtcccagcagttggaacctgagttctggcaggccccgccactgtgggctaaaatgacctggggttctaaataaacttgaaagagagtctaggccacaaggactgcacttcctggctaagacctagtgttgtgctggggctctgagccagtggccttggggggcctgcaacctagtgagacctcagccggggcagccaagggaggccttgcaccaccctcccacagccacaggcagtgcagcctgcagctccaggagagactcctcccacaaccacaggcagtgcagcctgcagctccaggagagactcctcccacaaccacaggcagtgcagcctgcagctccaggagagactcctcccacaaccacaggcagtgcagcctgcagctccagtgagactcctcccacaaccacaggcagtgcagcctgcacctccaggagagactccttccttctgctagagaataagaggagaggaaagacggctttgtcttgcagcttggataccagctcagccacagcaggatagagcatcaggcagaaccctgaggctcccggacgacatttatagacataccttggaccaaaagggaacccactgcttggaagggaagcacccagttcctgtcaggatccatcatctgctgactaaagagtccttgggccctgagtaatcagcagtggtacccaggcagaactcaccatgggtcttgcatgagactcaaagacgagctggcttcaaatgtgacccagagcacattcccagctgtggtggctacagggagggactcctgcttgagaaaaggagaggagactttgtcttgcagcgtaggtatctgcccagccacagtgaggtggaacatcaagtgggctcttgggagtccccagtttcaggccttggctgttagacatgatttcgggacctgctgtgggctagaaggcagcccactgctctgaaaggagagtctcaggcctggtggcattcaccacaaactgactgaagagtccttgggccttgaaggaacattagcaataaacaggcagtacttgctgcaggcccggtggtggctacagggagaggtttcctgcttatggaaaaggggagtgaagagtgggaaggactttttcatgtggcttgggtgccacaagaaatattcaactgcagtagaatagtgcaccagctagattcctaaggtttcagcttccgggctctggctcgcagatggcatctctagacctgcccggagccaaggagaactcaccgtcctgaaggaaaggacacgtgcccatctggctttgccacctgccgattgtagtgccccagggtcttgagcaaacataggcagtagttaggaagtggttaccatgggccttgggtgcagtccagtgctttgctggcttcaggtgtgaaccagtgcagtcccaatggtggtgactacaggggtattgtgtcatccttctctagctccagctactcatctcacacacacacacccctctctctgtctttctctctctctgtttgggagagagtaagggaagagagcaaagagtctctgcctagtaattgaaaattcttctggattttgttcaagaacaccgtggtggttcctatgtgaatcagcaagagtcacagcattactgcgtgtggggtgccccaatttaatgcagatacagctgcagtgagaccaaaaacttaaattgcaacacccaagtccctttgaatactggaaagccttcccaagaaggatgggtacaaacaagcctaggctgtgaagactacaataaacacctagctcttcaacgcccagtgcccagacactgacaaacatccacaagcatgaagtccatccaggaaaacaggaactcgccaaataaagctaccagtaaacaattctggagagacagatatgtgacctttcagacagagaattaaaaagtagctattttgaggaaacaatgaaattcaagatgacacagagaaggaaatcagaatcctatcagataaatttaaagagattgaaatatgaaagaatcaagcagaaattctggagttgaaaaatgtagttgacgtactgaaaaatgcatcaaagtctcttagcagaattgatcaagcagaggaaagaattagtgagcttgaagacaggccatctaaaaatacacagaagagactaaagaaagaatcaaaaacaatgaagcatgcctacaagatgtagaaaatagccccaaaagggcaaatccaggagttattggccttaaggaggaagtaaagagagacataggggtagaaagtttattcaaagagataacagatagcttcccaaacagagagaaaggtatcaatattcaagtacaagaaggttatattaataaaacacgaagtagatttaacccgtagaagactaccttatgggatttaataagcaaactcccataggtcaatgatgaagaaaggatcctaaaagcagagagagaaacaaataccatacaaagatgctccagtacatctggcagcagacttctcagtggaaagcttccaggccaggagactgtgggcctgacatatttaaattgctgaaagcaaaaaccttttatcctaggatagtatatctagcaaaaatattcttcaaacatgaaggagaaataaaaactttcccaaacaaaagttgagggattttattaacaccagccctgttctacaagaaatgctaaagggagttcttcaatctgaaagaaaataatgttagtgagcaataagaaatcacctgaaggtacaaaactcactggtaatagtactcagaagaatacagaatagtataacactatgtgtaaactactcatatcttgagtagaaaggttaaaagatgaactgataaaaaactacaagttttcaagacagtacagtaagatataagtagaaacaacaaaaagttaaaaagcacaaggacaaagttaaagtgtagagtttttaattaatgttctgtttccttgcttgttacattgtttacacaatcaatgttgtcatttaaaaataatgggttttattatttggaagtccatggtaacctcaaattaagaaacatacaatagatccataaaaaataaaaagcaagaaattaaaacataaaaccagagagaatcacctttactaaaaggaagacaggaaggaaaaaaggaagagaagattgcaaaacaagaaaacaaatgacaaaatggcaagagtaagtccatggttatgaataataacattgaacttaaatgaactaaactctgcaatcaagagccgtagagtggctgaatggattaaaaaaaaccaaaaagacaaaaaacccaatgatctataaagacacctatagactggaaataaaggaatggaaaaagatactccatgcaaataggaaccaaaaagagcaggagtagctagacttatatcaaacaaaatagatttcaagacaaaagctagagacaaagaaagtcattatataatgataaaggggtcaattcagcaagaggatatagcagttgtaaatatgcatccaacattggagcacccagataatataaagcaagtattattagaactaaagataaaccccaatacaataatagctagagatgtcaacacaccactttcagcactggacagatctttgatacagaaaagcaacaaagacacttgactttatctgtactttagaacaaatcaatctaaagatacttacagaacatttcctctagtggcttcagaatgcacattcttttcttagcacatggatcattcttaaggatcatctatattaagcacaaaacaagtcttaaaatttttttaaaaatgagattcatctcttaaaaaaatataattttatcaagattcttctgaccacaatggaataaaactagaaatcaataatgaggaattttggaaactatgcagacacatggaaattaaacagtgtgctcctgaatgaccagtgggtcaatgaagaaattaagaaaatttaaaaatttcttgaaacaagtgatcgtggaaacacagcataccaaaacctatggggtacagcaaaagctgtattaagaggaagtttgtagctgtaagcaactacatcaaaaagtagaaaaacttcaaataaacaaccttaatgatgcatcttaacaagaaaagcaggagcaaaccaaacccaaaattgtagaaggaaaataataaagattacagtggaagtaaatgaatttgaaatattacaaaagatcgatgaaaccaaaagtggcttttttgaaaaaataaaattgacaaacctttagtcagactaagaaaaaagagaagacccaaataaataatttttcttttttgtttctgattttaaaactgatactgcagaaattcagactcactagaggctactgtgaacaactgtatgccagtaaattggagaacttagaagctttggtagtcaacaagagagacctgccagaggtcatgtggttacaggggccccgtgtccctgtgtgtgtgtgtgcatgtgtgtgtgtgtgtctatctccaccctgagtgggagcaggaggctacttgtgaagtctcatctctgaaggccatctgttgatcacgacaggctgctgggttccttgcggctggagatgtgtatggaggttcccccagcacattgctctgtcttcatgggcatctcagtttccatctgaaatcacttgttgatgaactgagaaccattcctctgtctagttagcagtatcactaggagtaaacatgttacgggggaaactgcttagcatttgatttctcaagtgttttttctgagacccagtaatcttctgggtaaggaaaaaaaacccttgggtaccccctttcaccttgtgctgttgctgttactgtgaagatgtagatggtatgtgtgactctagctgtcatcagatcattcatggacacaatgcaacatcacacctgttagattatggctttggttctgccaggaggcctggtgggagcagctggcatgatgcgtgctgcctctcatgactcatgtgcaccatcctgctgcccaaggccttgatgtagcccctgtggggtgccctgtctgcatgttatcacactctgaagagcagcctatggagcacaagagagaaccgaggggaacatcccctcctttaattctgaactcatattctgtaatggtgatttctgtgagtctggctggttgtcgtgtgaattcaggtgtctaggcagcgttatgtgtggaatatgttggcacgttatgctcgagtcctagggctcagctgacctttatgagctttatctgctactgaattaatgaacaagggctttatcagccatgaaactttggtgatggcagtgacagaaaattcttgggagaattggtctgggactgaaagaggtaataaaaatctagagcctaggctcagtgcggtgaattaaataggaaaaaccactcgtaccgtgaattgttcgtttataagctatgctgaaatatgacttaattttcattaattgatgaaatatcagaaatgaaaatcagtttatccagatttccttttctgaatggatcggggctgtggcactggaccaggtaggagatgaaatcttagcatagcccatggcccagcactgagcagtatttctgcaatcctaagaatttaacccattgtgggtagcacatatccaataactttcctgtgccacatctctggcagtgttttctgtgcgtatacctttggcattccatcattacccagtgctcttcagtcctcctagtgaggcatgcagggtcctgtcattctagaagcccgcctcttcctgatatttcactgtgtctctgaggatgaacatcacctgctcagatgtcagaagattctcaaaacctgtgtgtcttaaagggcgtgttcttcctcctctgtaggctggcagcagtttgtagctcctgtcactgagactacataattgtcttcagtttacttctgtacaaaatgatagaactcactttaaggtagagactgtttcttaccctgtttttaatctgttcccagtgccttgtaatggtgctgcatacatatagtagttgaaattaatttgagtcagtgactaccctgcaaatggacagaactgtggctaatcccggtaggttgtggaaaccccgcttagctgttcacagttggaaatgggtctgcagcagtgcagatgctagcttactttgccttctgttgtgttttaataaactaaacagtaaagcaccataataactgcatgacacattcaggatttggaaacatggcttggatgaattagaccagtgttgttgagagcttgcattgatggaaacatgctgtatctgctagacaaatttcagtagcctctagccacgtggggctgtgaagctctggaaatgagattaacgcaactgaagaactgaatttttaatttttttaaaaaatttagttaaccttacttgaaatagctgcaggtggctagtggctgttggatttgagggtaaagaagcatggtagagaaggcaggtgggacagcctcccatctgcgcagagatctatatgtcaccgccaccgacaggaagacttgtgcatcctaacccttagcctccttgtgctgtgggcaaggtccctgctgttgcagaccccactaaattcccagtccgtgcaggtaactgttgtgcttctgtgagcccccgccagtactctgggtggggacatgtcttgctcagacagagatcaaaggagagctaagagagggagagagatggacagttaaatattgaaggagggcgttggcctttttttacacagcacagggaagagactagtatgtggagggagcacttacatttggtagatgttcttacacagatcagccacctgaacgtgtgtgggatatttttattacctatattttacatttctattgtctgtattatttaccgtaactacatttgacatctacatattgctatgttttagaagcagaggtttattttcacctctttcctgaaggccatgttttataaaactgacatgttatctagtctagaagggaaggcccagctgggcatggtggtgcatgcctgtaatcccagctactcgggaggctgagacacgagaatcgcttgaaccgggaaggcggaggttgcagtgagctgagatggtgccattacactccagcctgggtaacaagagagaaactccatctcaaaaaaaaaaaaaaaaaaaaaaagaagacccattgtgctgggaatgcttgagtctgaggagagaaaacggtgggtggtgggatttggcacctctgtcacagcgttacttcctgtgcttttctgtctccacagctattataggacgtactgataacagctcagtaaattttcttaaattgatgagaacaggaacagtctttttgagcctcggttaacagttactaagaaatgaataaaaaatggttgaaaaacagggagaagaccaagttagcataaattttgagtgctctgtgttttgaacatgaggtttttcctaatacttgtgacttgctgattctcctgactatgactttctccagccagtacttagccgcggagcggaaagcagtgctcatgaaggtggaggcacacccagagactgcatggaggtggaaccgggaagtccggggtctgaggtcctgcctgcagggttgaaaggcatgcctgccagcagacacatttgggagccagagtgtgctgtggtctgaatgtgtttccccagatcatctgttactacagatgatcaccaattggatggtattaaaaggtgggccttggaggtgggtaggttgtgaggatgcagccctcatgaataggatcagcagccttgtaacagctgtgagggagctgttttgccccttccccgctgtgaggatgcaataggggaccacctgcgggtgccttgatcttaggcttccaacctccagagctgtgggcagtgcatttctgttgttggaaaattacccagtccgcggtgttctgttcccagcaggggcggactgaggccgtgtgcttatcggtggggacagcagagcagaagcagtgtccccatgagttgtaggcctggaccttagacccaggctccagccacctttgtgttggatgctgacgtctttcatttttttttgcattcctctgtcattttggtcacgtacctgctctgggaacttcccgaggagcaagtgcatgccaggcagttaatccatgtgaatgctcacggttgactcagatggagacagttagaggaagcgatttccacccccgtttcaaggggtgcttcagtgtttctgggctctggtgctgaggagccccatgctgttcctcattctcggtgtgaacaggtgtttctcactcagagctcttcgcatccttgtttctgggcttctgaatgactctgctgttgtctggggcctcggtcttcttttggcctgtgtcgacgctcgtggacaccttcgctcttgtgccttgcactctttctgtttagtcgtgtgatgatttctttgattgacttctgcttatatttttggttttctgtatcatgaacttttattctgatgtggaatgactatcatatttcctttttctcctttgctccttcattcccctttttttaggcaaatgtatttgtcctttcatgccttcttataattaaggttggcacactaaaagcactttggaagtgctgtccgagagttgggactggttgactcttgttttctgtaggaatccctggtgttcatgtttttggtcactttttctctggctcccattccctaggtaggaggatgtaatccttctggtaatattgtgggtatctggggagcaaagacaccctggggtgcagggaaggtggtaagagttcacgtggttctcctgttttcagcacacgtgcccctgctccgggttgttgctgttgtccttcagaaactctgaggtctggagaggtgagcgtgtaccccgttaggcacacccaacactgaggcggcaccaccaggggccctgatgcccacagcttgtgccgacttgtcacccctcatgcagcttccagtgctggttctggtagtctcttcctcattctttttgttctcatgagtttatgcttcttggaaaagcctgttaactgtcaggatgctgtggatctggggaggagaggcacctgataggtgggcttgctttctagtctctaacctgaagggaaaggcggtttttgtattttttgttagtcttgatgttgctgctttggtagaaaacctcacagactgaataaccacattcaataattctccttattttatgcaaagctgaaggctctgtgacatctgtttttctcactgcccaaagaacttgggcctgagggttggttgggatgctgtgcagtctgaatgctgctggagaggacctggcagcacagctgctttctgggcgccccttctccttgctagactcaaggcagcaacacatgtgtgctgggatcggggcctctggttttcacagatgggtgcagagggaggttttccttactcagagtattatatgtctgtcagttagcagttgtcctgtctgtaaaactgatgactatttccctttgtgtcgcatttctccaggttgcccgaagctcagcagagagtcggaggctgctttttaaacctgatgccacagatgaaaaccctgtacctcacgtattgtgccaatcacccttctgcagtgaatgtcctcacggaacacaggtgcgcttgctaggcaccttggcaacagggagggtggatggctctgtgtccttcaaatagtgcatgaaatagtatgatgctaatagtcccttggttattaaagggtatgaattttaattacccctcaaaattagtgcttgagaagtactggtaagaagtctttaaaatgatggtgagtatttttgtaaaaagacaaatcttttcaatgttttccctacagcctgaagccctttggctaataggttgaaggggttagtaagtgttctggggtgtagccacaagcttagtcaagggtcctggaatcatatttcagttcttaaaactggaagtacatgagtccgagttacatcagctgtaacagaaagtatctcatttcagattaatacaggttttatacacaaaacattacattggagacccttagcttttcatcctgaaactaaaaacaagtgcaacagagaatgcacagacgttttgcttattttatgaagcaagacagtgtctgcttcctgcgaattggaggaagatgtttctcagctgtttcagttactgaggaggatctcagtcattagtgagtgttaagaattgatttgtttgaggattggcttggaggagaccacaccggggcttagagagctcagaggctcactttctgcttctaaaaagatttatattaatgttttacaaaaaattaatacaaagatttgtattaatattttacaaaaaatttcataatttcttttgaaaacagaaattcacacattttcaaaaccataaatggaaaagtattgttttagtagcataaagataaatgccattgtctttctaacttaagtatttaacttcagcttaaccgaacatttccactgaaagcctcgtcagtgaacaggtgttggttgcctcttcagaagcacatttggggctcaggtgtggcgctgcgtgggtgtcctaggacagctcagacatggcagcagggtggactcggctctggctgtggctgctcccttcaggctctgcagccttgggcagatttcctcctgtctctgggtttcagcttcctttcctgaaggaactcattcacaggggtgttacaagcattcaagctaaaactgtcagcaggtcaggtcagggtgaacgcaccaaatgctcagtgaatattctgttgtcttctattgtttcttcattttttaatttttttattttttaaaaaagaccctggatagttactgtttcctgggtgtgctcaaatataaaaggattaagattttttgaacttcctatttgttactaaagcatctgcagccctgaaaggaaacagcagccttgaacaatgtagtgaaaggaaaggaagttagaactcacagcagtggcagaaaaggaaaacccaaagaaccctccctctgcacgtcccgcttgggagcgtgggccatgtccgcagcatctccaagcgtccagcatgtttccagttatgtgctatgcccctacccctgggctgtgtccacagcgtctccaagcgtccagcatgtttctagttatgcgctatgcccctacccctgggaatttatacattgaatgagatttccagaaagcgcaatgcaagtgttaaatttgtatctctggaaattcttcaagaattgttgatggagtcatgaggaagatgaacagaaagttcatctttctgaggacctgtcctaaagatgacattgaaagtcactaggactgttagtttcctaaaatgcgaagccattcaagagcagtgcttgcgggcgtgtgctgtgttgatcctcttctctgttattaccttaatgagtgtgtttgtcaggtcttaatgtacgtgtagcattttcctgaagtaactagaagaaagaatacaggtgggtttttgagtcaggagggtctttgtgcctccttcccagggctgcccagagagtggaggggcaggctgaggcccgctcgggacagcagccccggggcaagtcaccattgctttagtgctgggagtcagagctgcggcgagaggaaggtcccccgagccagcaggtgccgccactgtggaacatgaagcttgtgtgccctcccgaggtccctgcaccacgagagttcccgctgtgttggccacagattcctccccaccccaaagacacagcagtgaattggggtcaggcttccctgtgccaaggctccttcctacctcctgcctttgtacttggattctttcttggtcctcttgccagcttttccatgtgtgtgacggtctttaagctgccacacctggggtagactaatctgctcatgctgtggagtaatttttaaggattggttcaagtgcagtgggttgaagtttaaagtcttatttgcatcctcactgtccttgtgttacttgggtttaagttctaagtgtgagccctgcgagcgcagaatgccaactctgaccgttttagcagctcagaccttctgcagcgtccagtgatggcagcaacacttgtccatggccagctattttgaatgaactatgggtgtcataatttagcctttgaaaatgatttttttcccagcagtttgttcctctgcacttggctccatgcttgcatgtgttttgtggctgccgtcagcccacagcactgtgtcggtaaggactgaggagacccactgtgtacgggctgctggcatcagcagaactgaagctgaaagagcagtctttggtcagagtagctgtaactagctgttttgttttattatggcactactttttttttttttaacttcaaactgaaactaaaacgatgatccacaaacatttataaaatttcatttcctttttaactgtatttgttctggcattgtaagagtgtcttgtggatattagaaggagttttgcttgcacatgtttcacttttttggcttctgggctttttttgagggagtggtgatgagggtaactgtttagttttgttagtttttctctgctgtaccgtagttaggaaatttcacaggtaaccctgaaatataaataatgacctgaatggatttttccttgattcttattttggtggaaaaggtacttatgtggattacatttaaaggagttgaaatatatttttagtatcataaagtttgattttcatgggactgcctgataaattctccaacacctagagaattgttggtaaaatataaattgctcctgtctgaagccctcatgtcactctattcatgctttaggaatggatagagtgagtaatgggaagaggagcacttctgagtaagaactgggcggaggggagggatgtgtgtgtgcggaacaggctgcccgtggtcagaggggccggccatgccatccacatagcaggggtccgcctggggtgcagagcgtcagctgttctgccggcagtgatggtgtgggcagtggccttcatgcaggccgtcgtctgtatcacttgcaaaattgtaggtctgccccacccagtgatgtttggagcattgatgtctgtgagtgcctgccctggtgcctagcatggtgagcagtcctgtggctcctcctctgtccttgtggtcctgctgtccacagagtgctcacagttgccccagctgagaaggggcgggggacagtggctgtagtggctgcagcagatgggagtctgtcctggaccctcctcagttccccacccatcttcccggggaaggtggatgctgaggaaagaaggcagaggacgtgtgcgtgtttagaaatgataggaacacatgcggtgtgctcatgggctcatgtcaatgcagcctgtacggtgagcaggacaccttgctgtgcaggtgttacccacagcaggcccctgaagatggcactgtgctttatttcagtaatctccagcctgggattgtctcaaggaaatgatttttggaaagcacaaagttacagacaaaagatgttgagttgtctgttgcccacaaaagtgcacttgctctcgtgcgtgcgtgctctctctcacaaagacagacaccacgtacacacactcggaagtactcttgacagtctctgtgctactaatttttaaaacagcatcaacacgatgggcagccttacagaaataattatgaagccttatatatggagttgataaaatgtttcttgtcttaatttttttacaagtggatatatgcaacattacccttttttataatttgctttagtattgataatatctgttaagtgtgtatatgtatgtgtttattggaagtatttcttgttggcaagggcagacagaggtgccgcacccacatcgttactgtttttacacagcataggactgcaccctggccttggttaatgagaccaccctggttttgtagaaagcgttgagatgtaagtggccttctcagaaggtcttacgtgcttaggaagtggaaggctggtttcctaatgactgtttggttttcagcatggtgtttgaatcggtttcattggaggacattctccctggctgccctggcaggggatccacatggaataaggagggtgagaagcgggaagggctggcaccaccctggctctcagtcctccttatgggaagctgtgtttaggttgaactctctgaaactgttaatgttcactatttgtggactcagtttcctctgggttagccaaaacactgtctgtcttttccccgggagcccttgatggttctggtgtccccgagacctctggcagtagccagcttggctggggtggtgcggtgggaggctcctgtgagaccagaaccggaaattggcttgtttctcagttttgctgttaggattttcatgtttattttaggacatcgtttacataatgaggatataaaagtatcttttccttttaagggaaaacctctagactaggaaaatttgttcctaggatttgtgccatgggtatcatttgaaccaagctctgctgactagagacccctatcttctaggatggggcgtggtgatggggcgggggtcacctgggtctcctggatgggatgtggtgactgagaagtcatcctggtctggacctggcatcggctgccagcgctggtgctgcctcccctcctttctgtgggctgtacactgtcagatgtgtggactgatggcacatgcaatttgagggacagcagacccagggcctgacagagacctcagagatcgccagtgaaggggtgttgcggtcaggtgactgtcagccttaacaaacgtgtgggtgaagagctggaccccccacagaagcctgcccgtgtcctctgccacagccatgggaactctgaggacaaagatgacacacatgaggacccactgtagggaaagataggcgaggcactgtgaaggggatggttgaagaggaatacagaaagttctaaaacttgtttctgactctttaattttgggatatgcactgtttctatgtccatacacagggacaccttccttccttacgtgttgtgaggattgaatgtaacaatgcttttgaagttctaaagcgtaaatcaacattcgctgtctgcacacagggacccctttcttcctcacgtattgtgaggattaaacttaaagcttttgaagttctgaagcctaaatcagcgtttgctctcttctcttgctgcttctcgtgctcctcaccccaagagccattgcctactcccaggctgagtgctggcagcacataggtggggcctgctcgctggacgaactcgcatctggggatgactaccatcagtgtgctctagctctttaccggagcagctcggtccttgttctaccaccttgagactctgagattattggaatccattctggctctgagtgtgcatgtttccattggatatgtctgcatggcactgatgtgctggaggacctcgccatcagtaggatctcatggagacccacatgtcctgtgctgtgtatagttattgttgctcatatgagagcaggaacgggaccccttagggatgggagtcccctttggcatttccagataagcagcgcagatttgggataaaagctggagccttccagatgttaaaagcaacacttatgtttcataaattctggctgttgctcatggagatgagagagccaccattgtctctcattgctaaccacgagtgtctctcttgccacttgctgcccagtgaggagttgggggagttcatggagaccaaaggtgccagcagccctgggattctcgtgctgaccacgggcctgagcaaacccttcatgcgcctggataaataccctacgctgctcaaagagctcgagagacacatggaggtactgcgctttcattctcttacttggagtccttaccaagggttagtggcatggtcagacttactgtgaaagaaagtattattcatgatttattttagaagccagaaccaacagagtttacaaagagttttgttaaatattatgtttttctccttattccagctctattagaaaacatttaccccttatctctcttttacccactgctgctgattgaaaagtttccaaaagctgaaacatgagaactgattttcagatagtgttgagatgtcttacctggatcatccagctacaaacaatgtgtgcataggttatagggtaatactgtactaatcatttgatgaatgattgtgctcttttaattttgaataacaggttgcagcctagcagaaatttgggttgaagttactctcttggcttgagttggcaaaccttttctataagggggcagactgtagggtcttcttcacggctacacagctctgccattttagatactgtatgtgagccgtggcagtgttccaataagactttattgatgaagcaagtgttggcttccccacccctgctgcttgtgactgttctcttccaacttatatttccccaaagtctaatggcttcgtgatttgctgaaagactgacactttaatgctgagggaaaaagggaatgttaagggttgaaaagtgttagaaaagtttcaagctggtctgtagaaagtacctttttaagaaaagcttttccttatgaaagctaattgtatgtttcttttactcaaaggattatcatacagatagacaagatattcaaaaatccatggctgccttcaaaaacctttcagtaagtgattaagcatattgttttcccccccagacattattgtgacaaatgaatgtaaaagaattatcaactgaaaaagtcaaatgattaaaaaatgacttgtgctgacatgaaagaaaaacagagtcggcattctgtggctggtaaactccttttagtggactatgatagaataattatttaaattttttaaagtcactgtgtaattgatgttagatctactttaaaattgtttaaaacatttttttacccttcattcatgttgtctttaatgatttattgcaaaacagaacaatggtggttccattttctctgctgttgtgttgtcttaccaactgcgttttggaaatatatggccttattttatagcacaagttatactttctgtttcttcttttcagtcttccatattggcaaacacgaacaaaaccagaatgaaaatacagttcttgtcctgtccacatttcttttttgtacaagtggcaaaatgtgctctatctttctaaaataatacttagtattccagagcagttgtgtgtgttgcttctcttaacttggtttcatacttctaagcaaatactttcaattccctataattaagcaaatcgctcaataaattatctgtctgaagaagtaagatataaagcaataattgtcttaaggatgatacaaagcaatgtggccggaacttaacattctgaaagtttatgtctgttaacagtgttgttctgtgtctgtcaggcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggtactgctgcccacatgcacgcaccagggtttctgtcccactcttaggagctcatagcagaagattttaaaggcatctcaagcgatgaaaaatgtctaatagaagctctatcttataatttgtgagctactttttattcttgacacaggagagaggcttatggcatgttagagaggcttagagctgagtgtggacttgttgatcagtttgatccagctgaagtcagtgtggcccgaagcccacgtgaactgaaggatagatagtgtgcagaaagacttgcaggagtcctgtgcacacatccgcatggagctgtatgcgcttatctggccagcaactttgtaccaaggctcactctcacagggacctgctgctctcaatgctttcgggtcattatactttcctgtgaaagtatgctagctgacatatgcttacaggagtcacagttttcttacaggtttggtttaagtgagagatcaacccagatttttgggacatacccacccacacagtgaaaatcgagcagtttgtttcatgattcacattgacatacattcaatgggtcactgaacaggcacctctttctgaattttattctacctttgcaaaaataacatgatcaaaacatgcgaaatgactcatttttgaacacaagactccaaggagaataagaaaactaaaacttcaaacttatatagtgtgttttcctttccacctgtaaaatatcaccccttctacatagtcttgtagtttgggtaccataagaaaccatgattataaaaacttcacatcttttcagaagaagtttctttttgagtcatgctcttttaaactttaatctgtggaaacatttcccaaagtgtgttctttataatattagatctatacagcactggtgggtgttactccaaaatgcttcagagtggttctgatcacgactgaacgtaattagtggaaaagattctttatgatagagctcctcagagacttggctgtgaatgttcccaatgtatgttgtgattcttcaagaggggaatatagcaagtcgttctcagtgacttctttaaagtacggaagactcttttctcaaggtgctttgcataagcctaatgttctgaggaatatacttggggaaactaattcctaggactgatttcacttttttgggccgtagtttaaatgtcaacatgtgaaaaggactgtggcatttttttgtctctttttggattcttaggaacttttttctttcacttatggtctctttggcttttatcttactgaagcaaatgatttttaatacataagtaatacttttaagtctgatgtaaaccaggtgatgtttatggggtggatgaaaacaacactgagtcgacatttgggaggtttgggaagtgccaggaattactagtagaccaaaattgattttaacattttatcctttctttagcttaaagactccacctgttccccctgaccccattaaaatttataggttctctcctttttctctgaaccagaaaaagaaaattttagcttacctgaaaatagttaatcacagagctgaactctttaaccaaatatagtttcaagatgttacacaggctaattgtgagtccaggatcttttaatcagtccgtttactttcttaccttttgttttttgaagaatttggaagtccttctctttacctatatgttaaagctctctcataatcatatgttaagacttaatacagaatttatcataattgtttccatttaatttacctgataaaacttgatagaaatacctaaacgagaaatatcatgtaatgtttcatagggcctagtataaataagtgaagtatttgtgctcacatttgttaagtagatgttttttaagaaatgttttggatttctttttttgtattaggaaaagaatgaaagatatcttctactcttcccaaatgttttgctaatgttgtctgccagtcctaggatgagtggctttatctatcaggtaaaacacaatttaaatttatattttattgtggatctgaggataatttcaaactggctttgaattttgtgttaaatattacgtgtatctatctgtgtatgtgctgtgtgtgtagtgctgtatattcagatatggacgtacagctcctgtttgtgtttcgttgtgactgcaagcatatcctatgttaatttcaaaaaaggaaagaagtgtaaactgtagagcaacctcataaggacacagactactgtggcacaagtcagtctctgtcattgccttctgtcgtttcatgcaaaataccttgctcctccttgctatggttttattctgtgaaattggttcaagtagggcttgtgggttagtggggtagtgtagactaagatcttgtgtcagtggcacggcaccgcccaaatgcatcagcaaacagaaagtgatgtaagggtgtaagtagcagtgtgtgatcgttgaacctttttaatttttgtttccctgcttctctttgagaaaatgtgacagcagatttgggaaggaggtgcaagggtgagcagggccttttctgttgcgacagtggtttatagtggtggtatatgaaggagctggtattttcgctgtctgtctagtagatgcacttggcaggtttcattcttctttttctgggaagttacagaggctcatatccttcccatcaactttctgaggactggccagtcaccacgtaaccactgcagcagaagccgccacttcgtgttctctgggttgcatttcattgtagcacgtgttgttttgtgttggcgcagcaaggacgttcaagatccctaagcagacactatgccctcacagaggctctgccgacacccagagaggacttgtggccatacgcttacaccaacacacgtgctttagaattggtgaatcacatatgtaggaacagactcaggaaagtgaggctgtagtttgttaggccactgctgaagagaggtgatctgtggctaggatagtgcccactacagtttcccccaaactagcagctacttctgtgttaaatgaccttgataaacctaaatctctgtcctttctggtcagcactatctggcttccgattttatatccccagaatctcattccagtggctggaggcaggggccttctctaacctaaggagagaagaggttgtcacttgtggcaggcttgagtctctgcctgtgtggctggtgcttacactggatttgcccttgatgtgttgacagactgctggagctcatctcaacaacaggattttatttttccattcttagcacagtggtgacccatggtctctgtatcattggtatccgtttctaccattagaacactggctttgggggatgccaaaaagtgttcggtccagccacagtcatagtgttctatacaccgatgttcagaggggctaggttaaacacagttgtgcggtttcattttctgtaggacttacagctgttaaagtacttatatgcattacgaatcttggaaaggagttcacagtgtgtagcattttttaaatacgcttggccacagaagtgtccagcagtctcctcttccaccggccatgctttaggatgagatttctcagcctgggcactgctgacgttctggactggatcgttcatggccaggggctgggggtctcggtgagactgtcctgggcactgtagggtatcagcagcctctctggcccttacttgctggaggtctgagcccctgccaggttgtggcactgccacccattctctgtgggggcacgttccccacaccagttgagcagcactccgtctggaggtgcttatgtagaatcctgctccgcagctgatggagtgctccccaggcagcgctgcccagacgcccactgcctcttcctgcggacttggtgggccaccatgtactgtggtttctgtcagctgtgccaggatgttttgtgttcacttctgacttgtttgtaatgatcactttgtaccccctttctggtatctttccattgacatttcctggtgcagttaccgatttcttctgttttcagggagcactggtttgccaaccattttgtgcattgtgtgcagcatttagcacaactacttattttctgttttacaaagtagaatgttatgaaattcttgttcttgcctcaatttcccacccttattttgactttaaacttggaacttcctctgcatttctttacgaggaaaatacatggttcttttctgcaaaaacatcatttaaaacaactgttatacacggtagttttttaaaaatcataatgtgtgatgtcttttgtcctggtgtctatgtttagtagcagctcatcagatacagtgtgtgtttgggcttgtcactctgtcccttgtcgccagttgagtttcttgcttacagtacagtattataatttattatttgagataaaaatttttgtattatacacacatctgctacaaatgagctttttttggttcacaaacacagttcctccaccaattctaaaatcatttaatattgactttaataatggtacctttttctagaaaagcactaattgtttttttttttgtgggggggggtcttttttagggaaagcttccaacgacaggaatgacaatcacaaagcttgaggacagtgaaaatcatagaaatgcatttgaaatatcaggtgataggcacaagctgtgtgagtgctgtgtctcggggaggagaggcagcttgtccccgcgtgcagattcttgcttgcgtatttcagaaggtggtgtttaagcgctgagtggaattctggggggtgtgcacgcacgtgctttttacctgtgtttccactcggcctattttttccttctctcctatagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccgtaaggacttggtgcttctcctccttccagactccaggcgtggcatcccgtggctgagctgtcagcaagtgatcagttgctttaaaacctaatcaatatttggataaaaagtgcaaaacacttgcttcacatttctctgcagatctttggccctcttcgtgcagtagtgaattgttttccaatgagtgttctcgagaaacaaccctgaattgtgcctcctcacgcacagttcagaggtgcttgggtgggaagctgcttctgctccgtgtggccctagaagactgatttaggggagttttacactcaactatagatgatttttctgagaattttaactgtttattatgcttcatttaagaaaacaaaaaataaatgattatgatgatgaaaagggccagactcatgttgaaggcattaaaagaatttatgacacactgttgattttaagaaattgaggtgtcttttacttagaaaagctcaacaagtctttggatatttagagacttttttttttttttttttttttttttttacaacttttcagaatagatgaacactgaagcttcagtgtttaaacctctcctggtgttttgtgctcaagaagttggtatcgggttgttttaacagtcgtcatctttatcaagtaatacggaaaaactgggcagagcttttaaagaatgaatgacgatgacacaggcgttttctgcttacagatttcctcacatccttattaggctattaggatcagctctgtcgtgtgctcagttttcatgttttcttcttcatgtgaaggttgtagctcaagaaggattgctgtactctgatattctcatcagagtttcagagtccatctgatttctttcagcagtaaagattgtaactactcattggcttttagctagcatttcatttttaatggctctaccattttaaaattctccattctttcatggagatcagtttatcccagggacgtgtgtgtacacgtgtgtttataaagaacagtggatgagctgcttcactcaggttttcaacagcagcctgaaactctacttcatacaattttatatcaagtcagcttttctctgtggccagaccctccgtcttagtgtttctttcactggtggctgggaaggcatcccttcagcggggaaggcactgtgcctcatgtttaaaatgttctgcattctcctacagagtttcttgtgtgggatgatgtattctgtgatccaactctgaccagctgaaatcattttctaattttagcataaagcatacttcctttgactttttcaagaaaggagaaacaaaaccagacactgctttgacgttgttgctagaagggatgtcttacataattttatccatctatacattatttcctatgaaaagatgaccttacagtggcttcatagcatgacctgcatctcacacaattccctcccccatgcagggactagaatgtgatcgttgcaggaagttgatggcttctattcttgaaattgtggcattagctgccgtccctctcagcctgtgttttgaaggtcgcgcacttcctcagaatgccggccccactccgtttccagttcacagcgccacacagcttgttctcccattaaatgcaccttactattgttggctaatttgaggtcattattggctgattttgagaatgacttatttaacttttctcatttaactgtcattgtgatggaatattttgggttttccaggaatataaaatgcattaatggcacaccgctctaagaagttaatttttgattaactttgttttgattaaagttgagttttctaagaacataattggttttaataccagggtttggcagtgttcagtaaagatccagatggtaaacgttctctgctttacaggttcaggcctcttgcagctgtactctgcccttggaacacaacagcagttttagacaggcacaggcctgcctgtgtgccaggaaaacttttttaaaaaacaaaactaggcgatcaggccttagtttcgcccagtactttatcaccaggtgaagaataatacgtggctgggggggaatcaccttccttcttacagccacatgccctgtgtgcttttgtgaaattctcatctttttactagatgaagtaccttttttctataaatgttactccgtagctaataaatgtggctagtggatgtcttttgagtgctggggccccagctagagctgcccctcctgtctggggcagacgccgtgaggagccccacgctcggcccaggtggcgcgagctagtgtttggccccaaaaactgactgctgagagccagagatacgaatgaaatgataaatcctgaggtttatttcacatggagtgtttaaagagcagaaggaagtgcgtgataagtgccctttcgcggtgagcacgcgagtctcatgttctctgcccttcccgctctgtgcccttggcagctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggtgaggtcccttgaccactcaaacagccagatgacggtgagcatgcctcgggccctgggtgtgcccacgtgctgggccttctgtgtacagcaaaatgcaccctaactcctagagaactgagaagggggggtctgccttggttctctggttatctgctctgctgctgagaggcccgtggtaacctgtgtgggaaggcgatgtgcagggtccccctcctttctgccatgcacaggggggcctttactgcacttgccggaggagtgtgccgccaggggccaggagctggaaaggcgctgagcccaggtggctttcactccctgtgtgtgaggccatcgctcagcatctgcacgctgtctgctgcgtctaacgacccctcctctaggttggggatcctgtccaggagccctgcattttgtcatccagaagccatttgagatgaagagaacatttactaatacaaatgaaaaacaatcacttaggcggtttccccctttgatgcataagaaatcatgatgcggtctttgcttgtctctgttctcatccggcatttttatatttgctaggcgcaaataaagtacgattccaatgaataaatagaagtgttaacacttccttacacttttacctaaaccagcttggatgaggaaaggaagtgtctttagaaatctgttctgagaagtactttcacctgaggaagctgataattgagatgagagttgttttcataagcagttgagcgtgcatggtggtgaggtatgaggagtggcggtgagagtgtgggtatcgtgcgcgtcagtgtgagcagcagtgcccgttggtggggtgtgagtgagcgtgaggatggtgacacgctcttgcctggcattgtgcctctgtgtctggtcaaggccacatttgccaagggaactggagcagactttttctacattcttgccggcagccctgggggttttaaggcccacaggaaagtactgtatgagaaattaggatctgtgcttttcattttttgttctgagtctttgtttttatgatatctttcaggtaatcatgtgtgcaagtcagaatttccattttctatcatgggaagttacttgaagaatgttgctgttccttattgtatactttagtgtgcacagtctaaagaaaaagtgagctactacaagaactggtggagactgaattactagggaagaaaattgggataaaactgttgggcaaagaagtagaaagggcaacggaaggggtattgaagtgaagataaacaattttttttgataagtctggctgcatttgctttgccaactccacactgggagagaagggctcacaccgagcagctgccgtccagtgttgctgagcaccgcccagcagtagcgtggagagtgatcttgcagggtgtgagaagaggacatggaggctcgtggaggccgctctgcagcccgctctgcctggctctggctcaggtgtgctgtgtgctctgtgaccctctgcgcctgcaggtgccctcggagcacgtgaggggcgggcgttggctcttcaaggctctccatctcaatttgcttcgaattagggaagccatgagcacatgtgtataaatgtgtcttctggaacagattgctgctgcatttctaagagctttccaattttttatagaaatacttttgtttaactttttgaaggctattttagattcagagtttgttacgtggctgtattgggtgatgctggggtttgggcttctggggtacctattacccaaataggaaacattgtacccaatgggtagcttttcaaaactcacccccatcaccttccgccttttggagtccccagggtctgtcatttccatggtcatgtccatgtgtacccattgtttagctcccaagaaaagacttttaaagataattttaaaaaccaagctttgtttcctctgtttccagcctggttcattccatagcacatctcatcttctgagtcttggtctcgcgtttagcattcgtgatggtttatgtcgttggggtgatgcagaaaccagcctttttttgatatcggtatttaacacgtgcttgacagttgacaccttacctgctctgttgggacttgctttgctcactttgttttttgccgtcgtcttctgtgcttgtttgaaaagctgtttgaagaggtaaggggtgggccattccgttgtgaacactctgagctggtgtgcatgtggcccctgcacagcagccctggccgagcttggctgtgctcctggcactcagagtcaggtagctgagcactcgctcccttttcttctccctgaaacttcaaatattttcttaaagcaattattttttacttatctgtcatttaatgacaaccttagtttcctcctctctttccagttagctgtgccaggggataggtctgtcctagggagcagctgccccctcctctcctcctccctcaggagcgtgcaggatgtctgtgcacaccagcgccagcctgcctcctggtgacacctctcatcacaggactaacaggacccaaatgacacgaggggttttattagaattaaaaaaaaaaaattagccaatgactaatactgaaaatgccctattgatttttaaaaattaacgttcagaagctggtaaagaaaaatcaaagtaggaaaaggcgagaagctcttatcagtggctataataatttggggttttatacctttacagcagcctttctgatatgccagtgaaaatgattggctttagagtatgttagcattttcttttgtctttccctaggatcttagtaagagccctaagaccatgaaaaagctgctgcccaagcgcaaacctgaacggaagccttcagatgaggagttcgcgtcccggaaaagtgagtacctgcggtccgtgtggtggaggacgtggcctcctggtcacgtaggccatggctttcctgggatagagggaggcttggtggctttctgaagactccaaacaaaagtaaggtctgccccttgaggcagtgataggaataagccacgtaacatttacccaagcaagcaggagaagcgcctttgtgtcagtggtgaagcctccgtgccagtcccggcaccactgccttatagccccttcctcatccaggagctggggccggacctggagggctctcctgctcttctggttctccctctcgcctataagatattccacccacacttcctgaagtgccagcatctcccaaagcaccctgtgtctgttagaagcgtgacctgctgtgttctcctgtgggtagcacccacccgtgctgttctcttgctggtctctctgctgttggacctgtcctgtctgctcctcaggcctaggggtctgactcagctctgggttcctatgtggcctcgcagcaagcacctggcacctgttaggtgctcggtagatagcttttgaataagtggagctcttttcagaagtaagtgattttcctgggggtgactgctgggaaggggtgcacgtgaacagattgctgtggactgatgggtgcagcccagggagagagagccagctctgggaaagttgcaggatctgtcctacagggctctgccctgccccgcccctgtgtctgagctcagcctttgttggtcctttgccttcactgctcacttcctccagcctcaggaggaggcccagcagccgtcccacacgctcactgtgccatgccactgctggcctcccctcaccgccaccttatcatcaatcagcccagtgaggtgaccgtgctggggtgttcattcttttcttgtccttgtcacctgatgtccatggcagtataagtcaccatcctgactgtccttctccttaggtagtccaggtccctgaccaccagggcccctgatgagatggtgaggccctggggtctagtgattgaagtggagctggtgctggatgcctgctctgttgcttactggctgtgccggggcttctctctgagagggctgttctgtgggccacttccttcagcagatccaggggcagcactgagctgggccgggggccggctgcagctgagaccatcgttcatggacgcgtgcttcatcagcaccttcgtgggctgggtgggaaggatacagtgtggccgaaagagatccctgttctcatagagcctatgttttagtaggaggatacagacaagaaacaaaacaagtgaacaatgtgtgggccatggagtgctgcagagacccagtggggaggacaggtgggagattcggtgccagggcgccatttgagcagcctcctggggctgaggaagcaggccaagcaggtgtctggggaggagctctccaggcctggttgcagagaccctgagcaggaaccccaggctgtgcccaagggacagtgcgctgtgtgggcccaagctcccctggcagagcgggaggtagcacagcaccctgagcagcaggcagccagagtccggttccatagacaagatgatgggcccgggttttcacaggaccacgggctgccgtgtggggaacagacaggcacggatggccacgtcgacactgagagttgtcggccttttgttttcatctggctggcgtgtggaaacacgaaaatgttttaattttcatttcttgttttagcgagattggacattttttcttagaactcttcttgttttgtgacttccttattcctatctcctgcccttttttcagtttgagagtggggatactaattttcttacgggttggtaggataatcattataaagttaggatgttcgccgtttttccaaatgtgttgcaaatatttttatttgcatttattttattttattttgaatataactcatgaattttgtagaaaacagttatctgacaagaaaatcaagggcagattatcttacttggtcactttggtcgagttgatgtctgcattgcattcgtctcgccagttgccctagaggcctttcagttcgactgtgaactgttgcgcatctcttgacaggcacagctgctttggaagaagatgctcagattctgaaagtcattgaagcttactgcaccagcgccaaaacaaggcaaacactcaattcaagtaagtttagcaataaggcctgggaagtgtggtggtttattctgtttagtttcaaattacagtctgaaggaacctgttgtggtaggccccttgcacagcccatgcgcctgacctcccagtgagtgatgtttcagtcaggggtggcaggcaggacagcagctgagcttcaggtccctaaattcatgcagctgcgtctgagctgtgggcacaattgctgtgtgattttctagataaaattatactaggaaatatttaaatagaaggtattgccagaattcataatgcttttgctaagagaagacgtgtttagaagatagtggaagattagttcagttatttcagctatttaaactgttggtgtagtactggaatttttggtttttattttgttattattttttagtttcttagaaatatccaaaatacaaaccttgagcaaggtttcttttagcctttctaaaaaataattgcttttaaaaattttttggaaatttacaactaatttattcagcagatttcagaaccacaggatttacgtgtgtctgatgtacagtgtcttaaatgaaaaacttttttctattaaggtggcttttttttttctttttggagacggagtctcgctctgtcacccaggctggagtgcagtagcgtgatcttggctcactgcaacctctgcctcctgggttcaagtgattcttctatctcagcctcctgagttcctgggattacaggtgcgcaccaccacgcccggctaatttttttgtgtttttagtaaagatggggtttcaccctttgggccaggctggtcttgaactcctgacctcaggtgatctgcccgcctcagcctcccagagtgctgggattacaggcgtgagacacagtgctcggccctaaggtggctttttttctttaaatttttcctccggtgttgccagtgaagcacagcagggtggcggctgatgcagcgtgcctgtcatttaccctgctggcatctgcgtgcccacaacagctgacatgtgggcacgtgctgctggggcctcggacaccacaggtggtccttttgagaactggatgatttctgtattatctcagcatagaaactgatgtatcctcaaatttaggacttggtgccctttccagctcgactgtcacttaatctcacttgctcgttttgttaatcacctgcagtgtggtggttccaattagtgtcatgtattgtttaatgctgagaaaaggagagagagggaagaggacttctcaactgctttagcttttatcaaagacggctgcagctgtgaagataggatgagcagggtaaatccttcacggaatctcgattatccagaagcttctttttttttaaccattttcagtattttactggtgtcgtaccatatcccgtctatgacattaagactttttgccaagggtcaacactgttggtttttttgtccatactttagtgaaaaatatccatttgtagtgactgcttatcagaataggagagaaatagagaaacggaaaggcctgggtaacccatcagaaggtggaataaatatgtgtataatcacacaataacgtctaagtacaaattgttgtgatgaaaggtactacatttttataatttgatattgatcatgttttaagtaataggctgtaaaatgtggccataaatttttggattttgaatttgagatttttttgtcatctcaatttcagttacttgaaataaaattttaaccaagtagtcttagatgaacagaccaggttcagttggccacccaaccgtgtctgtgagttctgcatttgtgaattcaaccaactgcagataactactcagaaaaaagaaacaataaaaagtaacaatataacagtaaaaaataatacaaataaaaaataattatacttataacagctatttatatggcatttacattgtattaggtactataatttagaaatgactcaaagtatatgggaggttgtgtgtaggtacaatgcaaacaccatgccatcttatatcagggactggagcgtctgaggattttggtgtccaaggggagtcctggaaccaatcccctgtgggtgagggccgactgagggctgagctttgtatgtgtcatagtgcccaccacatttcttcatgaccagggtcctgtgatacgctgcggcttcacggcccctggctgcctaaggggaatggcccacaattccttttcttttcttgtcacattgcctgtattctgtacttccatttctcctgtgcaagaaaagcattgaacgatacattgatttttgtttttaattcatattatgggcaaaccactctggggcttcagggagcttgcagtcatatatgccctttaaacctaacactcaaaactagggagtaataggagaaattgctcgcttgtgctggaaaggtggtatacttactcaaggtgtctggaaatgggatcatagtgaaagcagctctttttacattaaatgcttagtaaaacgggttttagaaggataatatattttacctaaaatgcagctctgttcaatacacacatttggatgccaagaagattttgtaaaccaaacttccttggtattgatttctaactccaggaagtaacggccctcacagtctgttatgatgtagttctcgcagtctgagaacagaggtcaatttgatagaagcaggagtagggaggggccagggctactgtgatttgccttcacctagcgaggggcatccccgcctctgcatggagggagaccctggcggcccagcctgcctctcagcccaggtgcctggccatgggcagtgctcatagttgccagccactcgtgattatttctctcctgacatgttgtgccacttcctctgtcattctccttttaacactgggacgttgccagttcatgtctctcttcctgacagcagagggtctgcattggggtggccggtgttgccagcagacccagcttcccactgcaccctgcctgcgggctaagctccagcgcgccctgggagcagggggtgggttctggggctgtgggccctgcccaatccttttctgccctctgagttctcacagtggttattgattgatcaggtaagtccagacccactctcaggtttatggtcttggcaaagagccagctgaaaaagcccgtcagaattcctttgaaattattttgcatttgatacatctgtttattgataggaaacaatttttaattagccacataaatggcacctttcccaaatgatgtcctaaatgagactatttgttaattgaatgtggaatagaattgattaattgccacatgtctatagaataatcttttggacatgggtgtgatttgtaaaagatttcttaaatgagggctttagagcaatatctttttttaaaaaagcagtttgaaacattgtatattaggtttaattagataataatcgatctagttttattctaagggttttgctaagttcgttattgtgaaacccagccgtatataaggaaaaatatgcattgttgccaatttttaacactattttctcttttccttctcttcccatcaccttttgcttttgttccatgttttggttgtggctcttcctgtcgttctcctcctcaccccctgcctgtcgcgcctgtccctccgcccgcccgtcttagcatggcaaggcactgacctgatgcataatcacgtcttggctgatgatgaccaaccaagcctagactccctggggcgtcgcagtagcctttctcgtttggagccttcagacctctcggaagactctgactatgacagtatatggacagcccatagttacagaatgggttctacatctcgtaagagctgttgctcatatatctctcaccagaactaatgcacttctgagcttttcttaacaaatgcttgttgtatcgcagcctgcttttcttagatgttttcttgctgttccttgtctcttttatgtgatattttaacaacttttgagagtgttcctgatatttcccattgtactttgtggaggcttaactgccgatgcgagtatacattcgaatgactgactattggagggaggtggtgtgttcacgtgagcctacatccgagggtgctcttcgtaaggggtagttgttgttttatagctccaaatggtttttttattctcagtgtagcaactgtttgatttctttctggatacagctgtatgaacacttttctattttatactgaaatcacacaggtttgtgatctaagtgccagaaccatggaggagactctggccttatctgtagggacctaaattttttaagtgctatgaacactgatcaagtagttgtggagagatgagaagaatatatgcagcaaaggtgctgtgagcccagttccaacggctgtgttctggtaatcgtgcagaacagcatgtgggctctgggccttggcaggtgcacagacgggcgggcgtcacgtgtgttcagagcttgtctccacctcacggctctgtgctcttctgtgtgctgcgttgtggccgtgaagtgggagctctcctttccaaaggcagagcttactgtcatggctcagatgttcactcgcatcttcaccccaaacttccctgaattgcagtgatttctgttataaggcacatagcaagcctgtaccactctacagtaaaatctctacactaacagtttaaagcccgaaagctgaagcattcagcctctgcaagtgtagactactggactgtagtagaggcatttggaatacttacaaagtcaagtgctgtggcttcagttcccccggctccccacccctgacatccatacttatgttgtctggaagagccatggacacatcattattttcagcaaccagctgcagtgaaactccatttacagcaaccccatagtataaaaccacaatgcctcattgtaatgggatattgaagttcattgaagaattactaggttgccatgtggctcacttatttaaaaaaaaaaaaaaaaaactcacccgttttcctgggatttgttgtaaggagttttcactggcctcactcagaccaatttctgcttcaaaaagcactgaatgtgacctgttgcattcagttgtagcatcaaatccacacctagtcattgcttgaggggccaaattgtgttctgtcccatgcacgctctatttggtgttaaaatggaaccttacggttgtgttttaagtattcattgaaaccagcttcagaaaacaagatgccatagtaaattgagaataacattttttccttcttcagggtggctgtaattccaggtggccgtgatttctttcttccccactgcccactccttcgccaaacccacgtattcagtgttctgatcttgtttgtgcagagtgaactctgatgcagtatcagtcttgtcctgggagccgggtcctgctgctcacaagcccagagctgccagggagctcctggcagtagcacgttgtttagaaagttgggtggcttcattcagcatggaacaagctaatggcacaggagacatcagggcagctgttaattccaaatatttgttcccaagtagctactgaactgctcacaccattggaagattttgtattttcataccaattagtaaaaataagaacattgaggagcagtcagagcccagtgttaatctccggcagagatggggtttatgtatgttcagccagatagtaaatgggatttttggagaaataagataactacaaagtttctatacttactataagtggatttagaagcgattttggttttgtattacatacggtagtcctctgcgtcagggagcacttttttgtttgcctcgagactactcattagcgcactggctaagctgcctttgccttctcgtaggcgtgggttgcctgtgtcatgggctgtgtagaccacaacactcaaacacagttgctgcacttggattttcctttaataccaagtatcatttggttatcttactgggacattttcattgatattctatacaccaaagttttgacggtttaccatcattccattttgtaccagttaaaggcattttgatgatgctttttcttgatgctaagatcactgcagaagaataacctgaccttttctttgcatttgttttgaatgtctaacaccattagcttttgtgatctggttaagaagtattagtgccacaagcctgaaaagacagttctcctgtggcagtggcgatgtggcatccagagggccattgtttctacttttgtgggacttcagtcatgctgataatagaatcttctgttcatacaattctgtaatatttatttgtacagttagtattctaatgaaaggatgaagagtctgaactagaaggtaggtttaagccatcaccaggcctttgcaaatggcctaaatggtgttccctttgaaataacgcttgccacaagtatataataagctatattaattgtgttttgcataaaattgccaaaacacagtaatgtgtatatagtggtataagatcttgaaaaaaatctctataattgtgctctttatctgtgaatgggaaaagccatttttagtaggtgactaccatttgaaaaactcaattggatgtatatctgaatgttgcattgtattgtacagtatgcatattattgtttgtggttgcatatggcaatgaagtgtttgttttatattaaaaaaaacctgttatgtacagttgaaataaattttgcatttgctagcccgtggcttttaatatttgttacatgggggaggggaatagcatagtttgcagtgtaatataatttggctcttctacctgaacggaacatcttccaaaggcaggcaggtgatagatagaacccttctgtctgccctgatagaaaagcttgcactctcttagattagccgtgttctggacaagacgaagtcactccttgtacatttcttatttcatctctttcccgtttcttaagaagctttcagtcactggcgggtttgtcttcagaaagaagcattattttttgtgtgtgcgcataaatgggaaaaagcacaactttaaaatgtttttatttagactaaggccagtttttaatttttgttttataaagtgcttatccagctaagagagtaatgaagcaaaataaagggaaaggaaacgaagtacctggtggcaggtatagtgataggacaaggtgcagacagtaaatgtagaaaactctctcagcacaagttgggagttttcctaagaaaagtaaattagacccttagagccataaataacaaaatggcctagatgacttttggagagagattactaaatcgtttttaagtgtagttgtattttgctccactgtgaatgttatttgattttcagttgattagagatgcagattttagaaaagataatgaatttaagaaggtgaattatcctgcacatgtcctggttcactggccagatagacaggtgttctcttctgatgaacttaccctgtttttaggcttttggtacaggcaggcttacacaagcatgcatgcacaccacactggtgcctgggctggacagttgcgctgcgttgctcctggagcagttagttgtgtgtcgtcagataaggccccagagtggtgtctaacagccaagcgtggtggtcgcgagctggcactcggggccccaggggttgatcagcactgtgttgctgctgtagccagtcatctcgtctatgaaatggaaatgctgggttagatctgtgtttcttaaacgaagttccatagttctctagagatgtgtgactatttggggtgggggaggggcagggttctcagacatccctaaaatgttaagttttgtgctcatgttaacacacatgtgtaccagccttctgtggctcacacctctgagtgttgctgtggggtcctggtgccccctggggtctccagtcgtgtggcacacagcagcccctgagagtggaatgcttgctgcaggatttttcagcactgggcaggcagacaccgagcatctacaggcacattcttggagtcctcgagtttgagaagtgctggattggtgttaagtataaattatttcattatattcgtgtttttcttactcccacctccatacggaaataagaaccaaccagctgttttgtgtatgtggttatagaaatagattataagctgatctagcacttctcaaaatgttagccacaaaaccacaagatgttaataatgatatttaaaagaaaaaaagttcagcactcaaatgcatttcagaaatgctgaatgaaagttaagtgagtatttttatggcagacttcatcagagcctgtactgtgctaagggtgcgctgtgattctccgagaagtgtagcccacaagatttcccgaaacgatgtgttgtggaacccctctcatctcccagaaacaaaacagtttgggaaacacagatcttgactgtgctagaaccatcatgaatgtgttcatctctgtctgagcctctgttatggattttaaataaagcgagagaacattatcggatcattctgctgttaaattgtttttccattctaggtaactcagggaataatgtgctatgatgtctctaaaaacacttaataatttctgagataacttgttaaatctgctttctaaaacatcgttctttaaagaagtagtcaacttacgtaaacctggctagagaacatttctttgttgttttttgaaaggtagtaaaaacttttcaatcattttagaaaaactgtatgttgaaaactaggcagattattagaattgcataatttctaggcgtgttaataatcctcatttacaagcttcctagttcgccatcagatccgtaaatggcatttttcacattggtgcatttcaggaatcaagcagtacatcctatctgtgatacaacattttccaccttacatttgtgtatccctaaatccttctcgcatgctttaagtgtagctgtagaaataagacctgtgccgggcacatacagtaaccgtaccagttcttagaggcttagttcctccaatcatgctacataatggaatgacttttacctttatgacttcatctgttaaaagatatttacaaaatgtaatatttaaatcctcagaacagctccagagaattagttttgccgtgctttgtaagtcatgaaattgagactcagtgcttaagtgctgtgcccaggttaactgaaaagactcaccacgaggggcgtcctggttctggctggaggcagtggacacgtggctcatggcctcacaactcccgtacggaagtcgaccccgtgtctgacccatttctttacaaagttgacattctttgtgatcctattttatgtcattcgaaaatgttaatgttggaaacagatgatataaacaggttgtctaggaagctagaagagacaaaaataattgaaatacagaatttactttgcctgatccgcagttacataactttttccagtgtgtctcattagtgaatccatttgaagaaatgtgtagcaaacaatgtgagatacacaagtgatgcttttgtgaatttgactctgaaacagtcatcaactgtctgggctcaaagcaggacaactggataattggtgggaaaattagttgactaaaatgtgcgatgttatcagtggacttctctttgcagggaagagtaagtgaagccatttgatttcttcacatgtggtataaatatctgaatctttatgaatattctggattttctttgtttcattttttattttctatgaaatttctgtatcttttgggcaaatagcacatgaattaacattttctggtagaaacatgggtaccctttgtatttgtatgagaaacactggcagcttctccacctggctggcaccccatgctctgctgtaatatccctcccacatcagtttccttcctaagcagtatcttcccgtgtggcccacgtgtctcagcagcattacccgttagccaggaagggcccaccagaaggcagcccagggcccactaccctcagggtcctctcccgtggcctcttggagcacaggcacctggagtgtcaggagtccttgcagcccaaagggctgtctccgtccttgtctcctggacctgtagagattcctagggctgatactaccagcctaatgttttaaaaaacgtttttctgaaatcatatcttgcagtcctgtctgaatcttctgtccgaaaagttattcccgagacataggtcaccgtgtgtgtgggtgggtggactgtggcccaggggacgcatgtgaggagctgggccctctccttcactccctgacagtgtcaggtctgctgctgccagctggtagcacagtggagacacaacagcatgagggggagggagggtcgcctttgaaggggcatttggcccactttaacaacagccgcaggtgtgccagccatggcttgtgactgaattttaagtgctacatttgatcctaagatcctgcagttaccctcattttccattatcggtgtggcaagtgtctcctgaagcttgtgccaggtgacagagcagcacttggttgctttcccaggacgtcatcttatcttcttatgcccgcgaggatgaaggagcagtgtcttgattttgttcagtccctgaatttccagtttcccaggggttccattctgaggagtggagcaggttttgcagacgcacaaggggcagcacctggccagtgagctccaggcctggttcctgttgcacgctgctgtggaaataacagtggtgccctcgcgtgtcaggaacgtcttatgagacatcttaagctttggcatcatccttaaccttgttctgctcaggggagcctaagcgtgcagtaaaatgctggtgaagccattcatttttttttttttttttttttttgagacggagtctcgctctgtcgcccaggctggagtgcagtggtgcaatctcggctcactgcaagctccaccaccaggcttcacaccattctcctgcctcagcctcccgagtagctgggactataggcgcctgccaccacgcccggctaattttttgtatttttagtagagacggggtttcaccatgttaaccaggttggtctcgatctcctgacctcgtgatccacccgcctccgcctcccaaagtgctgggattacaggcgtgagccacggcacccggctgaagccattctttaaaatcccgtcttcataaaacattcgtattgtactgagctttcctgtgacagtgaggctgcacagcaagtgcctttcttatgatctgacaaacttttaggaacaagcaaaaggcgggccagaagaaagacccagcaagcggaagcactgtagtttccatagttagcgagcgtgtctccaacatgagtgtcccttcttcatggagaaatgtttctcatggtaccgcttgcaggtgcttgtgttctgtgatagattatagccttctgatttgcatctggcataatttttcaaaaatataaatggtacacgttgtaccatataatcttcaagaaaatattttctttaagaaaagattttctcccttgcatcattaaatacaatttgattctcttcctcaccttttaaaatgagtattttgatttcctaatttctaaagtacatattttgcaacatttattgagggcctttcccatataagctcttgtgtaggtgttggttaaatgacagaaatgttctgacattgtgagcagtttgctttcatttagaaaaatgtttatattttaggaaatataaagttttcataaaggaccaaataatgttattttttctaaaccatgtgctatgatgctgtaatatcttgattattaaatgttgctgtagagtaaaatgtttttattgccagatctttgatgtataaacactcactgtatatgttctgattggtctcatatgtctttgctgaaactcttggaataatggctcaaaatgggatgaatatccagagcagtacagtcacaacctttaacttcctccctgttgaaaatgctggggtttcaacaatccgtaattccgatttgaaaagggctacagtttccttccctctctggctttggtcatgaggaggcctgggctcggtagacagaggtgaagagaactggtaaaagatgccctcctctagcttgcctggatgaacgtttttaaatgcataattgctagaacttaatatttaagtgacatggtatagtcaagttgtttttcttcattctgccatggtattcgcctgaggtttatttattattttttcatgatcctaggttcacgcaaagaatctgctccacaagttttgcttccagaagaagagaaaattatagtggaagaaactaaaagtaatggtcagacagtgatagaagaaaagtaagatgtcttccggtattctaaagcagatgtttgacctctgcggtggggtagtagagtccagacaactccctgagggcgggggtatggcttcagaagcttcactttttttttttttgagacggagtgtcactcttgtcacccaggctggagtgcaatggtgcgatctcagctcactgcaacctccaccttccgggttcaagcggttctcctgcctcagcctcccgagtagctgggattacaggcctgtgccaccacgcctggctaatttttgtatttttagtagaaacgagttttcaccctgttggccaggctggtctcaaactcctgacctcaggtgatctgcccgcctcggcctcccaaaatgctgggattacaggtgtgagccactgtgcctggccagagcttcacttttaaaatgtcttcataggctgaagttgcccttgactaggcttgaacctgccatgcacagaggttggcagtttttagttgtgaatgtagacagtacatgggtaaggcagagcagctccgtgtcctcctctcagcatcgtagtgtctcctggtaagttttcgtgtgtcctctccatgcctcaccttgttcatgtgtgtgtgttctgtttcctgtttcaggagtcttgtggataccgtatatgcattaaaggatgaagttcaagaattaagacaggtacgtcataatccatctttaaatcttttttttcttttcaaatgggagaaaagaagaaaattacattaaaaataagctggctgggtacggtggctcacacctataatcccagcactttagaaggccgaggtggacagatcacctgaggtcaggagttcaagaccaacctcaccaacatggcaaaaacccatctctactgaaaatacgaaaattagctgggcatagcggcaggtgcctgtaacccagctacttgggaggctgaggcaggagaattgcttgaacctaggaggcggaggttgctgtgagccgagattgtgccactgcactccagtctgagccacagagcaagactccgtctcaaataaaaataaaaagctgattgtccataagcaaaaaactaaaaggaggtcatgtctttgagaagtccagcagataaaataattggttgtctctaaagtgacttgtttaaactcttttttttttcttaacaatactgattttgatgtcataaaacatcgcaaattctgttggaagaataatttaaaatatcgaaagttctgtctggtgacaaatcctgcgaggcgcccctgagattagcctctgccactgcatggtccttggctcccgaagccaggttagcgagccagaagtggcgactaaccaagggtgttctgggtattgcacggaatgtgagtatgagcagctttggtcctctgcccagctaggcgagggaaggttggggtgttcattgcacggaatgtgagtacgagcggctttggtcctctgcccagctaggtgagggaaggttggggtgttcttttggccgaggaacagcctgagaagagttgtggtctgggatagagagctgagagcaggttgctgtgtggaactggacatgtgctgtcattctaagcagtgtccgcaggtcttccaggtacacctttgcctggctggcaggcttccatgttcacgctttgcccctaccggcagcaggcatctgtttgtgcatgcctcctacgtccgagacatgcctgggttcagctgcacagagcaggtgctcgcccacttgctcctgcacctgtcagtggctgttacttccagtcctttctgtaactctggaaggtggttataaatggacaaaaaggctggataggagctgtctcgtccgcagtttccagctattttcttacggtatgttctatagagattcattcatggacttaataagagccattaggaccatttccatcccgggaacagcagcacagtcaggagcaccgctgccaccctgtccaggtgtttgaccttcgtggatccccacgacctcagagcccataggcagctcacgtgggatttcatgaatcgaggccttagctcctcaaggatacacatttggggaaaggaagccctacgcgatgccaaagatagtgaacaccctgtggtctgcttaatttacaggacaacaaaaagatgaagaaatctctagaggaagaacagagagcccgcaaagacctggagaagctggtgaggaaagtcctgaagaacatgaatgatcctgcctgggatgagaccaatctataagggatgtcctcagttctttctgttgaagaccagttctgaggtgaagctgggcacccctgacccaagtcggggtgcactcaggaccacagggcagggctgggtggggcgccaccttgctctctgtatatagaaaagctggagcttattctgcgaatggagacgatcaaaccatgactgatgaatccagacaggagggattgactctgaggacctgagctacatcaatccactctgtgaacatctcagttacctcattctgcaataagttcagtgactgactaaaagtcttgtttttccagactttgaattgaatatataaatattatatatacatgtttcttgtaaatatcccattttgaatgcatacctgtggtggttctgtccgggctaatccccatgctagaatgtcctttccagctacgtgaataagaagtcccatgcccgcatccaccggaagcagaagcctggtggatgcctggttcgttccgcagcaccagggcctccaccgtgctgtggcagcaccccccatgtcggtatttctaaataaccttatttatacctgcagagatacacttcagtcccattcagaagtcttctcttaaagcagcattacagtcccagacctgcgggtttctgagggcaacttgctggctgacagactcagtcttgacctcaaggaaggcccatacggcactgccgcatccacctagaggtgtttgctcttgtccgctgtctgagtactgtgattctcagatgagtttgctgcgttttgggaggacacagacggttctgtataggctagttcagtaacaacaaaatacactgttttgtcttccctcaaagagagatcttactagaacctgtaaatagaatgtattatttattataagtcactgcagctgatgaaaacagatggaggccatgctgcaggctgatactgatgggtggagttttgtcatcaggccagcctcatcccgaggtctcctccaccattggccgtagccagcaggcttcagtgctcaccgaaagtaaaatcccctccttcagcaagaataaagcaatatacaccttaggttccactaagtaacataggcataagcagggaacgtttcccccactgtgttccagtgcagaggagacgaagcctgtcctcaccgcggctcgctgggcccaggctggctctggaaagcctgtgcggtcctgggcaggaagcccggcccgtggagcaggttttcgttctgcttcagcaataaataagggtgaccacagggactttgcttttggtttcctttcctgtgaaaaggttggttttaaagtgagatacacttttccgtagaacaagtgttctatctttaaaaacccaaattgcagcaccgtggattactggtctcagaacaactcattgcgcatcagatttgactctctgattttctgtctattggccaaattgccctttaactgcacctgaatcctttgtgtactgatgcctttgagctgggcaccttgggagagtgttgtgttgctgtttacggttcttccttgcccttgctaattacagtctctggtgcccagcaagcccctttggcttccttccgtgactggtcacgttgtctgcctgggctcagcgtggacctgccccatgctgcagaacctggcctcacctggacttttcactagaattgccagcttcctcaacttagcagatcattcactcatgcgggcacaagcaaagatcaacactttcttttttggtaagcttgagttttacaagttattttttggtgatgcgtaagacattgcagtgggaaaccattcaacttgagtttattggagtttgctgttgtagcaggttttaactcaggaacaactcttgtctgatctctccgcccctctgccgggaggcgacattaactgtcctctcggagccggtagcgttgctgtccgagtccccaggacggatctcctgcagacctgccttaatgctcagatcgaagtatttcacaagaatacttgtgtttttaacagcccttcccctggacggtgcggccatgagggcctcatgttacggcattgccttttctttctgtggatccagtatcttcctcggctttttagggagcaggaaaaatgcgtctgagagcaactctttttaaaaacctgccctgttgtatataactgtgtctgtttcaccgtgtgacctcccaagggggtgggaacttgatataaacgtttaaaggggccacgatttgcccgagggttactcctttgctctcaccttgtatggatgaggagatgaagccatttcttatcctgtagatgtgaagcactttcagttttcagcgatgttggaatgtagcatcagaagctcgttccttcacactcagtggcgtctgtgcttgtccacatgcgctgggcgtctgggaccttgaatgcctgccctggttgtgtggactccttaatgccaatcatttcttcacttctctgggacacccagggcgcctgttgacaagtgtggagaaactcctaatttaaatgtcacagacaatgtcctagtgttgactactacaatgttgatgctacactgttgtaattattaaactgattatttttcttatgtc

SEQ ID NO: 36194 - DNA, 57717 bp, Homo sapiens
gcgtgcgtgtgtacgactctgcgtgcgtgcgtgcgtgcgtgcgtgccgtcagctcgccgggcaccgcggcctcgccctcgccctccgcccctgcgcctgcaccgcgtagaccgacccccccccagcgcgcccacccggtagaggacccccgcccgtgccccgaccggtccccgcctttttgtaaaacttaaagcgggcgcagcattaacgcttcccgccccggtgacctctcaggggtctccccgccaaaggtgctccgccgctaaggaacatggcgaaggtggagcaggtcctgagcctcgagccgcagcacgagctcaaattccgaggtaagccccagaggccgccaccttcctgcccgcggcctccgccccagtgctggaaggacggagcccggcgcggcgggtgacgtcggccctcgtccccaccccgacggcgctgtcgcggggggcggcgaggccgggccgggccttggcgctcgccgcgctccccagaactgcccggagtggccgggacccgagagggctggtgcgggagccggggcctgcgcctcctccccgacccccagcctcctgggacttgccttcgaggcacttgtcactttgtaacttaccagtttgtgatcctctctagtgtgagcctccgccgctgcctttgcctagaagtttcttcccctgctccgtgacagtgttgacctcagggcttagttgaggtgtcagctgctcagagaggcctgctgtgaccacccagccaccgtgcacacctgctgtcattccctattccgtcactgtttcgtggtcagcacggcacttttcatacccaaaatcactgtttcaatactagaagggaaactgcatgaggacaggctcttgtcagttcgctgctgtgtacccagcacacattatacgcctagtaaataaatacctgttgaaccaacagatgaacatgttgaaccaacaaatgaacctcctcaggacttctgatgggattgggcccattttcctttcactgcgtccctcatgctgtctcctggttgcggtgcaaggaggctgccacggtgctgggatcctttttctccgcagagctgtctggagcaacacctgcggcgatgggaagccatgaccctggtttctcccagatactattacctctgtaatttgtgcctttatgttttctatgttgttacttttgttttttttttttttttcctaccttcaccagggccacgaggtaaaagttcttgtctgacatgctcattctttctttttgcgtgtatccagtgatgtgggaggctctggggaggtgatggatgcacaagacagataaggcctctgctctcacagagcttaccttccgacgaggacagacaaaccaacacacaagatcattgcagatagtgctaagtgctgtgtaggaaatggaacagtctgactccatggaagcgtactttagattggaaggccgggtctccactatatcgctagcaccggactcacagtagatgctcagttggtatttatgaatgaatgaatggccagaggctctccagtttatatgtcctattgggaagtagtgtagggtaacttacccaaagttacccagttggcaaatggtacatttgaacccagacttcagagttcacgctcttaaccgttttgctgtctgatcgctgggaaatactccagaacggtggctgtcactttgccttccaagttaacaatgtgaaataactctgaatttacagagaaccaaaggctttccaattaaaatgaaaaaaccgaaaaaccccaccaaacctaccgtggattgtaattccaggatagtacttgagctttcatgatgttctcatggccttctggggatgccagattgggaaagaagtccaggtagctaaagtgaaaatagtgagccttagtttccacttgagttgtctgaagttctttctctatctgggaggcctggcttggcttctcctgataattggtgggttcattcggttagtccacaaacatttactgagtacctgatctgtgtgtcagatacccagagaagccaagttatatcagctgtactctcctattttccctcaacctcctcccagtactttagggaagggggcagatgagaataacagccaggacaggacaatgatgtagggtagtccagagtgctccaggagcattgaggaggtcaactcctgaaagaggtgtcatttgagctcagttataaaggtcgagtagaagaaggctcaaagaaggaaagggtggggaacatttcagacagaggaaattgcatgcacagaggcacaaacactgagatgactgggctcctttgggatgccactagtagtttttttttttttgagatagagttctcactctgtcacccaggctggagtgcagaggcgccatctcactgcagcctctgcctcccaggttcaagtgattctcctgcctcagcctcttgagtagctgggattacatacaggcatgtgccactacgcctggctaaattttgtatttttagtagagacggtgtttcactatgttggccaggctggtctcaaactccggacctcaagtgatccgccctccttggcctctcaaagtgctgggattacaggcgtgagcccggccaccactagtggttctgaatgacagcaacaaagaacatttgttgtggttgcctggcaagatgggagacaaggctggtgagtagacaagagtcagatctcagtccctttatgcatagatgcagccagtgtccaagttaaaattgtgttgcttctccttgagcagtccttccttgcattaactttctgaaaacccccaaatcccagtacaaactctgttgtctaatatgttatggaaagaggcactcatttgagaaaatttaagattttgttcaattgttttactgaaagatgtgtgaccttaggccacttcactcctcaaagcctggggtggttattcggtcaatggggatgatgctcgtgtccacgttgcctcttgtagaacgtgtttagaaggaatgacatggctgttagtggctttgtaagtgcatagtactatacagagattagacaaccacttaactacttaagtggtttcatcacttctgtacctgaaaggtgtggcagagaatagcgatcattctggccctggattggccaaagtaattatgccaaagtcactggatatttttgctagggaagtggtccaagagaagtggtaccaaattgttgaaggcctctggctcataactttagaagagacatctgtgtgtgttcttaaatgacgtcatgaggtgtgttgtttgtttgttttaaactgaatgctaagacagtacaattaatagagactgaataccctgacttagagataattcatttcaggatgagaaatggcacatttaactggtttcttccaggttactcagggtgacgactctgatttctggtcgttcacctagatgaacctctgagctaactttacttgagaaggtaataactaaaatgcccattcaaaggaaaaattatcttttaaatgcagcctaagttgatcgtatgggattgtatattgtcagactctttaatcttgggaattttgtgtggtatgttaaatttaaggatgttacagaagaaaaagaatgcaaatttatatgactttatgcagttttataggaagtactatgctgcatcataaatatcaaaaggagaaagcctggtggcttcctgaaagaagcatgacacaggaggatttgcctagacttaaggttgactttcatgagatatttttagtaagtgaacattaagctctttcagactaggggtatctttctgagagagtaaatgtttttgttttttggcagggtcttgctctgtcacccaggctggagggcagtggtgccatcatagctcactgtagcctcaaactcctgggctcaagagatcctcctgctttaggttccctggtagctaggactacagatgccaccattcctggctaatttttaaatttttttgtaaagatagagtcttgccatgttgcccaggctggtcttgaattcctggcctcaagcagtcctcccgcctcagccttccaaagtgctgggattacaggcatgagccactgcatgcagcctaagtgtgtgttttcttttatatttctttttgtctttttcactaagtcataggagttttttaaaattgtcactctttctgttgatctcagttcttccaagtcctaatcgtttccttgccatctcctcactctgagatcccacttgttgtccagctcaaagagagctttccgaatgagtcactttcaaggcattatatagcactcttctttcattcccttctccctccccttccatgagagtccatctgtggtaaatagtatgtcatatattttttggtcgttcaggactctagatcattccttacatcctagcccattcccccagcaatgatactgtcacatggaaatggtctgttgaacatccatcctcactaggttaaggtttgttttgttttgttttgttttgttttgttttttttgagatggagtttggctcttgttgctcaggctggagtgcaatggcgcgatcttggctcaccgcaacctccgcctcccgggttcaagcacttctcctgcctcagcctcccgagtagctgggattacaggcatgcgccaccatgcccggctaattttgtactttcaatagagacagggtttctccctgttggtcaggctggtctcgaactcccgacctcaggtgatccacccacctcggcctcccaaagtgctgggatgataggtgtgcgccactgcacccagccggttaaggtttaaacataactgtggatgcatttacttttgctttattgcttgactgaaccaatgaccttcaagaagtcttagatagtcctgccattagtagggatctcagatgggagggcaccaatgaatcagtgtagttgagtaccacttttgggagaaaatagaaacttggacactctaaatgatagtttaaggacgttgtttgttttgttttgttttttgtatgggaaaagttggcttagactctttagttcagcccttcaagttgatgtgtaatttaagattgtttaggaagttaaaaaatctaaagccctgtggatatagttcattcagtgcagtaattatctttcagatgccaagtacagcattaattctttagctttagcatggcactgattttcttaacacttcatgatcacgtggagcagactgtgctttacagcacaacagagcgtcagccatgtgctgaagattcttcgtggtagtggtttagatccaccctgaatagattatcttcatttatttaattattaagtagcttgcttatcaaaagcggcattaaacttactaaacttgagtcaaacgtaaatcttcatagatagtaccatttacttctgaaatcttgttcctgggagaaaaatgtggactggaagttaactttcttttatccacctattcactcctttttcttcacagttaactccttaggggaaaaaatgtatagttcttgaccatgtgcttatgtttgtaaagcaatgatgtttccttaacgtgagtggttgtgacatagatcactgttatcttcataattacctgggagcttttcatccaagtgtggatttactaaaataattagtctgaattgatgcttattaaagagctgaactcttaaacgttaacactatcttgtatttattaaaattgtatgcatgtttccttcaaatgctgaaggcagaatactgagaactttgaccctgtgttattatcgctaagtagttgaaaattaggggaggagtcaagggagtatattatattggttatcactcaaatactacccctaggcatgatttttagaaccgaaacttgaatttttacataaagaattatctccaaaagtgtcttttttttttttttttttgagatggagtcttgctctgttgccaggctggagtgcaatggcactatctcggctcactgcaacctccgcctcctgggttcaaacgattctcctgcctcagcctcccgagtagctgggactacaggcacatgccaccatgcctagctaatttttgtatttttaatagagacggggtttcaccatgttggccagatggtctcgatctcttgacctcgtgatccgcccacctcggcctcccaaagtgctgggattacagacatgagcctctgcgccaggccaagagtgtcttatatatccccacttttttgaaaaatttgctgtctaaaggatgatcatgatttgggacgaatgagcacagctttcaactagatgacaagaaagatgaatacaaagagtgctgagttccattagtcaagacaaggttgccatagaatgtctttaataaaataaaacaaaagccttttgcgttattttgcaccgaggattgtgttaaaaacaaagttgcattatggtttccagattggcatccttgtttttttctatcattttaggcccctttcaggctgttatcagcatagcatatccaggattgctttggccttgctcagtgggtatgtgcgttctttgaagttcttacctgacagatgtgggcagctggctttacacaaggaagagttgtttaaagagctttggtatggaaacaaagttactaaacttgacagtcacttgaggattatttaaaaaacaaacaaaataactgaatgtggtaaaatactatctctagaatatttttcaaactgttaaatgcatccttttaacagaagctgttgatgtctacaaacactgtctttgtagacaaagacaaaccccccttgcatgggggtttgggggttgggaagcagttgagaaaatggcatagtcccgtgagaaaaccttggaatactttcttttaataacatttttttattgcatagaactgtaaagctacagaaatgctttcttggagttttccttcatcctttcagaagggctaatattgacctttggttagcatgttagtattttcacctgtgtcaagtgatgtcttcacgcttttggggggtgtgtgtgtgcatgcccacctcgtgttgtgtagggcacattggccgatacctataatgtgtttcaattactacattgttggcatttcagtaggctccttcagcctttgcccatctgggaagtggagactagggcaataaatgttttaggggtagattgagactgcagtgtttttcatcttttagcttgtactttaagacaatgggatgtacccctagaccatttacctagatttaaattacttccttgtgatgtggtttagagctctaagttccctgagttgtcttgaaaggctgaagggtgctcagagaatggaggggaattgaaaatggaacctaaggatctgggagtggtcatatgtgtgagtggtgaaatgtgccccccaacaccccgttgggtcgggtctggagttaaaagcagtggctgacatacattttgcaatataagggtaaagaaaggtaaagaaggaacaaacatttctagaggataaatgctttaattccagaagataggccacacagtttaggaactgtggtaagaggtgctttgccatatttatgttactgtttaatctgtgtaacaatcgtatgagatgacttagtcagtggctaggtaactttctgctggatgaggctgcactagtaaatggtggcacaggcaaagccttgtactttccctcataccagtatcagctcattagagttaactcataaaggggtttgttcttgagagagggaggcagagaatttaaaaccattaatgaagtattaatagctgtcaggacaatttcttaagaacatcaattcattaagagttattctctgaattttttaggagggatttcttgccctacttttgaaaaagttcagacagatgactccaaagaatgtttgatttctcttgtgaatattcacttttatatcagattctgatggtttcttgattctatatatttagaaagcattcggccgggcatggtggctcatgcctgtaatcccagcacgttgggaggctgaggcaggcagatcaactgaggtcaggagttcgagaccagcctgaccaacatggagaaaccccatctctactaaaaatacaaaattagccgggcatggtagcgcatgcctgtaatcccagctacttgggaggctgaggcaggagaatcgcttgaacctggaagacggaggttgcggtgagccgagatcccgccatcgcactccagcctgggcaacaagagcaaaactctgtctcaaaaaaaaaaaaaaacaaaacacattaacttgtgggtaatttgtccttctgctatccagtctttggaaggcagggcaaagcttgtgtgtggtagagatttcataggcttgcaggtttgtagagtgggaattcaagaagttgtaaagggcacttattaagataggaatgtctaaaataaatgatctttagcagtgccaccttaaactttgtaagtgttgctacaaaacctttagttctgcatgctcctgaccagccattgccttggacagagaaacaaataagggtgagttaataaactagagacttgtctcaattgttcaaagaggtaaacttaaggtgattaaaaagtgctgttttattctgtatgagatacactttgggaagtcgtcattttccaagacgatgatacgccaggcatacgaattggatcagaaaggatttagagacatgcatggatataatgatctcttacagatgttcctcaccttacagcggagttacatcctcagaaacccattgtcagttgaaaatattataagttgaaaacatattagatacagcttaacctacccaacatcatagccttgtctaccttaaacatactcagaacccttaagttagcctccagttgcacaaagtcatctagcacaaagcctattgtatgataaagtattgaatatctcatgtactgcatattactagcctgggaagagatcaaaattcaaaatatgtcaaaattatgatggcttcacaccattgtaaaattgaaaaatcgcaagtcaaaccaatcggggattgtctgtacataagagatgattgtccaaattagagctgttttgggtttctgccctttgcagatcctttgaggttttctttatagacagatgactccttctgggggaattgagcgtgactctgattgagatttggttcagttaccacatactgaaagcttcctgtgggccaggcactaggttgcactggggacctgggaggaaggcctagcccttaaagtttccagcctctaggtattgggagacgagggaaaatggggacaagatatttatggcctgtccttattgagagcttagaaaaagctgtgttaattctgctttgggtgttcgatctcacagggaagatggcatttgagatatgtgacttggcgagcttacactgtgcgcttgccatttttctaagcgttcatttatttaattcttaatgcaagcctaggaagtgggtacagttatgatcctgaagttattaacccaagttatgaacctgactgagggttggagctgggatttgaatcaagatctgtctgattgcaaaggctatggctttttttttttttgtcgtcatgctggctgtgtttcttcccttaaaagataagtgggagtgtgcccttggctttcttatttattatgttaggaagatgagaggaggagtgagactagagaaagaggcttgaaagagaaatgggatagaaaaataaaggaaaaggctgggcacagtggctcacacctgtaatcccagcactttgggagtctgaggtgggtggatcacctgaggtcaggagttcgagaccagcgtgaccaacatagtgaaaccccatctctactaaaaatacaaaagttagccgggcgtggtggtgcatgcctgtaatccaggtactggggaggctgaggcaggagaaccgcttcagctggggaggtggaggttgcagtgagccgagatcgtgccattgtactccagcctgggcaacaagagcaaaactccgtctcaaaaaaaaaaaagagagaaaaagaaagaaaaagtgccttattataattgtagtcttgtaattgtctcgttggcacctcttacataaagtgcagttgctctgggacattagaatgactgtgactgacttttaatctttgccagccatggtggctcacgcctgtaattccagctttgggaggctggggtgggtggatcgcttgagctcaggagtttgacaccagcctggtcaacatggtgaaacccctctttactaaaaatacaaaagttaaccaggcttggtggtgtatgcctgtaatcccagctaatccggaggctgaggggcaggaatcgcttgaacccaggagggcagaggttgcagctagctgagattgtgcctctgcactccagcctgggctgagagtgagaccgtctcaaaaaaaaaaaaaaaaaaatccttctatgaattctgtgtttccccctaagaacttctgtcctaacttgatcacttcttattgtgagctatttgtttattagtgttgaaaattctgtgctaatactatcaactgtaccttcccttccaccaccccactctctgctccaagtctttcatgtcctcaatacctgtcgtgcaaactatgcatttctgggttaactgggtactattttagtcttttagttccatcactcagcatttacaatatagtagaaaaatggaagaaatggaaaggtacgtactcgagaaatcagtgttatggccatctccattttagagatgagaggcctttgcagaaggcctttgcgaagactttacagaatgtgaatttgtacccgggtcttacagcctcccaagcctgtgtgctttgcattacaaagcgaatctgtggttcctagcattgctgtcacctagaggcacttgggctaacctccttagctttggtttcctcctctgcgatgtaaggaggcttgaactcagtacctctaggtggtccttccagctctaagcttgagaacttaagtttattttagctgaagaagagagatagaaagccccttgaggacaggaaccagcttgtatttcccacagcacctactggtactttgttcctatgggctcctgaatatttaattaatgaaacctcttgttactgtttgaaagctcactacttgtattaacctttcctgagtattcttggactctgatccagttttttctatatcacctcttattgtacgaattgtatgtcactttcacgttttgttttattctttatgtgcttcatttacttatttattgcttggctttcactgctagaatgtaagctcctataggtttttgttttagtatttctgagtagactacatagactacattctcttcttcttcttgttttcttttccgagtaccccaaagaaggatacaaccctggatttggtcatcttttcagtgtttgctatgatcatttgaaacagaagcatacacaagaataaaaagagaaatttgctgaaaaaccagaggtttgtccttgtggaggcttatttgaattctcaatctgttggttgaattgatttgttggcatgtaaatatatcctgatggactcctctgaaaatctaaatttgtgcttctgacctttgtaaagtcaggcagtgctttactaattggatgaaggagagccatggcttactcttgagagaatgtgcagatgcacacaatcaaaacttttcatgtaatttgcgggcaggaggatcccatcttagtgcatagttcacctctaacctcgctcagagaaaaggtggaagaagcatgagcagtcatctagagaaatccagagaccacttggtcggctcatttgtatctttttatttattattatttttaaaatgaatgcttttgttgcctttctcttccaaagcaagattgtttctttttctttctttacatacctagcactcactgagaatagtgcttggccattagtcattttcattaaacatttgagtattgtcccttccacctttaaagaagaaaaactgtgttgtcagtcctttttaccctgtctagctactcctttcactttccttcttatcatggtaagcttctggaaaacatagtttcctgtcttttttctttctgttcttcacttctagtcactgcccgggagctcaatcattgcttcatcactacatctcccattgcatgttcagtcttcactaccatttgacccctgttgtcatcctgctcattgacactcttctcttgacctctctcattgctctctctgcttttcttccgcccatgtggccagttttgcccactcatcatgcagtccggttggtaatgctcagggttacaggttcaccttctccccctcttctcctttccctgtttctctcagatttgctctctctgtgtcttcccttctcccctttgcggaactcttttaccagtacccttcgcttctaacgtcacttatgtatgaacccaggcctgacccaagcccatataaaaggctgcaatacgttaaatgcagcatgacccaagctgaactctataccaccttttcattttttcctccaaacctccccttcttactgtctcattggatggtacctacattcatgcatttgaccaactcagagagtctatgactcagttctgtcccttcttccccattccctctatggctgccccattttctcccgcaactgtaatagcctcttaactggtcttcttgtccgagtcttctctttctttccaccctgatgtggttttcaaagatggtttgcaaagatgcaaatctgagcatatctcttgcttgcttacaatcattaaatgtcttcctgttgccaaaaataaagtttaaattctttaacaaaacctggaaaattatcgatacttgttgcactccccccacattgccctgcccatctttccagcatcgtctttcctcatgcttgtgtttcagccttttagttctccttggccatggggctttggcatactatgtatcatgacttaccctgtatgtagtcataaagtaacagtttttagctgtttccaccactaaaaattagttgattccttttcctcttgtttgtttcactgcgtccccctgcttacctttgaggctcagcacaggcttcacttcttcaaggtaactgtcctgacattcttcactcacattgtatctgttcctctggctcccacacatgtcacagcatgttgtcattggcaacgtgatacgtgactccctttcgctgttagtcagcaagcccccccaccctttttttttttttttttttagattgtgtctcttctccccacatcccagtgcctagcacagcacagtgcatggtgcatggcagtttctcagggagttcatggtctctgggtctaaggcataggcgaggaagggttggtgtttaggagaaagctgagaaagatgccaggcgcaatggctcacacctgtaatccaaggattttgggactccgaggcaagcgaatcagttgaggccaggaatttgagatgagcctgggcaatatggcgaaaccccatctctactaaaaatacagaaattaacctggtgtggtggtgcatgcccataatcccagctactcgggaggctgaggcatgagaatcacttgaactcaggaggtggaagctgcagtgagtcaaaattatgccactgcactccactctgggtgacagagcaagactgtatctcaaaaacaaaaacaaagctgagaaaggagagaggggggaagaaagaagactttcagtggtgaagagtaatgaagcctgtcggcagggcccgttatgtacagccgatcgatgtagacacagtgcattttgctcagaaaatatttgaagattttccactaaatgctggttgcttttctctcttgtggaaacttatgtttttacttctcctcctcttctatttcagagagtcaggactacctcttaggtgtgtgttcttttaccccattcctttcccatcacttaacagtattttgcatcgttagcctattactgctgtctcacttttctcttgtacttgattccttccttgtgcctacaaacatgcttaagttgccccttcctaaaaagaaatcttgttttctagatcttccccgcttaagcaaatgcccagtcttctatcacagctaattttggggaagcggtgaatctcagtttctggtatctttactcttctttcatcagacctcaccccttcactcaaacccttcttagttcccccaggtttctctctgtgatacttgtctttgacttttctgatgaactgtccacctctttatcatctcttttactggatgttgaggtttctcaggttctggcttcagtcttctcaatttaacaattctctgtatgttgtctcattaataatgccttcatcttccacttctgcacagaaaacttccaaatctctatctccaagcaaatcttttgatctgtcagcctgctggacatccctgtctatctggttgtcatgagaacacctcaaactcagcatgttccacactgtatttaccgtttaccttctcatccccactgactgtggcttctggatcttgggaatggcccttgcaccaagttggcaagctggaaatcctaaacttgtctttcactccccattttccgtaacctttcacatctactcagtccatttaaatcagcagcatctcctatgcccttttgcttcttagtattctatcgtatcctaagtataggtcctttcccttccagactattgtagtagcaccgtgactcaactttctgtctctattttttctgcctgcttctctcaccctttggactatactttatacagtttccagagatatttttctaaaaattgaaatttgatatcatttcttggtttaaaaacattcattggctctctagatcttacggataggttcgtggcccaaattcttaggccagcagcaaaactcttcagagtcaggccacaccgcatctttccagcctcagcttctttcacccctctcgtaccccttcctcttcagccatttgatgcccccagaagccccttatagcgttatcacactgtactttcacccaagttccctacagctcaaagtgtactttgcgttatctgcttttcagactccagggcttgcctcagtgatcagttccctgtgctcctcaccctccccttttgataggatgctttatagattacctttcatacagtgttcgatgcagttagaggtagtatactgcccaggagttaagagtgtgaaccctagatttgccatctgaaagtcatgtgtccttcagtgatgcatttaacctctctgtgcctcaaatttctccctctggggtatgttaggagtatacaaattaacacatgtaaagtgcttagaatagattggtactgttaaatatgagctaacgtcacatttgatatttttttaaaaagaaaaaatcattatggagtctcagtcctagagattctgattcattaattctggatgggccccaagattgttctgtgtattctgggtgggagctgcagtgccctgtttctctctctagcttgagagcctagcacagcacctgaaccattctcttcatgggttacttattgagtacctgtagtgtgccaagcattgctgagaggccgagatgagaaaacttttaccttgtggagctcatcttctagtggagaaggtgtacattaaataaaaacagaaaatatatatgatgtggtgtcaggcagtaggtgataaatgggaaaaaaacaactaaaaacaatgcaagataaagggatttgggaatggattcaattttaagtagggtaattagggaaggtcatttaagtagggtgattagggaaggtcatttacctgaggaggtgatatttgaactgagacctatataaaatgagtgtatgaactgtggagacatttgggaagagcattacagacagatggaagggcaggtgcaaggtgatgatgagcttggtgtgttcaaggagcagcaaggtatgcctgtgctagagtggtggaggggcctgcggggagatgagctcaaagaagagggcaggagccttgccggtaggcaggccacaggagggactttggattttgttgtgagatgggaagccacagaggaatctgagcaggagtttatttttatttttatttttatttttggagacagagtcttgctctgtcgcccaggctggagtgtagtggcgcgatctcggttcactgcaacctctgtctcccgggttcaagcaattctcttgcctcagcctcctgagtagctgggattatgcccagctaatttttttatttttagtagacagggtttcaccatgttgcccaggctggtcttgaactcctaaactcctgagctcaggcctcccaaaatgctaggattacaggtgtgagccatcacgcctggccaggagccttttttttttttttttttttttttttgagacggagactggctctgttgcccaggctggagtgcagtggtgcgatctcactcggctcactgtaacctccccctcccagttcaagcaattctcctgcctcagcttcccaagtagctgggactacaggcatgtgccaccacgcctaagtaatttttgtatctttagtggagacagggtttctagattaaatgtagaggaatatagaggaatgtagattaaatgtagaggaagagagactgcttttggcctaagcagttgggtgagtggtggtttctttactgagatgagaagcattgagtttgagggaggagagtgggactcaagagtgccgtttggacatgagaaacttgagatgctcagtacacttgcaacgagagatgttaaataggtagttgagtctggagctcaggggagagggccaggctgcagatataaatttggcagtcagcttattgttgtgacatagaacagtaaggagtaatttcttctgattaaagagatttggtaaacctttccaaaagagaagacgtttgagcaaaactttgaagaatgagcataatttccaaaggcagagtaagggaaaaatagaaaatatttttcatccaagtctcacagcctttcccctggcctcttcttgagtttaagaagctgctgacctggttgataatctcttatcactggtatagccacttaggttctttattgaaaaggaaccagaacagattacacactaactgataaaccacgttctactgtttctcatcgttcacagattgaaaattccagttggatcatcaaggtgcagaatgctaaacttgttcttctcccctgttctgtatctggtgtgaattggatgtgttgattttcgtatggaggctttttcacatgctgtcatctccactaaagatggaacactttggagaagttttacttctgttgttaatgactttttgcacttgaactgttaaaacaactacaaccatgagaaattgggaccccatgctattttatcactcatacccctaacttgagcatattatctgtcttgactcatcctgctttgtgtaaaatgtgaatcatgttttgtcactcttctatttagatagaattttatttgcagtagaatattgcttatctttttgtttatttttgtgattactgtaatcagaaattttggtctttcaagtagagaataattactagatgttcgttagtcaatgggataaagaatgcattgaaaaaattcagtttattaaatcgtctaagatccttttagaactgatgtaaaattcatctgtgaataatcttctactgcacgataatattagtgctggatatagatagaatgtatgaagcctcagctcttatatactccttttagccatttttctattacgaaaaaaaatctagtgtattaaaggaaagtagtgacagtatttatctttagatggtttctagtatttgaagttcatacagaagcttttgtcagaattgtacacatgggtctttgtcttgagttaatgagaccactgcaactttaaacatgttttgagtgataaccttgatttttataaattatacaagcatgactatcaaggctggtttatcagttttcaacaactttacaagtctgaacaagtagaaaattatttcaaaagaaccttgtttggatctcacataaactacaggtagctttctgtatatgaaaaaatttttaagtacagaaaaatacagataatataaataccccagtatggagtaactaaatgttaataatttgttagaagactcgttttaaatctttctttaataaaacaagtaaaacttcactaataatttatggcatgtctgtactccatatctgctgattcatacgccctccttttttttttgttttttttttaactccccggaggaatttaatgtgaactatttccgtttttttctagatcacttaatgtagtgtcatggtgtatggatgacttaacatgtttttgagacctatcaactgttgaaatacagatctagttcattcttttaaagagttgtatagtattccttcatgagattttagaatttttattgtaagtaagagaattctttatatattttcaattctggccattcatctgttatataaactgcaaatatcttagttttccaggctgttccttactaactttgtattttttttcaggtagctttcctgagtttgatcttaggaattcttaaaatacagtagcatgtcttccagtttagttttcccacccatggaggtggtggcaggctgagttttgtttctttctgctctgaaagacctaggaaactagtgaattgagtaagcaccctgcaagtctggtatagtctatttcaatcaagttggcttctggtgtgcctttgatggcatcatcagtgagagttcttggtgttgatttctcttgctgcaataacaggtgtgatgtttctcagtagctggctggctcccgaggataccaggagaatactttattaatttaaaacactgcattctaagagttcttcaggaaagttatgtgtctatgggtagggttgtttttatgtggttatttcaaaataagagctatacaatcaggctttctgctggaatattggaatataatgtctgccatttaaacacattggttgcaaagctttaaagctttatttttgtttctaaagcattgatttaatgtgtgagctaacaattcgatcaagaaaatagatttttaagaaaacttctccagtgtccttattcttgagttcatggttatttaacagctcactctcttcgaatatctgttagtatggtatctttcattttttagggagggggcaactttaaaaaaaaacaccatagaataattatgatgaaagcattattgacacagtgagcatttttaataccttcaacctgtatataagcagcacaaatttagagtgatttcagatccgggttttgaagtaggtgtctgtttacaggaaatgcagcagaatcagagtacaatgacctctgaggaagtctcgtattcatgcagcatacatttttactatgtttgtggcactgttctagtttggaggatctggtgatgaataggacagacaccccccccccccaccccgccccccactccatgtggaaacaggaaaggaacaaacaaaatatgtcctatgcagaagatgaaaagggtgtaatgctggaacaggagcagcagtagtctcagtatttattcacccagagcctggatgtgcttacagagggtgcatagaggaagaatacagccattgtgtgaagtagatggaagcatggcatggctatttgttcattcagcaaatatattattgagcatctgttctatgcctgcaagtgctctaggtgctgatgatcagtaatgaacaagagggacaaaaaagtctgtgttgatggagtttccattctagaaggggaagatttacataaacaagaaaagaaataatgtggggattggtgcactgcagatgggtatagaacgcagaaagcaataggatactttttaatgtaaatagactgtcaaagggtaaaatttaaaaatattaataagatatccaacagattttgctttagaatgtccgtgtccctccattttagtgtatttttcccacatagagagtctactgtattgaaacctcaagcacacttttattgtcttaacaaaatccatcaaaagtcataggcttctggagacagattattaccttcccagaaggtaatctttttagagttgaagtgaaatatggtaatttgttttttggagaggctgtgaaaaggagagatactgtacctaatttgtgtttgcaagagtataaaataatatagctttttttatgcagagtggaaaaaactgttgtgaagctaataactttaaacttgtatctggaaagctgagacctgatagattatatatcaaattggtatacaacttatttggtaacatatataggttgagtttcaaagtattgtagctacatcagaagataaataacaaaggaaggatatgtatttgtgaaaccagaatttcatgaactctagaaaaggaagaggagcaatcactttgcacaacaaagaatctttattcatatacacacacacacacacacacacacacacacaatacagatagatattttcaaaatctcaataatatttaatattagaaatgttaagggggatactaccgaaagtgaattaatataaaagaccaaatgctttttccccttcctttttttaaaaaaaatatagtttagaacagttttaggttcacacaaaaactgagcagaaagtatgcacagagttctcttgtaactcctaccccacacatgcatcataaccccctccactgccaacatcctacactgagaggtacattggttaccattggtgaacctacattgacatgtcattgttagccagagtccgtagtctgcgttagtattcatttctagtgttgtacattctgtgagtttttacaaatgtataatgacatgtatccaccattataatatcagagtagtttcagttttactgtcctaaaactgctctatgctccttgtgttctttcctcccttaaattttatcaacaccgtatttatttatttatttatttattttgataacagagtcttgctccatcacacaggctggagtgcagtggagcgatcttcgctcactgtaaccttcgcctcctgggttcaaactgttctcctgcctcagccccccgagttgctgggattacaggtgtgtgcccccacacctagccaatttttgtagttttattagagatgtggtttcaccatactggccaggctggtctcgaactcctgatgtcaagtgatccgcccccccgccccactcagcctcccaaagtgctggattataggcgtgagccaccatgcctggccaacaccttatctttttattgtctctgtagttttgccttttccagaatgtcatagagtaaaatcatacagtatgctaccttttcatactgactgctttcactcaggaatatgcatttaaggctcctccgtgtcttttcatggctttatagctcatttctttttagcactgagcactatttcagtgtctggatataccacagtttattttatccactcacaaaatgcttctgcattttggcagttatgaataaagctgctataaacatccatgtgcaggtgtttgtgtggatataagttttcaacttacttgggtaaataccaaggagggtgattgctggattgtatggtaagaatatgtttagttttgtaagaaactgctaaatggtctttcaaagtgtctgtgcaccgtttttcattcccaccagcagtgaatgagagttcctgttgttccacatcctcaccaacacttggtattggtagtattttagaatttggccattctaaaactcaacaataagaaaatgaacaaatgtgtaatagtatctcattggacatcttttctatttttgtttttctgagatggagtcttactctgtcgcccaggctgaagtgcagtggcacagtcttggctcactgcaacctctgcctcccgggttcaagtgatcctcctgcctcagcctccccagtagctgggactacaggcatgggccaccacacctggctactttttgtattttcagtagagacagggtttcaccatgttggccaagctggtctcgaattcctgacctcagctgatccacccgccttggcctcctgattacaggcgtgagccaccgcacccggccagacatcttttcgtatgtttatttgctttctgtacgtttttggtgaggtggctgttcagatcttttgcccattttaaaattaggttgttcattttattttattttatttttattattttttgagacggagtctctttcgctctgtcacccagactggagtgcagtggcacgatctcagcacattggaagctccgcctccctggttcaggccattcccctgcctcagcctccagagtagctgggactacaggtgcccaccaccacgcccggctaatttttttgtatttttagtagagacggggtttcaccgtgttagccaggatggtctcgatctcctgacgttgtgatccacccgccacagcctcccaaagtgctgggattacaggcatgagccactgtgcccagccttcattttcatattattgagttttaagagttctttgtatagtttggttgacagtattttattcaggtatgtttttagcaaatattttctcctggcttgtggcttgtcttctgcagaacagatgtttttatttttaatgaagtctagctaatcagttatttttttcatggattttgttttggtgttgtaagtagtcatctccaaatccaaggccatctagattttattctgtcatcctgtaggagttttatagtttggggtctaaatatactttagcctttatttttctggtagaattgctaagttaaaagtaaaattatggctgggcgtggaggctcacacctctaatcccagcactttgggatgccaaggtgggtggatcatttgaggtcaggagtttgagaccaccctagccaatgtagtaaaaccctgtctctattaaaaatacaaaaattagccaggtgtggcatatgcctgtggtcctagctacttgggaggttggggcatgagaatcgcttgaacctgggaggtggaggttgcagtgagccaagatcgtgccactgcactccagcctgggtgacagagtgagactctgtctcaaaaaaaaaaaaaaggtaaaattatatatttactccttaaaaacttctatcttgccatttagtagataggatgttatgctatgcttgaggtaatacagataggtaaggcctagattgagttttcagttcactggaaattttcattattactttttataatttgatgggacatgaacttttaaattattcttttgtaaagatagtatttacatttcctgaagggaagcgttttaatttttcttccatggctcttgaatgaataattacagaaaagcatttaaatcatatgtagatcaggagactgtttaaagatttaatggaatacttttcccataaaatgctcttaggtttcctgacaagtttattcagccatttttttatgacattttcaacacctggaacctgacctcttcatgttgtgctggattgtgacggtctttgaccttcaaaccagaactttatacatcttaaggcccaatttttgtaattaagagtaaaaagcaactatttcttctttcacttttaatggtatgcaagtttttgctggtattgtatttgccttcttttttttttttttttaatttattttttattgataattcttgggtgtttctcacagagggggatttggcagggtcataggacaatagtggagggaaggtcagcagataaacaagtgaacaaaggtctctggttttcctaggcagaggaccctgcggccttccgcagtgtttgtgtccctgggtacttgagattagggactggtgatgactcttaacgagcatgctgccttcaagcatctgtttaacaaagcacatcttgcaccgcccttaatccatttaaccctgagtggacacagcacatgtttcagagagcacagggttgggggtaaggtcaccgatcaacaggatcccaaggcagaagttttcttagtacagaacaaaatgaaaagtctcccatgtctacttctttctacacagacatggcaaccatccgatttctcaatcttttccccacctttcccgcctttctattccacaaagccgccattgtcatcctggcccgttctcaatgagctgttgggcacacctcccagacggggtggtggccaggcagaggggctcctcacttcccagtaggggcggccgggcagaggcgcccgtcacctcccgggtggggccgctggccgggcggggggctgacctccccacctccctcccggacggggcagctggccgggcggggggctgaccccgccacctccctcccagatagggcggctggcctggcagaggggctcctcacttcccagtaggggcggccgggcagaggcgcccctcacctcccggatggggcggctggccgggtggggggctgacctccccacctccctcccggacggggcagctggccgggcggggggctgaccccgccacctccctcccagatagggcggctggcctggcagaggggctcctcacttcccagtaggggcggccaggcagaggcgcccctcacctcccggacggggcggctggccgggcgggaggctgacgccccgacctccctcccggacggggcggctggccgggcggggggctgaccccccacctccctccctgacggggcggctggccgggcggggggctgaccccccaacctccctcctggacggggcggctggcggggcgtggggctgacccccccacctccctcccggatggggctgctggcctggcggggggctgaccccccccacctccctcccggacggggcggccgccgggcggagacgccccccacctcccagacggggtggccgccgggcggagaggctccccacccctcagacggggcagccgccgggcggagggtctccccactcctcagacggggcggttgccgggcagagggtctcctcacctctcagacggggcggtggggcagagatgctcctcacctcccagacggggtcgtggccgggcagaggcgctcctcacatcccagacggggcggcggggcagaggcgctccccacatctcagacgatgggcggccgggcagagacgctcctcacttcctagatgtgatggcggccggaaagaggcgctcctcacctcctagatgggatggcggccggtcggagacgctcctcacctcccagactgggcagccaggcagaggggctccccacatcccagacgatgggtggccaggcagagacgctccccacttcccagacggggtggcggccgggcagaggctgcaatctcagcactctgggaggccaaggcaggcggctgggaggtggaggttgtagcgagccgagatcacgccactgcactccagcctgggcaccaccgagcactgagtgaacgagactccgcctgcaatcccggcacgtcgggaggccgaggccggcggatcacttgcggttaggggctggagaccggcctggccaacacagcgaaaccccgtctccaccaaaaccagtcaggcgtggcggcgcgagcctgcaatcgcaggcactctgtatttgccttgtaaaacagatcaattctagcccctcttactgtcttactcttacctcttattgccttaaacacaatttaaaatgacaaaaatccaagcacagtgggtcctgggggaaggtagaggaaataaattatactgtgtttagctttatctaaataccttttacagcatgtcaaggaattcattttcagttcattagtgctgtttcataagcatcttcagcaaactcacacaaatgttcacagatgagtatatgcataatctaggacataaagggcattgtttacattattaaaaagagtaacagtttcaaagagtattgccagtttctcccaaattcatgttttttcacttttttaacctcccatttcacattttagatgcttagttcctggttttgttacagacattatctgaaataaggaatagaagattaaaaatgatttgaagtgtatgctgtggttctagagacacatcatttttttttatctctaaaaaggaaaaattctaagtttagaaggagatttcatttgtaaaattgactgtactttataagcagtgtttaaattcattggtggtaaatatgcatgttggtatagtaaaatcccattttttacataatgctttaatggaaatggcagttttatgaaatgaaagtgactagtaaaagtctgaatgatgctcataagcttttacatcatttttattgaaggttttgtgtatgctaatccattaatacaggggaaaaggagaacactaacatggtttattttctataattactcaaatagaatataatttattttcaataaaattcttggagcaaattgcccagagtagggagaggaaggttggcctgttcttacaaatatcttgatttttacccacgggactttgttattttaccagtgatgttgtttcattgcatatattttcagtatagttccctccagatttttacaaataaaagcctgtgaaaggccaagaaatcccaagcatgtaaagacccaggattgtggagggagaaatctgggatgtttattttatcctgtttattattacaaatattgcttgtcttttaatagtttagacttccttttatgtggtttatataagttgaagcaccattaagattgctgtgtaatagcaattaactgtgatgtaatagattaacctggggaaattttcaaaaacagttaagtgtttacatttaaatttggcttatttttgtagagtaccttgaagaagaggtcagtgtaaggaataaacaaatacttaaatttgggatcctcacaccacaacttcataagggggagagggtgaactgaggtatcccgtaggtggttgaggtgtgtgtgcttgtgagttttctgtatttctttgcagttgggttcagcgaggagcagttttctgtgttcaccagtgttgatagcagacaaaatcacacagaaacaaatacgaaaattgttttatgtccagaatgtccctctaatatgcacatgagtaacgttggatcaaatttatgttttcaaaataagtctcatagcagaactagctgtcgtttgattttgggattgagtcccatttccttccttccttatcaccattttgatttcttaatttgtattaaggtaagcccatatcagattgattttttttttttccatgcccggagcacctcaagagtagagacaccagcctgaggatcttaattttgctggagataatccacacacaggtagttttcttcttggtgaatatgtagattgagatctttattctatgccagccacagtgctggggctacagagatggataaggtataatccttgtctcaggagcttagagtctcattgaaaagtttttcaaaacacacatttgaatgattttgttgagtcaacattacgtatttgtttgtgaacacataagcgcacaccctttccccaccttcacttcctgtttccttgcaaatgcaaagacaagagtaaaggacttgcctagaggaaacacagaaatactgatttacaggtgaaaaatatgtaaatttgaaaaggtgttgaaaaagacctaagtttttgtagccacctgactaataaacacagagatcacatgtccaccatagatgggtaaatgaaaaaaagcaagtttcaggttaataggaatagtattatttcattatttgttagcccctatcccttgcacatgtgtgtatgtattgtttgtgtaaacatagatgatgtggaaagatctcccatattgttaatattagttatctcaggggacaaaggaaagcttattcctgtttatacatcttttattgtttggtttaagaagcatgttttacttttttaattaaaaaatctaataaagtaggaagtgaataaataatagtaataaaaagtatcttcaggccactgagcctgttgcagtcttcccagtagcgtgagtaattagtaccgtctgtaatgcttcaggtgtggactgcccagcaggactctgaacttcttgctacagcctaaggtgatactaagttttctgtagcaacactataatgttgagagttactgtgtttatagaccattaacacctcaaagtctttcttccatctgctcctcttggcacactgctctagataatcattttggaatgagtttagtcctttacgctctccctgttagatttcatattgttactgtggaaatcagtatttagcatgggtaagaactggccttagatgcaagccatctggttacagatcctcactaccactatcatgaaaacttggacaagtaacttgtctccccaagcctcagttttctcatctgcaaaacagcaataatcataaagttgtgaggtttcaatgagatgccatatgttagaacacttacactaggtacctggtgaaatagtgggaacatggtaaatattagacgttactgctagtgcattaacctcagctcatctctttcatccattggcatgttaatgagataatcgtggatctcaaatcttcccttaactatatttacagctctcttttccacaaaccttctaaactttcctcatgagacccccaatcagtctctgtctcattctacaggtcccttcaccgatgttgtcaccaccaacctaaagcttggcaacccgacagaccgaaatgtgtgttttaaggtgaagactacagcaccacgtaggtactgtgtgaggcccaacagcggaatcatcgatgcaggggcctcaattaatgtatctggtaagtcctgagactggaggcctagagggtgggctcagaaggcccctggacagtaggttttcttaaagtttgtatttgcagtgtagcagaagaagatgatagaattctctccaccccacccccaccccaccccaccccaccccacaaccctccaccccgtgatcagaaagctgggtcccagtcgcctgtttttttcataattaatgcctccttgtttcaaagcttacagcccctttgcacctcaatagttagagcaaaactgaagtgataactttagactttacttcagaatgagttttgttttcactcccttgaaattaaatctgccctttggcaataaataaaaaagggctaaacaaacttaattttactttgtgggagaaagctaaatggagttattttcttatttaagctaaatgatttctgacattaagctcataccatttccagtgattggccactgcactttactgattgtgaaacgccaagagagatgagggctgagcaaattggaatatactcaagggtgtcagtttggtgcatgtctgatggttttctcttctgtctgggagtgcatgtattttccaaaatccaccttttgaaaaatactggtaaagtgcccaaattgagaattggatttcagaattaaggagatgtcagtgatgggttggagtttaaatgtattttagaaatggaataaacttttagctcattagaacttctccatccaagaaggagctgtgggggagtgtgtatttatcttgtaaatatcaagtgactcagtgtcacagaggcttctgcatcaatagaagctactgctcatttgaaatgagtatctctctggctttttccatgatagattttgattgtgatacacttggctattcatttgacacctaaaagaaaatgattcacctctttggaaagatataaggtgtttcattatctgatcgtttctgcaaactcttattccctgcatctcgtctctctcattatggtgcacccatgccagctctccccctgtgcttctcttgagtctgcaagacctgatcttcgaatcaagttattatcttgaagtcaggagggtcgaagccagcattgattgaggggcttctatgtgctggacctgcacatgtactatctcatgtcatttctcttacctgccctgtaagggatgcattgtcacctccattttactaagaagtagactggtggtcatagcatcgtgaaactagcaaataacagagccaagatgtggatcattctgactggctctgaagcccatgctctttgaactgcagcactctggagaaaggaaggaactgggattttggcatttctgtatcctctggatatgtatggtttaaatttttctgttgacatcaagggcagctgaaatcttttgttcccctcttctatctactttccccccctcgatttccatgcctgtatcaaatttgagcaagtttgtcagtagatgaaaattaccaatttttataggaagaatagggaatgcagcatggttttctgaataaaagaatctcagtaggtggttgtacaatgttagtgtgttttctgatataaaatataaatatgtatgggtgggtgtatgtgtatgtctctatctctctcttttttttttgagacagtctcactttgtcgcccaggctggagtgcagtggcgcgatctctgctcactgcaacctccacctcccagattcaagcaattctcttgcctcagcctcccgagtagctaggattacaggtgcgtgccaccacacctggtaatttttgtatttttagtagagacagggtttcaccatgttggctaggctggtctcaaactcctgacctcaagtgatccgcctgcctcggcctcccaaagtgctgggattacaggcgtgagccaccgcgccaggcatctccgtctctctttcaggaagatccattgtttccccatcataggaatttttaaaaagtaaaagcgaactctgcctttgttctgatttatgattgcttactcaaggaagaccaagactttgtggttgtggccttcctttggcagataaagtaaggcacagagtgtggcacagtcatcaagggtcacttggatggtcatggcagcactgctatttgaagctagtggcttggctcctgatccagtgctctttctgtcatactaaactgcctcagtagtgttagaggatgaccccacttatgaatgaatgtaaaaagtaccatcattctcaaagtttaatgtatttgggggaaaaagtagttgaataataaaatgtccatgtgtctgtagactttcttcctagatgagacaagatcatatctgcaccttagaaagagctcctttgttattatttggtatttagctcagtgcttggggggaaccaaggtgaaaccagatgtcattgcatttctaggacagccttgcaagtcagcaaaggaggccagccccatttgctgcagttgtatgtgctgagggaccactgcatcatttattagacatgcatagcttgggataaaaagcactgcctttttccaggagtcctcttggtattaatacagctacatgatgacatcttggtgagtcactagagtcctcaggaggaggaggataccagtcgacaggcagtgcagattatccaaaagccagcctccccttctccccagatatgcacatggccaagcttggttttacccactctcttcaaagattagtggatttgaggtcgggaaacctgaacaggaagaccagttgtgctgtttaaccagtcagctgaattttgaccaacctattaacctttctaggttcttgttttctcacttgtaaggtagggagaatagtgtctaccttacagaatatatacaaatactgcagaatcaacagcatggtacaagagtggtacatttgtacgttcgttgttcttccactagctttgacaaaaaccggctagtttttgaagaaggtggattgcataatacttgaattgactgtttagaaataaattacccctatattttatttatttatggacctttgctaattttgagaagaaatttgtgttttctcttccttgtgtaatattcatttgttttatagtgaaaagttgccagtacattttcaggtataatctttaaaaaggtggccaccacatcagcttaaaatactgctagcattgccctgcccaccacccaaagtgtcactacatacctgagaaggacatgaccagtgcatttttcccatttctgaaaacccttggaatgcactagctattcgggaaggctgtaaatcattattttaaagagaggagggagggagggggaaggaaagaaagagaggagggaagcaggaaggtgggaagagagggagggttgatggtaatgatgtctgcccatggagctggcacctgtgctggccagagggatcaaggttttgaaggcacacaggttcagattgtgacatggaaagccagatgtctttcagagaaaccctgtgaagctctttttaccttttcacattaccctgatattcaagggaccttacattgtgcttcaaaagttcaggctctgacctatcatgctattttcttcagaacacggcagatcacttattgggtccttaaaaaaactcccttttataaacttaggtggtaaagtaacagttggacacaggcataacctaaactttttgtgtcagtggattataatatgtgggctttcccaaagagttgctttaggccctggccccttggacctgtgatttgaatccttttctttgtcctttacatgggtgctcgtctcatctcatttttattgtagccccttctgaggtttgtgctttttggatgaggtcacatggtagatagggggtgcagggggctttctgtttgcattcactggcccagaatactgtggttttggcccgttgctccatgatacatactatcaactagagatggttttgaattatttaatctggacctcagcaaaataggtacacttaaatagagattgaagaaagggaggttggaattttttcctcctgagatttcaaatgtaaggaataaagaactttttgaattaacgaattgttttgaggcagtggggatcttcccatttgttctagctttacaaaattaaatctattttctgaactgtacggtgggaaaatatttttaaggtacataatttctgaaaatgtctttgtggtaagctgttagtggttgtggatttttttttttttttagtgcttcagttaataatgagggagttttccattaatattccaaaccatgtttgccagcggatacagcaggtgaagtggtaaaattatgggcccatcaaaaatacttatgcttcctgtaatatgatattaagtttaatatttttataaccttcactgaattctaatttcactaaagtagcaagcatgcgtccatttgcagttcagttatgcacattggttgcctgtgtcccaagcaaattagaaatgcaaaatatctgtgtgtggaggggggcattggaaagagtcattaaagataccgatatttagttacagatacactttactaagtgtaccttgggaattgaaaatggattaaagacaaacacaaaactcccagtgtctgaatctgtattttaaattagaattcaaaggattaaggagcagtattcattcctgacatacagcccttttcagcactcttttcaatcacatttaaagcataaagtttttccagtaaaatcctcaggacagccaggtgcagtggcttatgcctgtaatcccagcactttgggaggccgaggcaggcggatcacctgaggttgggaattcgagaccatcctgaccaacatggagaaaccccgtctctactaaacatacaaaattagccgggcatgctggcacatgcctgtaatcccagctactcatgaaggctgaggcaggagaatcacttgagcctgggaggcggaggttgcagtgagccaagatcgcgccattgcactccagcctgggcaacaagagagaaactccatctcacaaaaaaaaaaaaaaaaaaaaaaaaaaaaaaaaaaagaaaagaaaaatcctcagagcatgaacatcagcagctcttcttggatgaaaacattgatcagttaatttaaatggatagtattgtgattaataatccttttaagatttccctgactcagtttaatgtagctgtttggtggccctggagcagtcaaccaggagtgcacctttcaggtgcactagggtataaacgcacagagcccttagacaaagaagccaaacatttatccatcaagcactgatagtgggagctgcatttggggagtttgagcttcttaacagcaacattcttctttgtttgattgtttgctttggaagtctctgataagcgaaacttttttataagtggtttccatgaaccaggcttattactctcagataagaacaactcacattcatactttaaaagatgtctttaatctttttcagcagatgagagattctgcttaaacaaaaagtagaaaaaagaaaattaccaacaaaaattcagcttaattacgcttttaagggtttttacaagtttactgtaatacttaggtttttaaggaagaattgttactttttttgtgactatgacacagtttattctttacatttttaaatatcaagatcaagaggacttacacattttgtctacctcagttagctgaaggtaacttcaactctgtacagcataactgagaagcaaaaaataagcaaagttttaagaagccaaaagtgattttcttttcactcattatgggtccttgcatacttacacacttgagggctctccagtcttgaatcttgtcttgtttattcttaccttagacttactgttaaccctgtcctggttgccagctcatcacagatgagaataaagggaaaggggtacagaggtggccacgttgaaagcggcccatgtgacagtgcatagcagacagtggacgggctgggcaagaacaccaccgagagcaagtgcagggagcattcagaaataacagtggggagctggaattccttaagcctcggggaattgttctccatgttttaggtgatcagccccaagagacacagcttgcaggtttcattaagatggtatataatgggggttcatgtcacaacataagagtaatcagaaaaggggtatgttgtattccattataaatgttagaggagattgaaaagtatgttggatttttgaaaaagatttacattttaaaagatatttataaaaaagagtgaataagccttgttatttggccagtgcctgtatatagcagtcctcatcttccattgatactggagaaaggagacctcactgtcagcacatttgtactagtctcagcacaaacaaattaatcagactgtgaggagtttgttttctaagacagaatacacgaactggaaaatcctgtagagaacacaaagacacttcagtgttaactgatttataaataaatgcaattcattatttatttgctagactcagagttccatccatgggcccctgaataggcagaggtccaccaaggtggtcatgatctcaacgtgttctggaccctaaaggatataataaatttgctcacagtctaactaaaatgtccagcttctttgctttaggctagaattatatcaccttgtttaggtaatgctggttatctccagcttatcaggagctctgcttggcatttatgtatctgtgtctttgattagtctcaaaaaagtggatcagtgacttcattccgaccctgtaagcaccatatggtagaggacagtctttctctatgcaggctttgtgagaggacggggagtgcgagactgagggcactgccatgagaaactggaagccctgtcttgccctcttggaagggagggagtgactctgggaagtgggacagaagaaaagccagctggtgggggtaaagaagggtttcctctttgggcttctccaaggatatttctagggagagcatgattcaggaacgctttgaatgttggaagagaagaaggtgcaaacctgttagctaacgcaaaaaatgcaaattagcacccagaatgtgagctattaaaacattaagttctggtctcagtctcattggggagaaaaagcaaacatgtcagaaggagcttaggagtcttggagttgacagtctcccaataaagtaaggtgcccacagtaggaactgtggtatgaaatggtgtttcagcaggaactgcagtgttaggaggtatagtacagcacagattttccaggtgtgtaccctgggccagcagcagcagcagcccacttggggacctgttagaaattggagtgctcattctcactgcagccctgctaacacaaaaattccggaggtggggtccagcagtctgtgttgtagcaaacattcgtggtgactctgatactcactgaagtttgagaacttttccctccagaattcttatttaaattttattatatttatatatttatttatttttgacaaagtctctctctgtcacccaggctggagtgcagtggtgccattttagctcactgcaacctccacctcctgggttcaaatgattcttgtgcctcagcttccccagtagctgggattacaggtgtgtgccaccatgcccagctaaattttttgtatttttagttagggatgggatttcacaatgttggccaggctggcctcaaactcctggcctcaagtgatctgcctacctcggcctcccaaagtgctgggattacaggtgtgagccactgcacctggccttgtttgtttagttatttatggagttggggtcttgctgtgctgtctagcctggagtgcatgccgctctcatagctcactgtagcctcaaatttctgggctcaagcagtcttcttgcctcagcctcccaagtagctgggactacagacatgcaccaccatgcctggctattccttacagagttctgttagtggattcagtcctggaagatggggtatattgacatgtgagtagggtaagggagaatcaagagaaacgtgtcaggcagggccgacatgataagggagactttgatgatgataggagagcatcactgggtgtaaggacataggggcatgatgtgtggcctgagtgatgcgcacacctgttggagcagaagggaggcctgccaataagagaccaagaaatccaagaagggccagattgtgaaaagctgaactgattgccttttacttaggaaatagttactcttataggaggtttttgatctgaggaattaccatgatacaagtagggtattaaggtacgattaaatttgtggagtttgtaggggctaggcagggtgatttggatgggaaagaaactagaagaaacttggaaaaatctagaaggatctgtgggcctcagctgagattgtgggcacgtaaaatgtggagagagagatttcgaagataagattgtgagattaaaaaaaagtgaagcatgtgctgtagtacttgttagactttatttgctctgttaccgttataatgcagacgaaagtgatctgtgatctgttaccattatgatgcaggcgaaagtgatctgtgatcttttaccattatgatgcaggcgaaagtgacctgtgatctgttaccattatgatgcagacgaaagtgatccgtgatctgttaccgttatgatgcaggcgaaagtgatctgtgatctgttaccattatgatgcaggtccatgatctgttaccattatgatgcagacgaaagtgatctgtgatctgttaccattatgatgcaggcgaaagtgatccgtgatctgttacaattatgatgcaggcgaaagtgatccgtgatctgttaccattatgatgcaggcgaaagtgatctgtgatctgtgatctgttaccattatgatgcaggcgaaagtgatccgtgatctgttaccattatgatgcaggtgaaggtggtccgtgatctgttaccattatgatgcaggtccatgatctgttaccattatgatgcagacgaaagtgattcgtgatctgttaccattatgatgcaggtgaaagtgatccgtgatctgttaccattatgatgcaggcaaaagtgatttgtgatctcgtagcattatgatgcaggcaaaagtgatctgtgatctgttaccattatgatgcaggcaaaagtgatctgtgatctgttaccattatgatgcaggtgaaagtgatctgtgatctgttaccattatgatgcaggcagaagtgatctgtgatctgttaccattatgctgcagatgaaagtgatctgttaccattatgatgcaggcagaagtgatctgtgatctgttaccattatgatgcagatgaaagtgatctgtgatctgttaccattatgatgcaggcgaaagtgatctgtgatctgttaccattatgatgctggtgaaagtgatctgtgatctgttaccattatgatgcaggcgaaagtgatctgtgatctgttaccattatgatgcaggggaaagtgatctgtgatctgttaccattatgatgcaggcgaaagtgatctgtgatctgttaccattatgatgcaggcgaaagtgatctgtgatctgttaccattatgatgcaggcgaaagtgatctgtgatttgcttgggttctcagaagcagcatttaactgcatttaatcaagtcatcattactccaaggggtgtgtgtgtatgttttaagtagcgtatcttctgtgtttcttctctgttcaggcaactctgatcttaatgatccaatgttttatgaccccaaaggccctttcttaacaggatcccagtttgcaatctgtaatacaacaggcattgtatcacaaagcattaatgtagatgagtagtgacctggcttccaggctgtcttctggtaacaggcttctgtttagtgtagtatcagcagatacattttaaaagtaggatagatggttcatttaagagggctttatcatcagtattcacttgaataccagagatactggtgaataccatttggtgtagcgtaacagtgcttaaactttttggtctcaggacccctttaaattcttaaaaatgaagatgcagctgggcacagtggcaggcacctatagtcctagctactcaggaggctaaggcgggaggatcacttgagcccaggagttggaggccagtctggacaacatagcaagaccccatctcttgaaaaaaagtgaaagtgaaataaatttaagttaatggcaaactcttttatagtctgccatggtaaaaagtacataatttctgtcacaatttgcacatatggagctgaaagaactaatgattagcaacattctgtcatgtttttataaagttcccactaacaggatagagcaaattgaatttgacatgagatgatagtagctgagaaatacaaactctttgatgtgagttaggggccatgttatgcaggatgtggatactgagatactccagaagtttatgaagtttcacagaatctgggtgtcccaagtcctcactgtggctggctgatgtaggagcccacaagccaaggagagctggtgatgaaaaacacccccatttgctgttccaggctggtagaaatctagaagtgagtctttggggcctgagctgagattgtaggcgtgtaaatgcgaagagatttcaaagatgagattctgagatttaaaaaatgaagcatatgccatggtgcttgttagacttttttttttttttccaaagcagaaaacttttctcagatcaaaaacctcccataactacccaccttatacccagaacttcctgaaagttgacatgccggtagggcacagtttttattcccaattgaaaagtttccattcaccaatgcatgtaggcatctgtgtatatatctcctcagtcctccgcttttgcagaagggctgttggacctgctacctcaggctgtcgccggtgctctgttaaagtgattgcttacacccactgccttgtgtgcttgcatgcctgtttatgtcttctcctctgcccatgaaatggtccttccatgtctacactgtggtgacttggtaggtaggatgttctaggcctggagctgtgctggtgacatctgtaaggtctgcagtaagggggcagtatatctcagacagtgcccttttgtggaggtagagcaagcagttgcaaaggcctttgattagaggagcatagggaacgcccattccttccgtaagggatgtgtgtgcatgcatatgtgcctctattttcacctgagggccaggtacgtcccgaaaactcaagacctggtttgtgtaaatctcctttctctttttaaactgcagattctcccaagaggggtactacacagagccaccagtgtgttattacttggccgcattgacttatttaactatatttttacctcctggagggcctgtgagaccatttggtgtagcataacagtgctcaaactttttggtctcaggacccctttacattcttaaaaatgaagacgcagctgggcacagtgacaggcacctatagtcctagctactcaggaggcaaggcaggaggatcacttgagcccaggagttgtaggccagcctggacaacatagcaagacctcatctcttaaaaaaaaaaaaagtaagacccaaaaagcttttggtttgtggggtatatcaatatttattatattaaaaattaaactgaaaattcatataattatttaagaataacataattacatgttaacagagtaacatttttaatgaaaagtaacttttcaaaaaaattaggagactgatacttgacattttttcattttttgccaatttttctttttttttttgaggtggagtctctgtcgctcaggctgtaatgcagtggcacaatcttgccactgcactccagcatgagggacagagtgagactccatcctcccaggttcaagtgattctcatgcctcagcctcccgaatagctgggattacaggtgcccaccaccgtgcctggctaatttttgtattttcagtagagacaggttttgcctcttggccaggctggtcacagactcctggcctcaggtgatccacccaccttggcctcccaaagttctgggattacagccatgagctgctgtgcctggcctgcaaatttcatttttctttttttttttgttttgagacagagtctcactcttgtcgcccaggctggagtgcagtggcgccgtcttggctcactgcaatctccacctcgcaggtttaagcgattctcctgcctcagcctcctgagtagctgggattacaggcatgcaccaccacacccagataatttttgtatttttagtaaagaaagggtttcaccatgttggcgaggctggtctggaactcttgacctcaggtgatccacccgcctcggcctcccaaagtgctgggattacaggcgtgagccactgcgccctgctgcacatttctttagtgtctgtttcaatagaagacaggctggatgctcatatctgcttctgcatttagtctgttaggatgtgttcttttggtgaatgcatatgaagaaaaactgctgtcaccacagatatgtagttggaaaaggggagagtatgtttaattgctttttcagataaatctgaacattcttcgatactacaccaaaacttgacaagtgttactttcttcaaggttattagtatgatgtggaatctgaagccatgtctgtgactttttgaacattgtttcactaaaacacatcagtctctgttgtactttgaatggattttgtgatatcatgcatggattgtttggaaaccatttgctgagtgttgcagagcttccaaatgttggcatattgcattgtacactcacaaaaaaatcacattcatttcttttcctgatgatctcattggaaaagtctgtaagtatttgcagaaccatgaagctctggttggcagatgaaagtattccacaattataatttttacctaaaagcctgtattttatcattgacagtaactactgtaaattgtttttctctagagtcaaagccaggtttgagccctggcactcttgtttaatacgctggccatgggacccaggtgagcccacttagcgcctttctgagcccttatcttgtttgtttttttttttgttttttctttttttttaagagactgggtcttgctctgtcacccaggctggagttcagtggtgctatcatagctctctgcagcctccatctcccaggcctaagcagtccttccacctcaatctcagcctctcaagtagctgggactataggctaccatgcccagctaatttttttgtggtagagatggggtcttgctttgtcgcccaggttggtcttgaactcaagtgatcctcccgccttggcctcccaaagtgctggtgttacagttgtgagccaccatgcctggcagcccttatctttttatcttgaaaaaggagacgtgctgcttggatggattgttgtgagtagtaaatgggagcactaaggagaatttgccttctatggtacctattacacaggaggcatgagtaaagattcttttcctttctttccttcttgggccatcatgaaagtattggggatgaagaagctgagggatgatggagaaatggaaaggaaggacctgttttcccttggggcattcttagaacccaggcagagctctggacacagtgctcttggctgtacttttttactcccactgcctctaggaaggtgatgaatgggaaggggcaggcagagcttcctggggctgttttttgggggtgtgttctgttctctggacccattggtttttgtatttcatctaaatagcttctctaaaaattagcattttccttggattgctgtcatgtgagcatcagggatctttacaaataaaccttgttcctcctcagagctctccagagtggtagacttgggagtggtgcaatagctgttcacagctgggagaacagagtctcaagggtaagacggtgtttactactagatctgtgccctgccaaaaatctaagagtagttcaggtcaaagttctcttctttcctaaactgaaaaataccagagcatgattttgtcacagccaaggaagacctgaaattcttaaaactgaattcactttaattttagaaagggaacattaatctaacagtgaatcccagctccaaagaaggttgacagtccctgtccaggaaggttcacagagcatgtaaagacattggctctttactttaaaatgtgtgttttcgttattgcaatcttaggggcaggaaaaaaacacattgggaatttggctttcagaaaaagcattgacctgccagtctggtcatttgtccctgaggttaagtgtcaagcccaggtcggtaaatgttccaggtctgtctgtaggaaaggtcagctcttgccagctcagtgatgccagagaaagagttatgttgataaaaggtttactctctgacagttattgaattttgtcctgaagaagtctcccagcaaggcttccttgtagctcagggccttcaggtgggtcttgtgggcagtgaagctgtctgggtgactagggacaccagtgcatttaagtccaatgcatggttaggtctcagtggactttctctgttcccatggtgaagagtgctactgcatccctaagatggatgggggaggttggtatttctatcctgttttgtgaatggttccattagctttgtcgtggggcctgggtgccagatataaatctagctcatattggagtgactagtgtggtgaaaggggtgctagactgcacttgtagtcaagtcttggctctttgtcccagtgttgccacttcttaacattgtgactttgagggagccacttcactttgtggaatcccagattcttcatttgtagaccacggctatcctgctttctatctgctgctggctgtggttgattgtgtggctctagaggaagcacctgggaagtcctaagttggggtttcaaggcaagagaatgctgatgagggcccagcagaaaggtggtagaagccctgctggtgagaagcataagacttgtactgtcagaggacaaggcaccagtcctttgtggtggctgtgaacttaggtccccacaccaactgcctgggtttgagtctgcactccaccaaggtgtaaccttgggcaaattcacctctctgtgttcattcttttcatgtgaaaagtagacaccagaatagcccctctcccccaacaatagtacctactttttaaggattaaatgagatgatggtaaacctaagggacagagcccagtttctggcacatggagatactcagtccatgcccactgttgtggtcaaggccacagtaggctttccctgcatgtgaagttgtctcagggaacttaactagatgtgtgggttagccaaagccttgtagcaaagtaacatattttaaagcagccatcatttgataggagtaggcccagctgtactctaggaagtaggctgaagggagccacttggggtaggaaggcacctccctccatgcagtgggtgtgactcatccacaggatcctctgtgtgagatttctctaggttcttagggaaaaaaaagggggagtataagctgataccgttttccctgctgtgtgagtgtcctgattgtaaaaattttctagctttatgttggcaaaattgtatttcaaggattaccttgattagctatatgagaaatgggttggagagaagctacaacagttccttaaatgttcttaaacatcttagattattctatttaattcctgaagagatcatttggatatgttttcttgagcaaaacaggcagatggtgttgctacccagtttcccaattctgtaaggcctgtagcagacatttacggtaggcttgcagtagtgaaagatccatggactaggaatcagaagactgggtcctcggccttattcccagctctgtcatgcgtgattttgtggctcttaggttggtgacctgcaaaatggagatgttggtcatccttgcttacttcaccaggggcgtccatcctaagacataagagaatgccggtaaattgctttacaaccaaagtacaagtattagcataataaatggcactgacaaccaagctctgaccctcctaatgaaatattttctttctcagtgatgttacagcctttcgattatgatcccaatgagaaaagtaaacacaagtttatggttcagtctatgtttgctccaactgacacttcagatatggaagcagtagtaagtactgaatgcttcttatttttttcagtaacaataatttaaaaaaccaattagatatggaattgtgggtgcatgcatttcaaaatatgtcaaaattatttaaaagggaatagttttttttcaaggaggtttgtactttatctacctttatggtttttctaaaactttgaggaataattttaacattttttgtgactttctagaaggctgttcttttctgactttcctgagctcagtgtgcttcagcagctccttgcactggtggatggtgtcttgcatggttagggattgccttctttcgcctctcctttctgccccgacagaaaaggatacttttcattgtcccgcctttttcttacttgtcttctcatcccccacaaactcaagagccatgtgagagtgtcagtgctgaatgtcctcacccatttagacatacatgtttgtggctttgttctagtaaatatgcttatttattttcccccctgcttaaatctatgtttaacttttctctaattttgataaaattaagatgacttcatttttataaaagaaataagtgatgttagtgatggttttggaaaaaaaaaaaagagtataatggacattccctccaaaacgagctttttatacatttgaataagtccattggcattctggggctgggagttgaattgaaatctacaatacaacccacagccccagcagggacagatgcgcttgtccttacagttcaggaaagcaggacagggttgcctcataccacttgcattgctctccagttttggcccgcccaaaggggagccccgagtcatccacggcaggtctgcccacctgagtccgctgttcatcacaccatactgcagttctcctctgtctgagtttcataccaagggcaactcaggccaagaccaccccatgccctatgtcaccacatagccttttgtttaagttctggagaagcatctccgctgatgtttcacttgtaggcagaaaatgaaggaggaggccagatatttttgacttttagagagatcagtgataataggctgtcttcttttcataagaacaattcttatgaaaactttctctgattttctgcaacatgatgtgttacttcatgttaatttgtgtgatcaaagaaacatggcagatagaaaataatggaagatccaagggtgtgttctgtttggcttctgctgcatggcatagtgaaaagagcatgggcttgggtgttttcgagctgagttcttccttttactgacgttgtggctgggagcaggttttattaactctgttgaggttttgatcatttgtaaaatagggataaaaatgcagctcacacagtggtgagtatgaagtgtgcctgtgtaagtgcctggtgggtccagtgtctgacacttgcttatcagagtgtgtaataggccagtcactgcatatctagtaaagggtcattttagttccttgtatgatgatataagtttaaattttttttatataaaatgtacattgtgggaaattttggaaatacacaaatgaaaaaaatttaaagtgacccatagttcttttctactaggcctaaccatcattaatgagaaatgagagctttgtgtttttcttcctttttttttttttttttttttttggagacatgattttactgtgtcacctaggctggaatgcagtggagtgatctcagctcgctgcagcctccacctcctgggctcaagtgatcctcccacctcagcctcccaagtagctgggaccacaggagcgcaccaccatgcctggctaatttttttgtagagacaggttttctccatgttgcccaagctggtctcaaactcctggactcaagcgatctgcccacctcagcctcccaaagtggtaggattacaggcatgagccactgccccagcctgctttttctttattttaaaatgtttttctttttattgtgatatacagaaagttgaaaaaatagcatggtgaccactcatataacttttacctagatttacatttgttaacatgttgtgacatttgcttcctttctgtcacaaactttcttatttgcttgagatgcaaatttatgacacttcacccctaaatgcttcagagcaaggacagtctcttatatagtcatgatactattaatcatagctgaaaaaagtaacttcaattcagtattattatgtgataaattcatattcattatttcctagttgttccaaaagtgacctttagtagaggacacccaaacctttttgtttttcaaactttgaactttttttttttttttttttttttttgagacaaagtcttgctttgtcaccaaggctgaagtgcagtggtgcagtcatggcttgacctccacctcagctgttcgagtaactaaaactacaggcatgccaccatgccggctatttttttatttttttatagagttggggtctcactatgttgcccaggctggtcttgaacttctgggctcaagtgatcctcctgcctctgcctctcgaagtgctgggattacaggtgtgagccactgcaccctgcccaaactttgaacttctttttttttttaagagtccaggccagttgacttacagaatgtcctgtattctggatttatttgattatttcctcatgattaaattcaagttaaatgtgttttggcaagaatattccatagttggtatttcataccaggttgttccgctgttggtgatgctgtttgatcacttggttaagatggtgactgccagctctctccactgtcatagcacaaagcacatttgcccctgtggttaataggtaatctgtgatactctgagtcatctgatactttgagaccatgtgaatatcctgctcgccagcagtctttcacctggtgcttttagcattcagtgatgatccttgcttgatattttttttgacttatgtggtaggcacacgtgtacaggtgtgtgtgtgcagaggagcagacttcagtattctttgcgattttttcacttaacattctggacattttctccatctaactgagtgctcttcagcatcatttgagtggcagcatgctgttccgtttagtggatctgccataatttttgtggcagtcccctagggtcagatgtatagattgcttcccacttttggttcttggtacctgtgttacagtagctgcctcttgcatggttttgggaagggttgagggcatggagggtgggggtgccttctttttctatatcataaccttgctgctatcctggtctgtaatcctagaataccctggaattcccatcttctgctgccaaaaggagaagtaatcaggagcgtatcctcttaggacatgggatttagctaggaaggtgctctcactacagcctggagggatggagatgggtcttggggtagacacagcccacacactgccacagtgacagaggagggatttggtaatgaatgtgttccgttggtagttggcagagtggttctgaaactagtcccagatagtatgcgcttatactttctagatatgcctttaaaataagtttcattttctcattttaatttaatttattatttttgagacagagtctctcagtgtcccccagcctggagtacagtggcatgatcatggctcactgcagcctccacctcctgggcccaagtgatcctccctcctcagcctcctgagtagctgggaccacaggcatgtgcctccatgcttagctaattttttaatttttttgtagagatgacgtctccttacgttgtgcagactggtctcaaactgctgggctcaaccagtccctccacctcagcctcccaaagtgctgggattacaggcataagccaccatgcccagctgaaaacaagttttattttcataaggagagccaaggttacctggtcatccagacattgtttagaggattcctttttgttcagtggtgggcctgtcccacagagtagcaacatggggagcattggttgactttgaggagtcaggcagcaagacttcagggtttatgaagtgtaatattttgagaaagtgagtgtatttaatcttgtcatgttacaaatattgaaatctcagcagacttcagttctttatttgatatacatcagggctttctcattaagagtatttttctgaaattgtcagttataggaagaaagttattcttccagcaggtttataatatcttgattattaaatttaaattgttttagtggaaggaggcaaaaccggaagaccttatggattcaaaacttagatgtgtgtttgaattgccagcagagaatgataaaccagtaagtatatttatagttaacaataattgaatgttgtaagctgatacttatttgcataccatttcctgcaaaaccaagatttaagttggcaaattattttcctttatctgatgtctgaagaaaaaaaataagctgaagtcagcaaataagtgggcctttatgaaatcagcctttgaaaaactcacggaaagacaactgattgacagtgtttccccttgaaaagtgcagcccgatggccattgagatgtcataaatcctgaagagcttctgtggcctggcaaaggtataggttgctgttaaacagtgggtgagagtgaaagagggaacaatttgccctttatcatggtggttgatggacgtgtgggaagctttcaagttctcttgttttacaaagtgccctgtcagcctccctaccccttttaccctatctacctcttcaatcaaaggctgcttttagatgaggatttctcagcctcaacactgttgatatttggggcaaatccttggtggtggtggaggttgccctgtgtactgtagggtgttttattaatagcagcatccctggcttctgccctcttgatactggtagtacttcccagttgtgacaactaaaaatgtctccagatattgccacatgtgtcctggagggcaatatcaacccccattgagagtgatcccattccggtgttgcctgtggggagaaggaaggagccccatcctctaggctgtccactgtgagcgctttacctttcatgatcctcacttgtgaccagttgaagaaaggagactgtatctgaaatgctaatttggacttcccttcaacctagtcgaaaacattttaatttttataaaaacaccaaaactgtgaaagcatgcagcatgtgaaactatcctagccattaatagctggagttgggaaacagaagtaccctgaaatgttgtgttaacagtatctatgttggtctgcgcgagtgctgttgatttgtgtcaaaactacctgagattttatttctgctgaatcatttaccactatcattaccctgtttctttaagtggatagtggtcattttttccctcttcccagtgtacatcctgtcacaggaaggtcagtttggaagctgtgaaagcagtattctggcctcagctctgtgataggttgacttggtagcctggggccttgcttcacagggcctactcttctcatctggaaaatgatgggtagagctagattccaggccaatgatcgtcagttactctttccctgacaagctgcgtgcttccatgccctccctccactgactggctctcatcccctgtaaatctcaagaggggatcatagctgaatcttggcaggggaaataaggggagtatgtaacttcccaagattgaaacattgcagacactgagtttgtttcaccttcatcccagcttccaaatgctaagttggtaaagtaattcgccctctgtctaatgctctcccaagcctcctaaccccactaaggcaatcctagggatgttcacatctttgtggtgacagtaatttgtggctaataattcctgagcttgcacaattacagtatgctgatttttccgtggcaggaatttgatagtgcaatatacacagccctttttctctttctttgaagtattagtctcagccgaacttcattatttgcccttatccataatttctagggccctgttgctttagattattaagatatcagataaagtaatccatttttaaaataaatgtgacattttacagtgtggatgaaatgctaccacgtttggtgtttgctgagaactactttactttgcataaaaaagtccattattacatggtcggtgacacttaggctttcatttgtttttgaacagcatgatgtagaaataaataaaattatatccacaactgcatcaaagacagaaacaccaatagtgtctaagtctctgagttcttctttggatgacaccgaagttaagaaggttatggaagaatgtaagaggctgcaaggtgaagttcagaggctacgggaggagaacaagcagttcaaggtaatagtttattttctggtaatctacagaaaacaagggcgttttcactagcttcttgggtggggaagttgatgagccagtgaatatatagatttctttttgcttttggtatttggctatttttttctccccagggagaaatttccatggctttcatgagagtctcaaaagggtccttggatctgcctaaattaagaaccactgtcccttgatcagaaatttctcaactgttgaagctcttgtccccttaaaaaaaaaaacaaaaacaaaaaacttggccgggtgcggtggctcacgcctgtaatcccagcactttgggaggccaaggcgggccgatcacaaggtcaagcgttcaagaccagcctggccaacaaagtgaaaccccgtctctaataaaaaatacaaaaaattagttgggtgtggtggcaggtgcctgtaattccagccactcgggaggctgaggcaggagaatcgcttgaacccaggaggcggaggttgcagtgagctgagatcgtgccactgccctccagcctgggtgacagagctagacttcgtctcaaaaacaaaataaacaaaaccccaaacaactcaaactctccattattgtaaattgaaaataaatgttgagaccaaaatagtttttattttgaatatgcatttttaaaccacttgggtgagaatcttttttcagagagtgaatactgacctatactctgttttaatgcaagtatagttctgattttagaagactctaaataggtctgggcagttgtggctcatcaaactattgatgtggtgatgagcttggaggtggggtgcctcacagtgggtaggaggtggagattatggaaggaaaatctgagcttctagcttctggatgaggcagttggcattggcaatggaaggttgtattgtactgagtgatgaagtggggaggcagggggtgcttcttttggcttgtggtggtgtggaagttgctcccatccaatatgaaacagctctgaatctgtgctggtcacagcatctcttaggcctctgtttgctaaacacctctaaggccccttccagctttaaaagtatgagttttcttctcttttactctgacagtgaggtagatataggagaactgacagcatttgggaaatggcatcatcttcttcctttgcagtgattttgatttgcctcagtcagtaatttctttagtgtgtagtaaattgtgaagctgacactactttttggctaaaaatctaagctatgcctgaagcttctcgagtgtatttctcttctgaaacagagttctgtgctatttaaagtggtaaataggtagaaatagcttctatataacctaataaaataaatggtttagtttgccgggtttttttttaagccagtcggacaccaccagttgtttatcactgtgcagtgatacgggccatgccccatgagcagaatatccttaaaatatgatcagaccaatctcaacattagaagattctttatcctgccaaacactgccttcttgttttgtgttggtttattctgtcatctggccaacaaatttactgagggtctaatatgtgcccggcactgtggattcaaacacgaacagcccctgcccttgaggagctctctgttgttgggatagcagggagagacatagacagaagtgattacaagccagtgtgatcaatgtcccacagagatagcaacaaattgcagggagagtcagctccatgggactcatctgcctgtggtccccaggacctactaggtactcgggcggatgggagcgaatggaaggaaacgaagaaaagaaagtacagctggtgtgtggggtttaaggatgaggagatgaggtaattagcaagagatctatcagcaaagatgagtctgtgccagaatagaatggcttgatgcatgtccctcttcagggatgtgggcttggctttgagagcatggaaatggcatcatagatctacatagtaacttgcagattcttaggaaagtgcaaggcagttgtggcagtggaggtgaaggaagaaaaaatttttcatttcttacatttccatgtagtttggggacaaggggagggtggggaatatggtcaaatatctttatatgtatgaaaaagaatgttgcttcttcaatgagaaatctatgcattaagtagaaaatatttgagatgagtgtatgaaggccagtcacattttaatattccaaatatcatttgatccagcagtctggatgtaactcattaagtaccagctatctacagagctctgcatttgaaagcttccagatgtcccacttttaggtttttttttttttttttttttaatatggagtctcactctgtcaccccaggctaatttttgtaattttagtagagacgaggttttaccatgttgaccaaggggtagtcttgaactcctgagctcaggtgatccacccgcctcagcctcccaaagtacagggattacaagcatgagccaccgtgcccagttgactttgtagattcttttatttatatatttatgtcttgggaaatgcctgtgattttaaaaatcgatgatttgatcaaggaaggctattcattagaggcaggaaggacagagaggttggggttgaagagaagcatccggaagacatggccatagaggtgggtggggccgagggtgcaaagggcccagttgacccttttaagtgcttttttctgtaaatcacgggaaaccaaggagcaccctgtttagatgtctgttgtaactagcagcagcaagtggaatggatgaaagaaaagaggggactgttttctcagtggcttcaggctagccctttcccctctgtagcctgcagtttctccgtttgcaaaatgcggttggaccatatcatgtcatccaacactgggcataaacagcccatcccgttaagctgtacagttgactcccctttctggtgccttggcttgtctttgaaatgtgcgtttgctcccgtaggaagaagatggactgcggatgaggaagacagtgcagagcaacagccccatttcagcattagccccaactgggaaggaagaaggccttagcacccggctcttggctctggtggttttgttctttatcgttggtgtaattattgggaagattgccttgtagaggtagcatgcacaggatggtaaattggattggtggatccaccatatcatgggatttaaatttatcataaccatgtgtaaaaagaaattaatgtatgatgacatctcacaggtcttgcctttaaattacccctccctgcacacacatacacagatacacacacacaaatataatgtaacgatcttttagaaagttaaaaatgtatagtaactgattgagggggaaaagaatgatctttattaatgacaagggaaaccatgagtaatgccacaatggcatattgtaaatgtcattttaaacattggtaggccttggtacatgatgctggattacctctcttaaaatgacacccttcctcgcctgttggtgctggcccttggggagctggagcccagcatgctggggagtgcggtcagctccacacagtagtccccacgtggcccactcccggcccaggctgctttccgtgtcttcagttctgtccaagccatcagctccttgggactgatgaacagagtcagaagcccaaaggaattgcactgtggcagcatcagacgtactcgtcataagtgagaggcgtgtgttgactgattgacccagcgctttggaaataaatggcagtgctttgttcacttaaagggaccaagctaaatttgtattggttcatgtagtgaagtcaaactgttattcagagatgtttaatgcatatttaacttatttaatgtatttcatctcatgttttcttattgtcacaagagtacagttaatgctgcgtgctgctgaactctgttgggtgaactggtattgctgctggagggctgtgggctcctctgtctctggagagtctggtcatgtggaggtggggtttattgggatgctggagaagagctgccaggaagtgttttttctgggtcagtaaataacaactgtcatagggagggaaattctcagtagtgacagtcaactctaggttaccttttttaatgaagagtagtcagtcttctagattgttcttataccacctctcaaccattactcacacttccagcgcccaggtccaagtctgagcctgacctccccttggggacctagcctggagtcaggacaaatggatcgggctgcagagggttagaagcgagggcaccagcagttgtgggtggggagcaagggaagagagaaactcttcagcgaatccttctagtactagttgagagtttgactgtgaattaattttatgccataaaagaccaacccagttctgtttgactatgtagcatcttgaaaagaaaaattataataaagccccaaaattaagaattcttttgtcattttgtcacatttgctctatggggggaattattattttatcatttttattattttgccattggaaggttaactttaaaatgagccctatcactgagaaatacgtgtttcatgatttaactctgtgtgtgtgtgtgtgtgtgtgtgtgtgtgtgtgtgtattttttttttggttgtcttcagctgacagtatgaaaaatgaaactgctgaaaaagctgagcacctggtcacccttggccttccattgctttggccttcagtaaaaagcagcctcccttctaggtcagggaaccatgccattgagactagtaacgggcgttctgggcacagtcccactgtgcacaggtttgagaggacaagttcatcagaaggaaggcagtccttagaagtcacatacgttgagccacgttgctcctaagcctggctctgtcaagctgggtcaggggccttgaaactggagaagtggaagtctatggttggtctgagtaagtaacttcctgtcttcatgaaaaaagttgactttgaatcccaggtactcacagaaatggtgaacagacttagttgttacccaggcacccatggattgtgttgagtgtgcagacagggaggccaccccaataggaattcgtctccaggatttttcccatgtgtcccccagtacttataaaagggagtgaaaagaccgagctgtaaggcatgtgccttctgccacctgactttccgtgaggggactaaaatttactaattgtagttgctgcagccagttaagtcctgtagcttccaggccctcatgtctttgataggagagtgcttaggtggtccccaacagtgcctaggggtacagtacagtcccattacactagagcagggctctatttatttttaaaggatatggccgtgtgttttgataaaactttattcacaaaaacagccgggtcatgggatttggcttgtgagtctgtaacagttcttaaaaagaatatctgagaaactactctgttttagacctttgaaggtgatttagagttttgtgtacatctaggagaaggtgttcagcttctcagaggatgtggacattttggttgcagctaaaaatcagtctctgaagtctctctcccttctagaggttaggacttggtgaacatgtttgtgggccttttgactgagtggcagaaggaaactgctcaggaagagaaacaggtgactgatgggaaggttgattattttctcagtcatcctggcagccaaaaatgtgccaggaaaagaaagaatgtggagcacgcgtggctcctggaggacttggagatgcatgcacatttagggtgttttccctagaattacat

SEQ ID NO: 36195 - DNA, 7107 bp, Homo sapiens
ggttggttctgagaaggcttcaaggaataggcagacatttcagcaaggctgctgaggaaggataggctgtggaaattaggatgcaggtaggaggatcacagagcaaacactccaaggtgggaaatgcaagtgtgtgtagaaggaacagcaagtattgttgggttgggctggcttatgaagttgtgacgggctgagggagagacaggactggaaaagcacgttggggtcaggttgcagaggtccttgactgacagagaggggagcttggtctgtggggaatcttctgctctgtgtggtcagaggctggtctgactctccggccttgccccagtcttcctatccttcatccagccccggctggctcggtaaaaacggcgcgaatctcgctctccctgggtaactagggtccccactgcctggctagtggtgcttttcgcgtcttcactggcaccattaatgaatgaagtctggctcccacccgcggggaagggaggagcctcaacctcgggtcctttgctctcctgcagcactcctgcccgggtcccgcctcggggtcgccaggccctgaaccccaacgccggcattagtcgcgcctgcgcacggccctgtggagccgcggaggcaagggacggagaacggggcggaggcggagtcagggcgcccgcgcgtgggccccgcccccttatgtcgggtataaagcccctcccgctcacagtttccctagtcctcgaaggctcggaagcccgtcaccatgtcgtgcgagtcgtctatggttctcgggtactgggatattcgtggggtgagtgccgtctcaacggtagagccgctcggtcaaagagactgacgcggagagggcgggtctctgggtccgcgatctccagcaggagcagctctacgcgggagccttttcgagctgccgagccacggatgtcgacccctgcccagcctctgggatcgcgggccctgtggggaggggcggaggagaccacgccggagccgggcctaggggccgcttaaccaccgccccggcaggacgcagggactcggcagccccgggccggggaacgttagcgggcgggggttgggaatgggtgggagctgcgcagtcgctgaaccgctgtcttccccagctggcgcacgccatccgcctgctcctggagttcacggatacctcttatgaggagaaacggtacacgtgcggggaaggtaatgccgctccgcgtgcccgtgcagccaagctggccctccacctgccctggtcttcttacgcccagagggtggtggcgtcgcgccaaggccgggtgggacgtttgccccaatctgggtgaatagagacacatcctttatctggaactgggggttctctttttaacatagcccaaacccgtcttaatgcttaaccaaatagggctcagaggctcaatggttatgcttttggggcctgggaatttgaggtattgggaccaagtcatttctttagatcttttgctcttgtcaggtggggtattaaggaggttgggtcccacttaattccgtctcttacagctcctgactatgatcgaagccaatggctggatgtgaaattcaagctagacctggactttcctaatgtaagtggctttagtagaggtggcgggcagaagggaaagccttcaagtatatccatccttgcctctctcctgcctggtacagaaggatgcaaaataggggatcttaacccggatagaataaatagaattcaggggtccttgaactggatggatatgtattttcattcccattaaccactagcaaaagttatttccttttattgtgaagagagacaataagtgacattggttattagccatgtctgtcactttgtcactagtagaaatcaggtattttcttttttgtgtgtttcttgttcttttgttttgagacagtgtctcactctgtcgctcaggctggagtgcagtggcgcaatcacagctcactgcagcctcaacctcccaggctcaagcagtcctcccacctcagcctcccaaggagctgggactacaggcacacaccactatgcccagctaatttttgtatttttgtaagagacggggttttgccatgttacccaggctgatcctgaacttctgggctcaaacagtcctcccacctcggccttccaaagtgttgggattacaggcatgagccactgtgcccagcctgaaatcaggtagtttcatattctataacatgcgttgcagatattttaagtgatatttatatacatgtaagtaaatatatacatataatgttatttactttgagattatgttagtcattacatctgcttgctatttaatgcactaataggcacatgttactcttatttgaatttttaaaaatattttttgattgtgtaaattatctattttgcttcatgcatttaacaactttattctgagaaaaggtccatggcatgcacatacactcacacatacacacaccaatttaagaacccctgtctagaatcttgtggacccagttgctaccttctacttattttcttttttctcctaacacagcatcttctcactcttgttcactgccctgcaagtgttcttttcccctggagagagaggtagggaatcaagagagaggcaggttgttcatttgtcctgtccttttcctttcagctgccctacctcctggatgggaagaacaagatcacccagagcaatgccatcttgcgctacatcgctcgcaagcacaacatgtgtgagtggggtagggctggtgagggaccccaggctggtagtttgtctgagagtggatgatgccaagggtgatttgttgtcatttggcctacaggtggtgagactgaagaagaaaagattcgagtggacatcatagagaaccaagtaatggatttccgcacacaactgataaggctctgttacagctctgaccacgtgagtttccttagcacacatctgctgaatggagtatcagaaaaaggggtatttaggaacccaagggttatctctgttccattctgctgctgctaccttcccaccaatccagattgttagaataagaaacagaacttatattttttggtttgttttgtcatgtaattctggtgctggtgcctcttctttctaaactcctctttccccaccctgccatcctcaagtgaaggcaatgagaacccacctagagaaggggctactaagtgtccatcactggcctgtgccctgattaactacaaagatgatcaccactattctcattctgttttttcctctcaggaaaaactgaagcctcagtacttggaagagctacctggacaactgaaacaattctccatgtttctggggaaattctcatggtttgccggggaaaaggtaggaagaagggaaaagaagaggatacttctctatctctgcaggctactactcctcagacctaagcatcttattgcttttcttctagctcacctttgtggattttctcacctatgatatcttggatcagaaccgtatatttgaccccaagtgcctggatgagttcccaaacctgaaggctttcatgtgccgttttgaggtgacgtttcctgcacctttctcttataaaaacactcacaggctcccctgggacctgcaggatcccatagtggaggattcttccccggcttttgcctaatgggatcaatggttggacacctctagacctttaagtcttgggaagagcctaacttctataccttggaggcactgtctacaaaaaaatggaggaggtagacgcaggcaacacgtgaatgttgctgttctggtatgcatctgttggactgggttggggtcgttataagatttggtgtattttcctttcaggctttggagaaaatcgctgcctacttacagtctgatcagttctgcaagatgcccatcaacaacaagatggcccagtggggcaacaagcctgtatgctgagcaggaggcagacttgcagagcttgttttgtttcatcctgtccgtaaggggtcagcgctcttgctttgctcttttcaatgaatagcacttatgttactggtgtccagctgagtttctcttgggtataaaggctaaaagggaaaaaggatatgtggagaatcatcaagatatgaattgaatcgctgcgatactggcatttccctactccccaactgagttcaagggctgtaggttcatgcccaagccctgagagtgggtactagaaaaaacgagattgcacagttggagagagcaggtgtgttaaatgggactggagtccctgtgaagactgggtgaggataacacaagtaaaactgtggtactgatggacttaaccggagttcggaaaccgtcctgtgtacacatgggagtttagtgtgataaaggcagtatttcagactggtgggctagccaatagagttgggacaattgcttactcattaaaaataatagagccccacttgacactattcactaaaattaatctggaatttaaggcccaacattaaacacaaagctgttgaaatattgatgaaaatgtaagaatttttgtgaccacggggtaggagaagtttctttaaagacgtaaaaagaaaaaaaccataggctgctctgcctgtggagtagccattctttattcttttactttttaaaataataacaatcacaaaggaaagatttgccaattgaataggatcaaattctacaacttttcctaaggcacccacaaataaatgacaagtgagacaaaaagcactagtataaagattatataaagacctataaatcattaagacaactgagtttttaaaaatggacaaaatccatgaacaatttataaaatagaaatatagccaaaaatgtctaaaagatgtttatgatgtaaggaattatcaattacaacagtgagaaaccatatttccttctatccgatgagtaaaaagtttctaaagtgttggcaaggcttaggaaagtgatatgcatttcctgctggtcaagttgtaaattagtatagctactttggaggacaattgtaaaatttaaatcatatcctatgacccagcaattccatgctataaaaactcatccatggccgggcttggtggctcacgcctgtaatcccagcactttgggaggctgaggtgggcagatcacgaggtcaagagatcgagaccatcctggccaacatgatgaaaccccgtttctactaaaaatacaaaaattagctgggcatggtggcatgtgcctatagtcccagctactcaggaggctgaggcaggagaattgcttgaacctgggaggcagaggttgcagtgagccgagatcacgccactgcactccagcctggctacagggcgagactctgtctcaaaaaaaaaaaaaaaaaaaaaaaaaaaacattcaaagagacatatactaagatgttcactgtggcattgtctgtaatgacaaataagtggaaaccgtgtaaatacctgtcaatactatggagtaccatgtggcaacggaagaatgagactgaactgtgtgaactaacatgcaaagatccccaaaacaggccaggtgtggttgctcacagctgtaataacaacaccttcagaggctgaggtgagaggatcagttgaggccaggagtttaagaccagcctgggcaacatagtgagacccctgtctcccaaaaattttttttaattagctgtgcgcaattgctcatgcatagtcccagctacccaggaggctgaggtgggaggatcacttgagcccaggaatttgaagctgcagtgagctgtgttcttgccactgcactccaatctgggtgactgagcaagaccctgtctcttaaaaaaataaaaaagatctccaagcatagagaagagtctggagggaaacaccaaactcataacagtcttactgcaggcaagtgggataaaggcccagactccatggtggaagttaaagggcatttccaagttaaggctaagacttgcttttctaactaagagaatgtgctcatgcattgcttgtgtagtagaaactagtttttagaaaagaaagcaaacttaagaaacactgactcctgtggagatgacttggcaccactctcctttcacagagcagagtctgaatagtcttcagagataggcctgtgggccagattgccatcccctatggaccagaagccaaggatctctctagtgatggtcagagggcccaaatggcagggatacccagtgatgtcaggaggaatagtacagacagaaggtgctaagcagacaattcaactgccatgttttgccaccccctgtgagcagggattaggtgttcaggccagtatcttgggcatgggggagcctttggccagaagaggtataaagctcagaagtttttcagtctgataactattgatataatttccatagtgtgagggagcggtatgctctacccttgtgtatttaaggcaggacagagaaattgaggatgcccctggggctagatcgatgatatgaccagaaatcaaaaagggaatgcattatttattgctgtgtaacactgttaagagaggaggtagttaagggatggataggcacatagagagggaaggtctcaggagaagggatagaaaggaactatgttcacaagaacaacggcaagacagtgcctatactgcctctacagttaataggaaaaacggaagaagttacccttaagctaggatgttgctcagaagtgaccatcccaactttggtgcgggcacaataaatcagcctaaatgtccctaatttaacccagctcattataatgtcattaaacatgacattagcattgtggttttagcacccccatgggttttgcttaggcactcatgggtaataaccaagatggagtccctttggcaaaacttaggcatgcacagctgtagtaccccaagaagaaaatgttacttctctcatctgggcaaaacccacagaagacttcccagcttctgccacataaaagacacagaacacagacgccttactggcaacctgctttcaagacccctgtctttgctgagagctttcctttttcccaataaattctactctgccctactcactctc

SEQ ID NO: 36196 - DNA, 272005 bp, Homo sapiens
ggcgctgagcgagctcggagcccgcgctgtgcgcctgcggccggggcgccccgccgagcgccggtgccccggctcccgggccgccttcgccgcgcgggtgagtgagcccgccccatgcttttgtccaggcgcgggccctggaagtcaaggctccgagggtgggagttctgggtgggggctgggacccccaccgtctgtgcctcccgactcccctaatggagaggggccccggggtgcggcgaggagtcaggggcgtaaggagacgaccccagtgacgccaggctgcacgagttttcttttggggagatgaagtgcttggggacactgatgcgattgcctttctaggaatcatccgaagggggtgcctttgatttgaggggcggaggagaagcggacccttctcccagctcccagaccctcgctagaggactcggtgacggcctctgggaagggggtgccacgtgaaggtccttccagcccaaatgtgattccgggaaggtagggcggggaaggcggcccgcgagtgccagacctggccatcccaggcgaagctggggcgcgggctttgcagacttgttcctactccatactcctcatttaagctccttacctcgctctgcctccttcgcgttaactggggtcccattgttgagggaccttgttcgccgatgattgcagttggaaagttttggataaacttctcaggagatgtgagttgtcaatggttgaggtagacccctccctggaacttatggaactaaaacccttcaagacccaaaggactgaatttctaggagtggcattgcagatgtgaagatgggctgatggggaaatggtttcaaggatatatattttttttagattggggtgtgtgtgttggggtgcggggcactttctatttcgtagccagaaggagaagacccagctctactagagtctagagggagtaaaattagctgttgtgattcagggagctgggtgggtgtagggaaacacctgggcagtgggcatgatgccagacctcaggccgttggtttttaccatccctcctctccccaagtgcaaagaccagagtatatgcaatgacccgcccaccccacagcctttgagagcctgccctggagctgcatcccccttccaagagaggctgtgttcttctccacctgaatggaatactttttgtcaaaatgcacttatcaataaattatttccagatggtgggcttaggaggaccatttggggaaccccgcccacacttcaaagaatcaggaatcaacaatgcaagtctctgggagaagtgtaggtgcatctggtgactttactaggttcctacaaggcatttagggttctaatagaactgttttcttttctcttaaattcttgacctccttctctcttccgtgattctcttagtctcttccccgcctgcacactgtgggactgtggaggatgatgctgctggcaccacagtgctctagggcagcatggaattttccttcctgcccagagtgaggttacccctttttctcccactctcagtgggccaggagccttgggtctgggaggaacctgagcagttggtcctgggtccggagtggttggactctggatgctggattgggtagcgggtactctggggacatgcacaagagctttttttgccaagatgtgcaggtctgtctcattgttcactgatgatacaaaggatgctggacctcatttgcagctaagcatgagcttggagaaccaccccacagtggggaagcatttatgctggtttatctcccatgttcagtttcttttgtgtaataactggctagctgaggaggagggtagctgcagcattgtagatgtttccttgtcttatttttatttttattttttattttgagacagggtctggctctgttgcccaggctggagtacagtggcgtgatctcagctcactgcaaccttgacctaccaggctcaaggaatcctccacctcagcctcctgagtagcagggactacaggtgtgtgccaccacacctggctagttttttggattttttgtagagatggggtcctaccatgttgtccatactagtctaatgggctcaagtgatcgcccacctctgcctcccaaagtgctgggttacaggcatgagccactgcacccagccagagtagttgctgtttgtgtgaggtttgctcaccccttcatcaggggctgcttccccaggggccagatcttagaaaacatatgcagagcagactaggccttggaacattcctaggctaactggtaaggccaggtggccccacctgctgcctgaaaatggtagacagacagctacagtcactgcagaggaggggctcctggctggcaggtggcgggggtaatctgctgagaaggcttgtcagagaaggaggtgacccagatggtgcagaggggagaggcctttgagttccaagggtggggaaaggttctgggtctctggctagggagatctttgctggtctcagaggcatagattgtgaatgcgctggggtcaccatatactcagtgtctttgagaatgaccccttgcttttatcctcaaaatataagatgagcctagagtttgaaacacaactagttggcttgtctgtcttttaggaagttcataaggtggggtgggggtttcagaatgcagccttgcttggggacatgggtacagtgtcccatgagtatggggtgtcttatttagtatctttctgagaacaatacttgggagtctggaaatataagcctacttggaagcccagctgcacctctcacagctcaaaccaacccacacaggctgggagattgttcattcttaaaagcttcctgtcctgtcttttcagcaaatgtagtaaaatttagaaacaacacttaaaaagtatcctttcccaacaaaagacaatgtcctcgctcaacttggccagcagagggtgcatgcagaggacatgaggcagggccatttgcatggaaaatgtccatgtggatgcttaggcctgagcagggtctattgggtggcctgagtgctcagaatcaaggaaccgtccagcagtgagccagagtgggacagaacgatgtcactgtgatgagctcctatgccatgtgacttctatctcttccctgtgctcccccagcctcctaccttacaagcaggcagacatggttgtgcggggaagcagtgcccatacaagccacgcccctctcccacctgcaccattctgcagatggattctctttattcttccttgagttttggctgcacacttttccattcgtttgatgccaacaggttgagcaaatgcattcccctcacaaactcaaggtgggtggacctccgtatttgcactgcgggccaacaggtgcatccctcctccttgttgcatgcacctggtgtgtgagggctgcagcccccatgaaatttactgacagccagcccagtcagctggggcaggaggagagccagcaacagttgctgcctcatgggctggaaggtaaggctgtgtttccagatgctcccaccaccttcttttccctgccctcctgctcactgtacttcagtgtctgagggtgaatgggcaccccactagggagctgtggaaatttttgtgtagatccagcttcttagatttcccacgttgtccccatcccccctctgttggtacttccttgccccccttccaccctctgctcctctccttccctgggtcttcagtgcagagccctctggagacagaaagcccctttggagacaaaagaaaagggatgaggagaggatttccttttctttcagacctgcttcttgattttttttcccttggctctgggcgctcagatctgatgctaatttgttaatccaggaccttatgggttatttctcataatctttgggggaaccgaacacctgcaacttggggcttttatagttgaggatgctgtttacctttcttgttttcagagatgaggatttctgatgtatagtaggtctcattcaggtttctggcaggaggaggcagccaggcagaatgtgatctttggtgttaaacttgggttcagttccatcccattcacttactggctgggtgttcttgggcatgggttttaacctctgtgagctgacttgagttttgtcatctgacaatgagggcggttataaaaattaaatgaatataggaatataaataggcacaaaacaaagaatagcttttattatatataccgggcagtgttctccaggtctatataatgacttgtaaatcaaccagcagacactaatgatgtctactttctattgagctctgtagaggcttataaaacaaaggtaaatgtgggccaggcacggtggctcacgcctgtaatcccagcactttgggaggccaaggcaggtggatcacaaggtgaggagattgagaccatcctggctaacgcggtgaaaccccgtctctactaaaaatacaaaaaattagccaggtgtggtggcgggcgtctgtagtcccagctactcggctgtagtcccagcaactcgggaggctgaggcaggagaatggcatgaacccaggaggcggagcttgcagtgagccaagatggcgccactgcactccagcccaggcgacagtgtgagaccccgtctcaagaaacaaacaaacaacaacaacaaaaaacaaaggtaatgtgtctatgctaagagactctgggtgggtagcaagagagctaacacataggtaattagaaaacagggacaacatgcaatttccaagtttcattaacagaattaaaggatgacaagaaattcaggggctagagtgatgcaggaaggcctcaaaaatggagaggaggaagggagggtaagcatttgccaggagagaggaaggcaggaacatttggctccggtgtctgaaggctgttagctccttccttgctgggccctggcacaacacctttgaccttgcagcgcactcccaaacatgcaggtgtgcttgtcctgaggtttattttgggggtggttttcattctggccttgttttccctctgctgccaataatatttctgaaacatctgaaattgttttattttatactcgatcaaaaatattaagaggcaattgggtggccagagtgaaagcccagaggcccgtagaagacttttgggtttctggggctttgtgttctcttttcatgcctcatatattgtagctcacttcctagttctggaatcacagggtgttaggactaagggtcaggtccacttgacctttgcattggactgaagaggaaactctggcctaagatgccaagtggtggctgggcaccgtggttcacgcttgtaatcccagcactttgggaggccaaggcgggtggatcacctgaggtcagggttcaggaccagcctgaccaacgtggtgaaaccccatctctactaaaaatcccaaaattatccaggtgtgatggcagcctcctgtaatcccagctactcgggaggctggggcaagagaatcacttgaacccaggagcagaggttgcagtgagctgagatcataccactgcactccagcctaggcaacaagagcaagacttcgtctaaaaaaaaaatccaagtagtagagccagcatcagccagagttctcatcactacctatcctggtggaggatggtgatggcataggaaggtgaacggcctgacataggcaggaagaatggatacacattggttccctcatctgcccacctgcttctctagagtcctttaaggctgtcctctttagtctgagggtccaatggggagcaggagtgaatgtcctacctttatctggcctgtgatcactgccatctgtctgcttcagggcccctggataccgagtgctgttcccctttcctggggtcagactacatggaatgtcatctgaggctgtgggaaacaccaggaagatgccccgggtttgggggctagcttcagcactgtcttctgctatgtgacgtggtatctccaggtctcagattgtgcacctttaaatggacagagaagcccttctctactcatctgatgaggctgtaggcagatgaacacgtgcttggcaacctgtgcttgtgctgtggtcgtaagggtagtgtcctgctaggcactgtgctcctggaggtcaccagctgtggttcatcttgtatccttactcatagcctggtgcctgacacaccacaggtgctcagtacatctgggtggaaggactggctaatggggtaaatggaggtgctcagagaagattctaagggatttgctgtgtgccactccatgagaaggcactttccactcattcacctcacttcttcagttatgtcttctgtagggctaggtatacttcattctaacttttctcctgagctttatgcatctttccagccaagtactgagtccattcacagaacatgactcaagcagatgtattcctaaacttccccattgtccaagttaaatttccatttggtattttcctattagtgtcaacagggtgatcattttcgtaatcacttggttgctgatcttgtggaaacgagtatgttcatgaggaagcagcaggtggctttagaacgtgcctggaggaacagttcttatcttgcaacctgcctctgattactatcaaaagctcctgcctttccaatagtcactcatggtatacatgatacaatcaacgcagttgctactgatgttacccaatagtatgttttagggagttctcaggcttcttattgtgattgggcaggcacctagggactcagctcctcccctgtgggcctgctgattatcccaggcagagaaacacttggttttactttgatattactattttttcctgaccagaccgtactagctcacacttggagtattaactgtggcttctctgtagcccaaatacatcgtacacttgattgctttgttgatctaaaacatagtctgactgtgtcaccaccttcaggaacccccggtggctccctgtttcacacagaacagccttaagccattcacaggcctctataatctgacctccaagcccagtctcatagcagccacccccacactccttgatcccactacaaccagacttcttgtctcagcccaattgatactttcctgtgtctctgactgtgactgtgagttcatcctcacctggaatattcttcacttgtctgtttgattgacaggttcttctatccttaaacatttgttcagggaatgagttaagttcctaataactgtcagatactgcccccagaggctgcctctgaccttttcagcctcaacttctctagaaataagtccctgtaaaattctttttacagagacaagtcataaattattatggtatgtttttatcatttgtttaatttttctcatgctaaaattttatatctgtaactatactgaaaaaacatcaagggaaggacatgttaatgcctctgtttcctcatagcagtggttccagaactggctgataacaaaatctctttgggaaccttgtttgaaaaataatctatggctccccagtcccagcccagactaccttggtggggtcagggaatctctggtttaacaaagctttccagatgtttgtgatgtcaacctgatttgatgtttcactatgtaattgtttctattatttctttgatttgtgtattaggaaggattcttcaaaattaacagaaaccaattcgggccagctgaagagaaaaaataaaggtaatagcatgataaaagatggattcttatattttctttattccaaattatagccactaagattcgtatcactttatagtttctcaggaaaaagcacttcctttcatatagacaattttagaaaagtttctaaattacaatataccttaatttttgaaattgcataccagttttttcatcattataatcaaaatataaagatccttctgaactatgataatgtgataactgatataatctatcagagttacatatgatttcaaggtgaaatgctgtttttcataatctgtgttcatgatttttgaatgttgatgcattcttgccttcctggaataaacacttagtcataatgtatagtttttttaaaaaaaaaataccccagtgactttgattttctaatattttattttggttttttacatctgtagtcctaagtgagattgaactattaattgtctttgcttcccttggccagttttgtatgtgcccacaattttgacatttttggcacctttaggattgacagaataagtctgaggaatattaaagtctaccagggttttgtctatgtattctttagattaaattttgagttctagcttttctataagtaatattgctaaaagttagatatctttttctaaaagttaactggaaactttgaaaaaaataaatattcagtatctacctgatcatctgttgcacataaatcagtcacaccaacttttcctagtttcggtgtattctggtctggtaaatttggcagtttctactgtctttttattccattgtttgacaaatgatcagcattttcccaggtacacaataacttttcttttcaatgctgcatcataataggtttttttgaagactctttttctttctcatgtaaaaaagtagatataatttatatacagtaaaattcacctgttttaatgtacaattctgaacaattaatacataattatgaggaagttcagttctgaattttgacaaatgtatatatagtcatataggcaccatcacaattgagatacagaagagctccatcacctcccagaattgccttgtgagcttttgttgtctgctctcccaccatgcagaccttggcagttactgatctgctttctctccctgtgttctttcctatctcggaatgtcatataaatggagtcatggtttgtaggctttttagtgtgcctgctttcacttagcattaatgtgttggagattcatccatggtggtgggtatatcaataggttattcgtttttgttgctgagtattatttcattgtaaagacgtatcaccgtgtgtttacctattccccagttgaaggacatttgggctgtttccagtttgaggtgataatgaacaactcactatcaatgtttgtgaacagatttttaggtgaacatagatttcatttcacttgggtaaatatctaggattggggtttctgggaggtatggtaaatgtaatggaataccaaactgttttccaaagtggctgtaccattttgcattcctggtagtaatatatgagggttatattttccacatctttgtcagtacttggtattgtcagattttaaaaattttagacattctaataggtatagttttatcatattgtgtttttaatttgaatttccttagtgactactgatgttgaacatctttgtacttatttgccaaacatatattgtctttggtgaagtatctgtttaagtcttttgcccaagttttattggattgtttgtttccttatgatttagatttgagagctctttatatattctggacattaatcttttattgggtacgtgtttggcaaatattttctcgctgcctgtagcttgtcttctcattctctttaacaatgcctgttactgcatgacagaagtctttaattgtgatgaaattcaatttatcaatttttaaagatgtgttatgcttttgctgttatatctaagaaatactaacctaatgtggagtcattaagattttctccagtgctttcttcaagacgttttacatttttaggttgtatatttagttctgatccattttaagttaatttttatacatgatgtaaggtatagatagagattctgttgtgcatatgaatgtccaatagtgctagcaccacaatgaaaagattatccttctcttattgaattgtgtttgtacctttgttgaaaatcagttgagcatgtatgtgtggtctattctgagtattctgtcccattgatttatgtgtttattctttcaacaataccacactgtattgattattgtagctttattgtaagttttgaagtaaggaaatttgagcccttcaacttagttctttcttttcaaaatagttttggctattacagattttttggcctgacatataaattttagaatcatcttgttggcatctgcataaattcctgatggaagtctgttggtattgcattgaatctataagtcaatttggagagaattgacatcttaacaatgttggatttttaagtacataaataaactatatttctccatttaggtcatctttgatttccttatcaatattttatagtttttggcatatacatattgaacatattttgtcatgtttatagctatgtatttcatgttttggtgtaatttttaatggtacttttagtaaaattctgttttccaattgttcattgctagtatttataactacaattgatttagtattttaatggatttttaaaaatttaaatcagaataaagtacagcaaaatgtgtacttgcagagtttgaaaatctaatgtgattagtagctagctaaatctaatgtgtaacttaaacaatttaaaaggctgggatatagaatcaattttcagccctcatctgctcttaactatttccctgagctttttaattatttttaagcaactgatttttgtttgttgaccttatatcttttgacttttctaaactgacttattagttctagtagcttttttttctagattctttgagattttcatcatagataatcatgtcatctctgaataaagatagttttatttattcaattccaatttctttgcctttattttacttgttttattgtgctggttaagatttccagtataatgttaaacaggagtggtgaaaacagacatcattgccttgtttccaatcttaggaggcaggtgttgagtcttctatcatcttgtatgatattagtcataggttttttgtagatactttttatcaggttgaggaagtttccttttaatttgcttagattttctttgtctttaccgtgaatgaataatgatttgttcaggcgctttttacggatctgttgagatgatcatattttttcttttgtccatgagttggcaaactttttcacaaagggcagtgtgagaaaaataataaatatatatttggtctttattttcagtttctggcatagagcttctaaaaccctgggagtttcctgagtgagagtggtgagaggaatgtctttggttattcataataagtccctttcaaccatacctgagtttatgctggtgaggtgacacttggtgagcccctatatagcttcaggatgggggctgattgtcagaggaaacaaccatgtaattagaaggttggaattttcagcacaccctgccctaacatctggggaggggagaagggctgaaaactgagtaaatcattaatggccagtgatttaatcagtgattcctatgtaacggaacctccataaaaactcctaatcaaaggggtttggagagctttggaattgactaagcacactgagatgctggcaaggtgctggcaatgcctggagagggcatggaagttccctgctccttttcacataccttgtcctatgtatctcttccatttggctgttcctagattgtatcctgtaaaataaactggcaaatataaggaaagagggctctcaagttctgtaaaccagtctaacaaattatcaaacccaagaagggggtcatgggaatccctaacttatcgtcggttggtcagaaataagaggggcccaggacttgtgatctgaaatgggggcagtcttggggactgagcccttaagctgtaggatctaacactaaggttagatctaactcaaggttgatagtgttagcattgaattggattgtaagacgcagctggtgtctagagagagattcagttggtatgaggaaaaaaactccacatagctgggtgtcagaagtgttctgggagttaaaaacaggtcataatagccagataacaaatattttaggctttgtgggccataaggtactttattcaactctctactcaactctcataaatctcctctactcagtgattcagctctgccattgcagcatgaaagcggccacagacaatagatggataagtgaatggatgtggctgtgttccaggaagctgtatttacaaaaacaggctgcaggttggatttggcctgctggtcatagttttcccagtcatagtttgctgatccttgctttagtctattgatatgtggaattacagtaattgattttcaaatgtttaaccagccttacattcccagaataaactccacttgtggtatattattaatctttttatatattgctggatttggtttactcaatttcattgaagttttttgtgtctatattcatgaaggatattgatccgatgtctttgtctggttttggtgtcagggtatattggtagccttatgagttggaaagtgttccttcttctattttctggaagagtttgcataaaactgttgttatttattcctgaaagttttagtagaatttgccagtgacacctgagcctgaagttgttttgcggcatgattttcaacagcaaattaaattatttaataaatataggactgtccaggttatttgtttcttcttgagtgattttcggtagtttgtatctttgggataatttgtctatttaatctaaaagacagaatatttataaatgttcataatattaacttattatccttttaatttctttaggaattgtagtaatgtctcattttctattcctgatatttatagtttgtatcttctcttttgctcttggtcaatctggctagcagtttgtgaattttattggttctttcaaagaaccaggtgtttgttggtttgagttttctcaatgttttttgtttccagattcattggtttttctttatcatatattctgcttgttttgggttcagttgctcttccttttctagtttgctaaagtgaatgcttagatcattgatttgagacctttcttcttttctgataatttctagggttctccttttctgggacagttgggttgggaaaggggacatggaggtgtagaaccagttttcctacctctaagcatttattaggagagctttagtaaaagccttaccagcagggagccctgaggcttctgcttgggggtgggaccaatgggaaggaggcgaacggtcacaccatggactgtttctttcatgggaagcagtggcctggtcttcccaccctgacagtctaggaccctaatgctcatctgcctcccaatatggtctgtagaaaggagaggaaagggagttggagttcctgcagttttgttggatgaaagggttctctcctaatagtttagaccaggagctggtggactttttctgtaaagaggcagatacagatagaaaatattttcaactttgcaggctataccatctctgtcacaggtattcatctctgccattggagcacggaaggagctgtagataacatgtaaatgaatgggcatggatgtgtttcagtaaacctggtttacaaaaatagacaacaagctggatttggcccatgggccatagtttgcctacacctacctgctttagtctactaatgtggtgaattacattgattgattttcaactgttccagacaagttgtattcttgagataaattccacttggtttagagcatctggtctgtgctggccctgtctttgtttctcagcttgcattgtcactgagccatgagcttctcaggggtagggccacaatagggccatctctgatctcctgtcaggtatatggtagatggctagtgaacctttgtggctgggtggaaacacctgtgcccttcagtggtactctgctgcagcttcctttttggtccccccaggagcctagaagaaacggaggttgggtggaggagttgggctcaagtgctgtcactgcaggccccaggctgatctttcattttgagactcttttagaaatgtgactcatgtttggtctgtgaggcattgctttctaattactctctgtcctttttctgggggatgtggttggcaccatagctggcaggctcaggaattcaggcctccaggtgccagcccagtgctggtgttctaaaagggcttgattgacccctttccaggaccatggctttctagatccttttatagaagagtgtgcctgtgtgtgggaaggggcagagcaggagggtccatgcccttctggctcctaagtgaccttcatgcctgtggagtgtggactagatagagccatgtgacaaggcattacaaatggattttgcacaggtagatttcatcgtccatcttagccaattttcctaattgattgggagggctgggtgggcagttgatgggaaggtcctggagctaacagacctgggtttcaatcccagctcaagaacttattagatgggtgaatctgggcacattatttaactactctgaacttcagttcactcccttataaaatggagatgtaacaacttcccagaattgttgtgaggggtatgttaagtccctcactttctctcctgggctgacagaggtgagcagagtggtggacaacagaagtgcaaaacgacttgaaaacatgggagaatccatttgcagactgggatatggagagggtgtgctggtccccttttcctgcctagaatatttcagagctgaaagatggggaggggtgattcaagggccaagcctctgattctgctctggagcaagaccaccctaggtctggatgatgccttaggttgtttgggcctcttgtctttcattgttcagccaggttcactgggataggaacctggagctgtgccagtcctggtttagaggaattagttgcataattgccttggatttaatgggaaaatttaaggcctcttggacctgttgataataataaccctccttatgactacccagtgtgggaggagtgaggagagtcacctccaactgccttcagaacaccaccaccttttcatgtgttctgaggtttctgctttcctcttgacaaggttcaagacccttttgcacacgtgttaggggatgaggaccctgctttcctgcagagtctgtgagttaagggcactacagctcctaggccgccctgctcaccccagactgaggcctcattgccttctgggacaatcagaccaaggcttttactggagagctcataaaacttgttaaggatcaagaactagataaagttccaattttgtcaccctgagataatcttgtattattgtacctgaaaacagtattgaaacacagatctcattgtgacacccctggttaaaaacaatgttaatcccctgctacctaaaagacaaaatttcagctattcaacgtggcatgtaaaataggctgcaattaggcctgccacataaaatattcagttattattttgctataaatacttctcatttggataatgttttacagtttatttgtacattttgcatttaatctttgtcaatcttatgatattgttcttgttcccactttgtagttgatggcccaaagtttagggaagttaaaaggaatttgtccaagatcaggtggccacaataaagtcaaactaagcacagggtataaattagtgctcacttgctacttcctcactgtatgaccttgaacaagtttatttatctataaagaatcagggataatacaacaaacttgtaaagtttttgtgaggattagatgagagaatccaagcaaagtgcttgggggaatgcctggcacatagtaagtgctcagaaaatgttgggtattattacgatactctattttaattgttccacaattaatgttttcagtttttaattccactattataagtaacactgttataatgatctttgtccaaatagtttattttttctgttgtattatttccttggattatattccaagaaaagcattgctaggtcaaaagatacgatcctctttttttgcctttgttccatattgccaactagccctttagaaggatggttcccatttaaaaggctgctactagacccatgagagtgaactctctcccactggtggtacttctgtgcaacctctcagcccatcagagggcatataccagtcatttatcagtcattgaggattataattatcacctttcaaaaagaccaacagatcctagactggttggagccaaactttataaactaggttgtgcctacagcaagacataggacccggctaatcagcaaactgtactaaaaactctaggaatggctgacctctcaactcactttctgtagggctctgtgggagtctttgcatgtacacagcaggtagataagaaggagtggtgttgggggaggcaggagttgcttatgagctgtggacctgaggactgtagggaggaagactgtatgggaaccatgtgtggcttcagactttttatgtaggagagtgtatgcatttgtttgggttgtgtaacaaagtaccacagccaggtggctcaaaacaatggaaattcattttctcacagctccagaggctggaagtctgaaatcaggggttcaaacagagtcaagctttcctctgaaggttctgggaggatccttccttgactcttctggcttctagtggctgccagcagtccttggcattccttgggtgcatgtgtatcactccagtctctgcatccatcttcacatggacttctcccctctgtgtcagtgtatgttcacatgatgtcctcctctctgtgtgtctgcgtccaatgcatccaaatttcctcctggtttttttttttttttttttggatactagtcattggattaaatcccatcctaattcagtatgacttcatcttaacctgattatatctgcaaataccctatttccaaaccaggccacattcacaggtaccagaggttaggacttcaataagatttttggggggacacacttcaacccatgacagatggattgggaagagaaaatggaacatgtccatttttcatatcacagactacaccgtggatggggctgttggtggagaaaattatggacagtggtagtgtcactggtgggaatgctggacagttgtctggggccagtgctgcttctgttcttggcctccccagccccacttaccctaaggatttgtcacaaaactagtcactgataagtattaggtgcttctagctgggatgatgcagccatagcagaaagagcttagccaccgagggaaaggggtgttctaggagccagtggggagtcatagaaataacgggactgggcagacatgcagatctcaggttaagtctcaggctacctggaacaccatggcctcagtttccccattgaagggtgaggagggagggactgcatagcttctgacgtccctttctgtttggcattatataattctaacaggagaggtaacattttagagacacccaagctccttgactctaagggttgtcctgaggtctgtctgggtgacgaggtgtgagcagctgatatgggtgggtactggggaggggacaatgtggtattttccatcccaggtctttccaacaagactttattcaagtcacctctccatgaggcctttcctggcctctctaaaatttcaacctcatcctgatatttcatgtcccctctttcagttttaatttttctccttatacttatcccctatccaacatggtttacattttatgtattttcctcactaattgtctgtttttcccactaaacagtaagctccttgagggcaaggatttttatccaattctaaaataatgcctatcacataccaggcactccatacgtatttgttgaataaatgaagatgtggtaaacttgataaattgggtgaaaatttaaagggggtgtaccagttatattctttgaaaggtctcaatcctccctggctccagccccctagccaagactgcccagggtcctgccataagtagcacctatttctgcagggtttgttccagtcatcaattgctgggagaaaactctcccaaacagtggcataagacaacaatcattttgttatgctctggggttctgtgggtcaggaatttgaacaggacacagtgggaatggcttgtgaagacctgaaaagctgaggtgactcaaacagctaggggcttggatcatttggaggcttcttcacttaccacctggcttctagactgagacaacttgaaggctgggctcagctgggatacctggagccagagtgcctacatatggcctctccatgtggcttgggcttcctcacagcatggtggctgggtttctggagcaagtgttcccagaaggagcattccatgagagccaggtgaagactccctggtcttttattacctggcctcagaagtcacatagtgttgctttttgccgtactctgttgatcaaagcagccataagcctgcaccttggtaggaggagtgtcaaagattttgagaccatgttttaaaactgccacaagaatcttaccactttctcaccggtctcaatctaaagttaacctgaagtaaaaatctgccaccttcagatcaggacttatggtgaattatacctgttctctacctcactcttcactaatggagcttcttcaggacagagtctgccatgtttgttttttgaagcacctagcacattatctggcacacaataagtactaagcaagttagcaagcaagtgaatgaatgcacgaacacagggaatgggtgttttctgtggctggcttagcactgctaagtagctacaggaagacttgaaactcctgtctattaaggccaaagttttctaaccagtttccattcatattcttcactgctgaaagctgtgggttaggaatagattcctgtggaagagacatgagtatggagatagaagttgtatggtatgttagggaatactggtaatctggtttgatgatagctaataatttctgtattttcctaggacaatggcagaataaggctagaatgtaagggccttgttacaggacactgagtatggatattattcattaatgaagagtcatcaaatattgttgagcagcagagtacatgtaataggagctgtgaactaggaagattgacttgccagtgacattcaaaccagattggagtagggaaccccacagataggcaaaacagagatttgaaatccaggtatgtaaccagggcctgaaccaagctagaaactgcaggaaagccagcaaggggagggatgtgagtgattgtgaggttagcaggtgtttgggcccatgtgagaggtgacaaaaaagagaatgtaaaagatgatgcaacaatcacatatatgtagagatggagtctgtcactcaagctagagtgcagtggttgcagtctcgaactcctgggctcaaacgatcctcctgcttttagcttcccgagtagctggagctacaggcacatgccaccgtgcctggctaatttttttactttttgtaaagacaggatctcactatgttgcccaggctggtctcaagctcctggcctcaagcaatcctcctgtctcagcctcccaaagcaccaggaacactcttactttgtagggactaatttctataattttgttataaaaattttcaagtatacagcaaagtttaaacacatgtatggtgaatacatatattccctccacctagattctaaagttaacattttcctgtatttgttttatcacctatctgtccatccttccatcgtcaatcagtccatcttgtttttgtgatatgtttaagtcacagacattaggaaattgtacattcccctaaatacttaagcatgcataccattaccttgagttgaatattgtttacgttattttttcttttgaggtaaaacttatttatagtgaaatgaacaaatcttaagcataccattggatgactttggacaaaagcatgcacctgtgaaacccaaacccctttcaagatttggacattaccatcatcctacagaattcctttgtatttctttccaatttctgtccccaccctccagatgcaaccattattctaatatttaaggcacagatttgttttgtctctcctagaacttcacataaatgaaattgtatggtatatattctttggcttaatgtttctttcatttggcctgtttttgagatttatccatgttgttttgtgtatcagtccgttccttttaattgctaaagagtattttgtttatggctataccacagtttacttatcccatttccagtttttggaaaaaaagttgtttccagtttggctattatgaataaagctgctatgaatatttttgtataggtctttttgggtagacatatgttttcatttctcttgggtaaatatctaggagtggaattgctaggtcataagatgagtctatgtttagttttgtaagaaactgccaaagtgtctgtttccacatttatacacctatatttccaatgtatcagaatctagttgcttcacatcgtcatcaacatttggtattgtcagtctttttaattctagtcattcttgtggatactgctatggcagtatcctattatagttgtaatttgcatttccctaataattaaggatattaagcgctattatgtgcctattggccatttatgtatctttctttttgaaatattattcaagtattttgcccatttaaaaatttgaattgtctttttattgttgagttgtaggaattttttattctgaataccagttctttatcagatacgtgatttgcaaacatgtttttctaatttgtagcttgcctattcattttctttcttagagcagaagttttacctttttttttttttttttttggcaaggctatttttttttctgtgtccaaagaaacttttaccacccccaaaattaccaagataatcaccattttctcatctagaagctttataactatagtttttatgtttaggtttgtcatccatctcaaattaatttttgtgtatagtgtgaagtagggatcaagatttcttttttgcccctgtggatatccgttgttctagccccatttgttgcaaaaacaccttcctttttgttaggtactgtttttattctcttgcagaggaagaaactgagacagagctaggttaagtaaccacacctggcagagacagatccaggatttgaacccaggcagtctggatgcagagcccgtatttaaaccactgtgttataataacccttcttacgtggatgacaggttttcaacgtgagtgcaggcagctcagtgtaaagccctggtagggaattcaggaagcaggggagttcagtttgggattgagctggggagcccatgggatacctgagtgggcacagtggggagaagatagaaaaaagacggaaaaacttggaagaacaagtaggggagaagggaggtgggggctgctgaaaggggatgttattaagcctaacctggatttcaccttttttatttagcatcaggggattggttctctgtcatatcaatcctggtctagaagagtcatgaaataggcaagatacagctagtctaaatcttttgaatttaggtagtaagggtgacatgagcaagagtcataaagccagagaagataaatagattaagtagaggtagggaaagtcagcaagcatcatgtttaggatgcctactctctgttagacagacctggcttcaggtcttcatccaggccttgcagctcactctgtgatctcaggcaagttacttcatttctgtgcctcatttttcctcatctgtaaaacagagataacaccaacctcactgaattaaaatagacaatggatttaaggcacttagaatagtagctcaataatggtgtgtcagctattttaagattcagtattttaagaatgtggtcaaggcccagaaatatagtagaccctcaggaaaacttgctgaatacacagatgaactacagggacacaggattctccagtttaaattgtgtaactgcatagttttagcacagatggccatgaagttacagtaagaagctaggaccatgagctgagctggtctctaaatactcaaggtggtgcaggaggcagcccagactggtgacgctgagccagcatggccttagagccttccttaggaagggcactgactgctggctcggattccaatggagcccccacgggcctggagctctggagtgggcagggaaggtgcttctgctctgagtgaacagagagctccctgacagcaagcatgaggatactcctgcctgcggaaggggtgacacctcaagtgtattgttgcccagatggcccacagaaacccatgtctatccctggttttgatgactatgtcctgatctagccccacttctagaaaagcccatttaaatggagtttgtaggattgacattttgagtccagtccactctccatataggcaggaagcagagtcaattaagtacttgtcaagtacctgctggggtacctgttgagactctgtgctggattaggacacttgttttcctgcccaccgggagctcaatgtagttagtgaatgacacacttaaagaggtatgtggtatatgccagatgtaaatggccaaagacagcttgggcagagtcatatggataaatgctttctacaagggttgttacactaatgctagacattcaggccctctggcgtctactccagctccagtaccttctcccttccaacagtaataactgatatttgagtgttcactgtgagggcagcactttagagctgttaactaaggttctccttatgatgaccccatgaggggagctctgttagtacctctgtatttaagatgagggatctgaaggacagacacctacaggcttctacaggcgcattgctggtgagcgatggtgctgggtgtgaacccagctgtctcgctgcagagcttatcttggtaggccctcggggctgcttggctagtttctttttcaaatatagagcaggaaggaggatgattgacattttctttcatgatctcaacatgcaatcacacagtgtccaatcagttttttttttttgttttttgttttttttttgagacagggtctcgctctatcgcccaggctagagtgcagtggtgccatctcagctaactgcaggctccgcctcccgggttcactcctttctcctacctcagcctcccaagtagctgagaccacaggcgcccgccaccatgcccggctaattttttgtatttttagtagagacggggtttcaccgttttagccaggatggtctcaatctcctgacttcgtgatcctccctcctcagctttccaaagtgctgggattacaggtgtaagccactgtgcccggcctgtgtctaaccagtttttacctaaatatggccccctatgcattttactctgacactggctcagctaaaatattcttaatttcagaagaagaagcaacaagacagaactactgtgtttattgaccaatttaggctgtctcagggcacagctctgaggatgggagcacactgagtactttaacgatccacggcaaggtgacagcatcttgggctcagacacaagaattattctcagacagggcttttttcagtgccataaatttaagcagctggaattcttttccatcctattcaacctcctgaagtgaagaattttgccttttattgggaaatctgcatttcattgtatagctagaacactatgtccttggctccctgatcctctagagaaggtgggtctttattttattccaggttctgggtgtcgttaggctcaaataccaaaaagtctctttcagcatgagaagctagagacacagcagtgccctgatcaaagaattcgagcagccagctgtccaccccagtgcaacgcaggccttgtacacagggtgtagggaagaactgcaggtctaggagacagtgatgctggttgctcagcatcatggctccccctacacctctggtctggagccgtgtgccgggcctgccagggcgtgagcactgctctgctgtctgcagaatcaaaggagggtattttaaccagcataacagaaggcatcatcccagtcactgatgtccttcaaaataaccttcttcagaaagtatatacttatgctagtgatgatgccattgctcagaatgtttttggaatttcacttttagaattgtgtttagtttagaatcatgcctttttccttccttctgagggggagttttttttttttctaactgcgtctgaaaatattaaagaatccatcacttaaaaatttatatatgtatctgttttttttgtatctgttacctaaaggggaaattactggcagcaatttgatccccacacgttaccagaaacagataccagtcatttaaactttcgtgaacctcatgggtaatacacgctatctcattgttaatttgtgcttaccactactgaggttggacatgtttccatgtattttggctatttgtgaattgtttgttcttgtccttggctcatttttctattaaacgatttgtcttttactccttgagctatagaagctcttcatatgatagtggtatatggacagttcttttaatatcttgtgttgtgacacagcttcatcttttgaacataaattagatttttggaaatgcatggcttgtgactgattaagtcaggctaaagtgacttcagcaatgttatttcagtacccatgtctggaaggacttaaacttgtcacggacttggagtcagatgtaatcaggaatagacagactgtgttggaggtgtgattaggatgagtaattgactagttgagaagctgatgaaaacttcatgtatacatacctaaaacattttaacttaaaacatataatgttaaacatttagttgccaaactttcaccatgggacccaactgggtttacaaatgggagcctatgttatcttacttgtttgctctatgcctgtaaggcattttctgcacattccagtttgaatctttttagtgtagaatggaatttaggcactttgaaagccattagaatgcagaactcttttagtttttataatttttccctgttttttacagttgtcccatccaaacctaattcaatagtaatttttttaacaattcatttctatcatttaactttcacagaaacagatcttttatattcacatttaatcactttatatactatttaaattatatgtaaatttagtgtttcaatttcaataataaatacaatgggcataaccggttttagggacaagccagctgactcttcgtaagcacacagctctcctggatgaagccagtttggtaggaagagagctgttaatatgagtgaacagatacattttagtgaaaggaggctgctatgttttggacgtccgctccaaaactcatgttgaaactgggtccccagtgtgtcagtgttgagaggtggggcctttggtgggggtgattaggtcatgtgggctctgccttcatgaatggataaatccattcatggattaatggattaataggttaatgaatagattaatccattcacagattaatgtgttaatggattaatggctatcaagggaggagaactggtggtgttataagaagaggaagagagccttgagctagcatggtcagcatactgcactgcctcaggaatcttaagagtccccaccagcaggaaggttcttaccagatgtagcctctcgaccttgtacttctcagcctctgtaattgtaagaaatacatttctttcttactccttagtttctggtattctgttataagcaacagaaaatggactaagaggcctatggctatctcaggctgtctggggacctaagagacaaagggaatgggtgaaaggttagaatcacatttctggagaacctagtcctattttcctttccttagtactttgagacctctcccactctggagacctctcagttctcccaagctgcactccacatttttctgtctatgaaaccatcttcaggtccaaggacaataccacaggatctgggcactattgcaagtgataaacataagcatgacaagcagatagctcccaagagcctctgtagcaggagcagcagcaagaaaactaccaacccttagggcactgaagatggcccagaatccaataccagcgggtacccaaaagtcctttgtccttcggtttacattatgcccgtggctgagagtcatcaggccataggccccaagtgcaagtgggagggttgaagtgcaagggaaaattaatatatacaggccagggtgacaggcccagtgtaggctattaggctggatttgccccaggattgaaaacttagttagggccatagcccatgacacacaattttttttttcttttttctttctttctttattattattatactttaagttttagggtacatgtgtacaatgtgcaggttagttacatatgtatacatgtgccatgctggtgcactgcacccactaactcgtcatctagcattaggtatatctcccaatgctatccctcccccctcccccgaccccacaacagtccccagagtgtgatgttccccttcctgtgtccatgtgttctcattgttcaattcccacctatgagtgagaatatgcggtgtttggttttttgttcttacgatagtttactgagaatgatgatttccaatttcatccatgtccctgcaaaggacatgaactcattattttttatggctgcatagtattccatggtgtatatgtgccacattttcttaatccagtctatcattgttggacatttgggttggttccaagtctttgctattgtgaatagagccgcaataaacatacgtgtgcatgtgtctttatagcagcatgatttatagtcctttgggtatatacccagtaatgggatgactgggtcaaatggtatttctagttctagatccttgaggaatcgccacactgacttccacaatggttgaactagtttacagtcccaccaacagcgtaaaagtgttcctatttctccacatcctctccagcacctgttgtttcctgactttttaatgatcgccattctaactggtgtgagatggtatctcattgtggttttgatttgcatttctctgatggccagtgatggtgagcattttctcatgtgttttttggctgcataaatgtcttcttttgagaaatgtctgttcatgtccttcgcccactttttgatggggttgtttgtttttttcttgtaaatttgtttgagttcattgtagattctggatattagccctttgtcagatgagtaggttgcgaaaattttatcccattttgtaggttgcttgttcactctgatggtagtttcttttgctgtgcagaaactctttagtttaattagatcctatttgtcaattttgcacaatttttttttataccaaagatcaggtgtcctcagtttgcaatatggaaacaatttgggtttgggagtcatatgtgaattcaagtccagcctgtgtaacactttgagaaatcactgaacttctctgagcctgtttcctatattgaaaaatgaagataacattgccctggtttgtatgagtagctgatgtgaagattaggaacgtatataaaatgcactgtaatacataaagaaggtccccattaaataaaggctgttattattaagaggtactcaataaatatttgaatggataatatagttaaatggaaaactggctgtgttagggttgacttggcaaaagcaaaaccaaaaagaagcacacatgtgaaataacccctgttgttaggtggttagcattgagatttatgtgcctcattcaacctggtaccctggtgagaccaattctgggcagttcccagtgtatgcacaaacgagagggttgtagtggtgtgttacagaggaaaatgttccaattgggaaccaactttctccttccacactcacaggcaacaaagcgttcctttccaggtaaagaggaagaaaaactactgaagtgtcatagattctccatttgttgattccaaactaggtgttgtccctttatatttccagtaactgagtaaggataacatcacaaacactggggactcaggtgcccaggccccagtgtaccaagttctgttctggaaagaatagacttgcagttttgagatataaacaaattgcagtattcactgtttcctctttcatctcactctttctacctgaaatgtttacactcgaatgagtggaaaagattatattagtctttaaaattcctgacaaagtcctctgctctaggtggcttgatcagtgaaagctttggtgtaaaagcagaaggtcccaaatctctagggcaggtagtggtggcaaaaagcaggatcggggtctatttgctttggttaccatgcttgtcttttggagtgagaggctttggcaaagtgatgatgcttctggggcaccagttaggaatggttggcattcacagatgatctccttctcctttttaaaaattttaattttgtttttatttttttaatttcttgtatttatttttttaaggacagggtctcactctatcaccaaggctagagcagagtagcacaatcataactcactgtagcctccaactcctgggcttaagcaaacctcccacctcaacctcctgagtagctagaactacaggctcatgctccagcctgggtgacaggatgaggcctcatctcttaaaaaaaataataaacaatgagatcaggtatatataaaaacatatataaatgaaaaatatagttattgaaataagatgcaatagatgggatacactggagactggttaccattgaagcatgagttaacagattggaaaatagtacggagaagtttagcctggctgcggcacagaaatataaagatgtcaaaaacatgaaagaacggtttaaaggtatggaaggtaaatgacaggcttcaacattatttaataaaagctacagaaagagatttaaaaagggaatggaagtgaagcaatatttaaataaatgattaataattttccagaattgagtaacaacatgagttctcagaacaaaagtgtctcctaatactttgaaagctaaacaaaagttaacccgcaattagacatagtgaaactgcagaaactgctttttatttctcttcagaaaagagaaaaaagagcaacttaaaaatccaaaataaaaatacaagttatgtataaataaatgacagactgacaggtatttcatcagcaacaagagaggtaagaagacagaggagtaacttttctgtgttgaccctaaaatactatacctagataaactatcccaggagaatgagagcaaaacaaagaccaagaatataaatacaaagatgctcactgaaataactattaaaggatatattttgagtgtttgtttctttttaattcccatttctattttagattcagtgggtacacgtgcaaattacaagaatatattgtgagatgctaaggtttgggcttctattgatcccatcacccacagataggaaacactgtatccaataggaggtttttcagcccttgcccctccccctccttttggagtcaccagtgtctattgttcccataaaggatatgttttggaaagaaaaaattaaacagtgagaaaatatgtacaatgtaagaggcaatggtaaacatagaaattgataaaatatatttatatttatttgttagctatgcaaaaaattcataagtgtgtatggtttgaaaaacatgattaaaatgaagactaggcaacaatagcaagatggtgcagattttttgggggaaaatgttaaagccatattcagagtcaggaagataataattatagattttttaagaaaaaactatagtcatcaattgtacccagagggttaggctacattactaaactcagtggcccaaaataaacattatcttatttagcttccaattctttgggttggttgggcaatttttaaatctgggccagctcagcagatcttgattggactctatcatgcctctatggtcagccggcgactagatgatctaggatagcctcactcacatgtctggaagttgactgtctgatccttggatgtcttagttctcttccaaattgcttctcatcttccagcaggctaccttggggtattcacatggtagacccaggtttccaaatgcagcaagagagaagcatttaactgtccaaaaactttttaagcctctgcttatgttatatgtgctaatgtcctgttagtcaaagcatgtcacattgccaagcctggattcaatggggagagaaatagactccacatcttgacagaagtaaaataatttatgggtgtttttggaatctatcagagtctgctctttggcctcatttctcatgcatgcaaaatatgctcatccttatcctaagctctctgtcttatttatagcatcaggttggaagtctatgatctcatgattttatcacattcagatatgaaagagggtcctcagctgtagctccttgggtacggcagctcttgatccagaatttaaaatgacaagtcacctgctccctacacctccatcatatagtggtgagacgggcaggataactggaatagacatttctcttcaaaaaggagaaaaacaaaaggcacatagcagttactggtctgtaacaaatcaaaattcccctggggcaaatgttgccaggtcatctaatctaggaccattgcttctgctctctggggtgtcttcccagtttgttgttctccaaggctcttgactccattctctagtatcttggttctcccccttaaaaagcctttccttttccataagaaatagtgcagctgagtccctctctcatctgtctttctttccatagttgagggcccagagacctctttgtggcttaatcaattttagtcccttccagtccaagctgatggtgttttgttgggatgattttctttaaaatattgtgggctttctatgtaataggatatagcccaactcattgtataaaaactacacccacaatttttttttttctctctagagttattcggtgacttgggattaggcttctgtcaggcccttaagattcttaggagcttttttgacaagataaggtgtgctaggcactttcttaaatccttcagaggccttaacaaatggtcatacaacccaactcttaatttgctcttttaaggcctccttttactctgagaatattttactcaaaggttgtcaaatatggggagactggagacgaggtacagttttattttccaacaccgcaaatcctggaccttctatattccatctaaattctggttgcaaactgaacatttccttctttagctcacctttgtcttgccatactttagcatatgcagttaagagctcctaaatgacactttcgaaattctgtctggagatctacttagctgcaactaggagttcactagggtcttttctttttgaaaatctcaggagctggttttttgaaaagatcagcaaaattgatagaccgctagcgagactaataaagaagaaaagagagaagaatcaaatagacacaataaaaaatgataaaggggatatcaccaccgatcccacagaaatacaaactatcatcagagaatactataaacacctctacacaaataaactagaaaatctagaagaaatggataaattcctggacacatacacccttccaagactaaaccaggcagaagttgaatccctgaatagaccaataacaggctctgaaattgaggcaataattaatagcctaccaaccaaaaaaagtccaggaccagacggattcacagccgaattctaccagaggtacaaggaggagctggtaccattccaatcaatagaaaaagagggaatcctccctaactcattttatgaggccagcatcatcctgataccaaagcctggcagagacacaacaaaaaagagaattttagaccactatccttgatgaacattgatgtaaaaatcctcaataaaatactggcaaactgaatccagcagcacatcaaaaagcttatccaccatgatcaagtgggcttcatccctgagatgcaaggctggttcaacatacgcaaatcaataaacgtaatccagcctattaacagaaccaaagacaaaaaccacatgattatctcaatagatgcagaaaaggcctttgacaaaattctacagcccttcatgctaaaaactctcagtaatttaggtattgattggatgtatctcaaaataataagagctatttatgacaaacccacagccaatatcatactgaatgggcaaaaactggaagcattccttttgaaaactggcacaagacagggatgccctctctcaccactcctattcaagatagtgttggaagttctggccagggcaatcaggcaggagaaagaaataaagggtattcaattaggaaaagaggaagtcaaattgtccctgtttgcagatgacatgattgtatatgtagaaaaccccatcgtctcagcccaaaatctccttaagctgataagcaactttagcaaagtcttaggatacaaaatcaatgtgcaaaaatcacaagcattcttatacagcaataacagacaaacagagaggcaaatcatcagtgaactcccattcacaattgcttcaaagagaataaaatacctaggaatccaacttacaggggatgtgaaggacctcttcaaggagaactacaaaccactgctcaacgaaataaaagaggacacaaacaaatggaaggaccttccatgcttatgggtaggaagaatcaatatcatgaaactggccatactgcccaaggtaatttatagattcaggccatccccatcaagctaccaaggactttcttcacagaattggaaaaaactactttaaagttcatatggaaccaaaaaagagcccacattgccaagacaatcctaagccaaaagaacaaagctggaggcatcacgctacctgacttcaaactgtactacaaggcgacagtaaccaaaacagcatggtactggtaccaaaacagagatatagaccaatggaacaaaacagagccctcagaaataataccacacgtctacaaccatctgatctttgtcaaaactgacaaaaaccagaaatggggaaagtattccctatgcaataaatggttttgggaaaactggctagccgtatgtagaaagctgaaactggatcccctccttacaccttatacaaaaattaattcaagatggattaaagacttaaatgttagacctaaaaccataaaaaccctagaagaaaacctaggcaataccattcaggacataggcctgggtaaggacttcatgtctaaaacaccaaaagcagtggcaacaaaagccaaaattgacaaatgggatctaattaaactaaagagcttcttcacagcaaaagaaactaccatcagagtgaacaggcaatctacagaatgggagaaaatttttgcaatttactcatctgacaaagggctaatatccagaatctacaaagaactcaaacaaatttacaagaaaaaaacaaacaaccccatcaaaaagtgggcaaaggatatgaacagacacttctcaaaagaagacatttatgcagccaaaagacaaatgaaaaaatgctcatcatcactggccatcagagaaatgcaaatcaaaaccgcaatgagataccatctcacaccagttagaatggcgatcattaaaaagtcaagaaacaacaggtgctagagaggatgtggagaaataggaacacttttacactgttggtgggattgtaaactagttcaaccattgtggaagacagtgtggcaattactcaaggatctagaattagaaatactatttcacccagccatcccattactcggtatatacccaaaggatgataaatcatgctgctataaagacacatgcacacatatgtttactgcaacactattcacaatagcaaagacttggaaccaacccaaatgtccaacaatgatagactggattaagaaaatgtggcacatatacaccatggaatactatgcagccataaaaaaggatgagtttatgtcctttgtagggacatggatgaagcgggaaaccatccttctcagcaaactatcgcaaggacaaaaaaccaaacaccgcatattctcgctcataggtgggaattgaacaatgagaacacttggacacaggaaggggaacatcacacactgggccctgttgtagggtgtggggaggggagagggatagcattaggagatatacctaatgtaaatgatgagttaatgggtgcagcacaccaacagggcacatgtatacatatgtaacgaacctgcacgttgtgcacatgtaccctagaacttaaagtataataaaaaaaaatgaataaatgtactcagaaaaaaaaagaaaatctcttaagttactgcaagctttagtttcaccagttgttctgtctcaacccaacacgagccatcattttgccagcctgctatagcagtttcttctccatttctccggcaaactgttttcttactgcttttctcaccactagaaaagccattatttcaaagccagtaccacatgttataatttttcttatggcaccaccccacatttgaaagcaactgctgtatcagttagcttttactatataataaaccaccccaaaatttagagacttaaaccatagctatttttatttatatcacaattctttgggttggctaggtagtatttctgatctggaccagcacaactgatctcttaactacatgcaactaaagctattctttgaggaaaatttatggccttaaatgcatttatgaaacatttaacatatgaaaaataagttgaggtcaggcatggtggatcatagctataatccaagcactttaggaggccaaggtgtggatcacttgagctcagaaatttgagaccagcctgagcaacatggcgacaccctgcctccacaaaaaatacaaaaattatccgggtgtagtgacgcgggcctgtagtcccagctactcagtaggctgaggtgggaggatatcttgagtctgggaggctgaggctacagtgtgctgtgatcatgccactgaactccaggttgggcaacagagcgagaccccatctgccctcaattcctaccaaaaagaaaaggataacatgttgaataggtattactataaattttatttggctatatttaaaagataatctaaatgaccatggctttaatgacctaggggtttaacatttgccatataacaagaagtttcgaggtagtccaaggcaaatatggattctccattatgccatcagggtcctgggctcttttaacatccagtcatctaaacataattttcatactcatgcttgctgcctcatggttgcaaaatggctgctttacttccagtttagcattcacattccaagcatgatggagaaaggacaggttttgaaaaaggcatgtgccaagtgagttggctacctttaattagagagctttcttggaagccctatgtaataactttcacttatatgtcattggttagaactgtgtcatttggcagttcctagctgcaagggagccagggaagtatagtgtttttttttattttagcatggtgtattgccttcccaaaccaaataagggtatgttagtacggaacaagggagaatattataaatattgtgtaagcaattattgttgtctactatatatatcctactcaagaagctagaaaaaaaatcctaaagaaacctttggaaaagtagaaggaaggaaacaaaggaagacaaatgaaatagaatgtcatttggaggattaaaaaagtgatatagataaaaccctagtaaggctttttttttttcaaaataagacccacaaataatattttgaatgaaatggaaatataactcctgatatgaaattgataataaacatcaaaaacctatactctgaaaatttttatgttaaaatttggattaggaggacacatgggtaactttctgggcaaatataatttgccataactacttcaaaagatatagaaaactgcagtaaaataacaattataaagaatttaaactgatagttaagagacttcttctcccaaaaatataaggcttaaatggttttttgcatgtagaactccaagaagtaaataatcctaatattgtgcaaactgtctaagaggatagaaactggggaaaagctgtctttttaaaataatgatagtataacttaaatatccaaataagacaagaagaacacaagaaaggaaaattgtgggccagttttatttataaatataaatgcttatgaaatatttacaaatctatttcaaatatttacattctgattaagtagagtttgtgaaaggaatagaaggatgattcaacattagaaaatatattaatgtcataaagaatattaacagattaataatgcctataatctattacatacagaaaaaacattagtcagaatttagcactcattcacaattgaggcaaacttctcagaaaactaagaatagaagagaacttccttaacttggtaaagaacatctatcaaaatagtacagcaaaaaacaatccttaacaatacacagtaacatcaggctcgctttcaataaagtcataaaaaagacaagaatgccctttattgctatattcagcattgtacaggaggttctagccaatgcaataggacaagaaaaatgtgaatattgaagataaagattaaaatgttcttacttgcataccaataagattttcttgggatttttaagtggaagatacagtcatccctcactatccatgggagattggttccaggacctcccttgggtgtcaaaatctgtggatgctcaagtcccttatataaaatggtatagtatttgcatatagtctacatgtatcctgctgtatactgtaaatcatctttagattatatgtaatacccaatactatgtaaaggctatgtaaatagttgttatactgtattttttatttgtattatttttattgttgtgttgttatttttattagatttttaaaaaatatattttggatttgcagttggttgaagccgtgggtgcagaacccatggatatagagaaccaactgtatactgtaagaattccaagttccataaatacagtatcaacatattaaagtactatttaccaggaataaccaattagaaaaattaatagataaaggatcccattttcagcagtaacaaaagccataatatacccaggagtacacctaaccaaaaagtacacaagaatatttatgaagaaaattacagttgttgaaaggaaaaaaaaaagagatccttaataaatggagaaaagggctatattgataaactggaagattcattataaaggtgccagttctccacaaattaattcataagttaaatgtacttcttagtatggatgagcatatggaatgacagtctcctacgctgctggaaggacggtactacagctttaggaaacaatttggttataccctttacacccaggaatttcggtcctagatggagaatctttcttgtgtacctgagtagacgtttaatattaaagtgttcattgcagcaaaaaatgggaaacagtccaaatttccaccagtaggaaaatgaatgaaatattatgcatactatatatagcagtaaaagaactatagttatatttcttaagagatcaatctcaaaaacaacattgaatgaaagaagcaagttacaggaggatatgaaaagaatagtgtttatatgcgttttaaagcctggaaaacaacactatatatacagtgtttgtgcttatactgtctttctgtgcattcacacaaacatgtctgggaatgataaaacaatgagtttataatggttcttacgggaggaacagacatggaaatgggaagaaagggttcccaaagagacacaaatgtatctgatgttcttttaatcaagaatccgttttgtcgctatgatagaaatctttcaccattaaaaagtgctttatcctaaatgcaatgaggtatcttggattagatcctggaacataaaaataacatcagttaaaaaactggtgaaatccaaataaagtctggtttcttagttttgaaaaatgtaccatggtgatgtaatagattaacattaggggaaacagagtgaagagtaccagggactctgtatcatgtctgaaatttttctaagaatataatgttattcccaaataaaacatttattttaaacagtggggaggtggtggaattttttaatggcttgaattagctgggcatagaagtgtgtagctgtagtcctagctatttgggaggctgagatgggtggattgcttgagtccaggaatctgagcctgcagttagctatgattgccattgtactccagcctgcgctacagagcaagaccctgtctctaaaaaataaaaaaatatagctgggcatggtggtgtgtacttgtagtcctggctacttgggaggctacggcagatggattgcttgagcccaggagtttgaggctgcagtgagctgtgactgcaccactgcactccaacctgagcaacagagtgagaccttgtctcaaaaaaacaaaacaaaacaaaacgaaaacccaaaaggtgctcatgtctatttccccagcattgtcaactttgaactctgtccctgaggtggatggactcctgacatgtccttgcggtaaatatttcctgggtataaatgatgcttctagtctttgtgtcctgcatgtctcatctgccctgttttaggacactcctagagggtaccagtctctctgcaaagtcttctttattccaatttcatgggtcatttggtactcacctaagacccagagatcttagagttggaatggaccctaacagagtgccctgtgcagcccctttccacagggaggtcagtcctctggaggataggctgaggaactcagtgagcaaaaaggactagaacccagaagtttgcttcctagaattatctttgctgtcacctcattgtctcttacaataaaggcaaaagagactgaataccctctcttatttgtttgtttgctttgaaaactagtggagaggtcaggcactgtggctcatgcctgcagtgccagctactgaggtggctgaggcaggaggattgcttgaggccaggagttcaaggctacagtgcactatgattgtacctgtgaatagccactgcatgctagcttgggcaacatagcaagatcctgtctttaaaaaaaaaaaaaaaaaaaaaaaaacaactgaggagaagagttatatattacccagaaatggtgacacacactggagctggagttatcaaggtgaggttggtgcatctttttttctctgtgcttacagaccttcctaagattagacactgtctgcttctgagggaagagtgggctgggtgcagacagaactaagagttgtagaatgtatgcctgcccctccgtctttatcacaacccgatggagtggtcaattgctcctgtcttaagatgagttaacaggcttagaaaggttaagtgacttccctaaggtaataaaactaataagaggtaggcctatattttaggattctaagaactcatgactaaggaagacccctctgaaggcagggaggatgtattccccagagccaacttttactcttgaaagagctgtggctgggaatgatgtggaacctgagccaagacagagcagctagcctaggacaggttgaggacagatccaggtggtgaggatcaggcctgccagggctacatgccaccatggattcctccctctggaaaagaaagttatacaagttggcttcctgctcctcctacccctcattcctctgttccatcctagcttgggggcccatgtccactagccttcctgggaggcctcccccaaaccaaggtccttgctttgtctctgtttaataggtatgggagaggcttatgtgactaaagaggacacctcagagcttggtcgagataggtgtgtgagagtaaactcaatcattatgtgaatgtggttgttggctgaacacagagcataaacctagaagatttgtgggagcaaggagggaaaatgccttttaagagaggtctccaaggagaatatgagattagttgaggttcagtgagttcctttgttgctgactcaagaagcatatttgaagggataagccctctcacttagagcagaagcatcccagccttgttgccatagtgacagtgctcaaacagaggcttaaaaaacagaaaacaccatgtcagaaggattcctttggagctatgatgccccagtagaggtcccagctattgtgtgctatggaggagaggggcagggaatttgaatagttccccttccttcctgtttcttgctgtggggcttttgttttggtctttctctctggactgatacggcctttggaaagggatgtgtctctgcagaaggaaccagtcttcttttaaacctgtgtcagaagttggaggcatctctctttttcaggcccttttcttggttatgctgcctgttaacttgccattctggaatgtagcagagttttctgtaaagccagccaccttacctttattcctattagaacatgaatctgtttgaagcaagctacatatatagtctccttgtcctgctccctagcttggatgctcttagacctggatgttcattcttatctcatagaggaaggatgaaagggcccttacaaccagacagacctgtgagatgtggtcactagtcacttggcttatctggcctctttaaactgtgccccaatttgcaaggacatattaaaatatatgattatttctcctaatctgtctgatttcattgtttccagtatttttgacatctggtcttcggcatctttgctttgacaacatggtttagacttcagtttgctttgacccatggactgctgagacttgagctattgaattactgatacgggagttgtgaggggtgtgttgagtctgttactccttctggttctaggtccctgcctgataagctgtattccacactatccgaagatcataccttaagcctcagcaagccctctgtcttaaatatcagagtgtgtgggttctgtaccttgtcagatccgacatggtgtccgtcccagcagcacattgggagctagccaaatctggattagacatagtcttgccttagggcacttgcagtctagtgatagaagtgacgctagaaatgtaagcacctcaaaggagagatctttgtctattttgctttgttcattaatgtatcccctatgcttagaacactgactggtatgtaagtatttaatacaaatgtgttgcataaatggacacaatgtctatgaacaatgtcaaaagagaagtacaaatgaataaggcagtttcagagagataagatattggcagaggaaatgaacagacaagttgatcttgttttttgttattgactatatgattctttggaatttgttgagacttgcattatagccttttgcagtttaatttttgaaaatattttctatgtgtttgaaaagagtaatgcatattttgtaattatcaggcatagggttctatatatgtctattagattaagcttttttgcccatggtgacaaatttgggagttttcacacaaataattgtgagattggattaaattgagcagaattggcctgattctgagctgtgatattggagatagttactagacccccatttctaaaactgatgatgccaggggtattctctacctctttatctcacttctgttattattatatagtgattctctttctgattaattatattaaagtcttttgtctgatattaatttacttattccaactcttttatggttagtttttgcctaacttattttttcatttattattttcaatgcctttgtgttttctaggttcatcttatgaatagtatataggtggaatatatagctacagatatagatagatattgtatataatattgtataataatattttatctgtcttttaatgggtgaatttggtccatttatatttattgtgatttctgataaagttagagttggagagacatgagtatacctggatggatgaattgctgatggccatgatgggagataatctaccacaacagtataccagaagatacctaataaatgttagttctcttttttaacccctgtctctagtctcttcctagtggatatttggatgatttaagtagattttttctgattagctccttgggtacaaatgttatatcttcctgacactctcagactctctaaaccctagcattctgaccttgtaggtggtgtataaaagaactggattgattgtagggggttaaagagggagtgggtggaaaggaaattgtggcaggagatgttgatgactcattgaaaacatatgagtggaaagaaaggctagaaatatgatggtagctagaaaagggagtaggtctcattgttggtatttttaagagaggatgtctgaagacggaaaaaaaggaactgacagaaaatgagtggttgaaggtattaatgaggcaaggactaagctatcacttatcagcttctttagagtgagaagcagggagaaagggatatacagaaaaatatttttacaaggtattccatagaaatatacatctctactaaattattagtgtaaactatgtaaagataggcaatatgacttttaaaatatagattaatctcatatttccttaccaagctcttaataaacattagttaggccaactggattttctgtctctactattttatagcactaggaagaacttttaattcatcaagtctatactcccatctaagataggagacctttcatagcatccttcacagatagttgtccaggaccttttgaacacttgtggttttaagaatctaccacctgaaatatgaagctgctgcctttgtccagaggtccggtagtaagaagctcctcttttattcaatagaaatctgcctatatgtaacaagctctttctggaacagcatatcatgaatataatttcattatatgtttgaagtctccaccatgtatctgtttcttcgtactccatcttctaacattacctgagacctgtctcataagaggacttctggatccccaagaaacttttgcctttttaaaacaaggaattccagttttttgcattcagactaaagcagttgcccagaaccatgaatgaaaacggaattttgtctgatttttaaatatctaaataaaatgattatgtagtttttttctttgtcactaagttgatactgtaaattacactgattttcagttgttgaaccagccttacattttcaggataaaccacacagaataataatatatttttttcaaaatatattgctgaatttgatttgccattattttgttgaggatttttgtgtttatatttatgaagaatattgttccatggttttttttataatgtctttatcttattttcatatcaagtaatgttgctctcataaaatttctttaattgaggttctctatttcttcttgtgggaattttggtagtttgtgtctttcagtgaatttttgtattttatctaagttgtcaagtttttatattatgacatagatttgtttatatatatatagagagagagacttgttctatatatatggattcatatatatatatatatatatataatgtctgtaggatttgtagtgatgttctctattttattcctgagatttatttttgtaccatctttctttttttcctgatcagcctgcctacaggcttaccaattttattgatctttccaaaaaccaaacttttggcttcattgattttcttttcattgttactgatttctgcttttatctttattatttccttctttctgagaaatttggttttaatttgttctttttctagtttatcctaaagtggaagcttagatcactgagttaatactttccttctttactaatataagcacttaatgctacacattttcttctgaccttttcctgcatccccccaaatttgacatattgtgcctttttatgtccattccatttgaaatattttctaatattcattgtgacttattttttgaactgtgagttatttggaaatgtgttgtttaatctgcaagcattttaggaatttgttagataccttcctgttactaagttttagtttaatttcataacgatcagagaatatttctatgtggtctcacttcttttaatttgattcaggtttgtttagtagcccagaatatggtctatcttgataaatctttcatatgcatttgaaaacaatgtatattttgcatttgttgggtcaagtgtcaattcagtcaagttggttgatagtggtgttcacctttctaaattcttacttattttctgtgtacttgttttatcaattactgagagaggagtgttgaaatctctaactacaattgcggattttcctagttctcctttcaggcctaagactttttggataatgtattttggaaccctgtgttagatgtgtacacatttaggagtgttacatttccttagtgaattgatccttttatcattatgaaattactctctttatccctggtaatattccttttcctgaaatctgctttgtttgatattaatatagccatttcagttttcttttgattagtgcttacatttatatcttttcccattgttttatttttaacccatttctgtctttatattcaaggtgagctttttttgtggatagcatataactgggtcttacttttttatacagtctaacaatctttaattcatgtagttaggccatttataattaatgcaattattgatatgattggattaaaactaccataaatattttttgtttcatctttttcttgtcccttttatcctctttttctgcttgcctttgtatttattgagatttgtttgtttgttttgttttgtttaaggtggagtctcgctctgttgcccaggctggagtgcagtggcacagtcttgctcactgccacctccacctcccaagttcaggcaattctcctgcctcagcctcccaagtagctgggactacaggcacgtgccgccatgcctgactaatttttgtatttttagtagagatggggtttcaccatgttggccaggctggtctcaaactcctgacctcagttgatctgcctgcctcagcctcccaaagtgctgggattacagacatgagccaccacatccagctgagaatttttattatttcattttatctccactattggcttatcattatacttctttttaaaaatgtagtgtgtgctctagtgtttacaacatatatctttcatcacagtctaccttccaattatatcacttcacgtatggtataaaaaccttagaatattatactccaagttctttcttctcaactcttgtgctgttgttgttatgcatttttcttttacataccctataaacccatagtacattactactatttttactttaaaaagtcaatcatcttttagagcaattaaacattttaaaaaatgtcttatatatttaccttcattttaaccatttctggagatcttagtttatttgtttggattcaaattctgtctgacatatcccttctgcctgaagaagtttctttctagttctcattatgcaagtttgttaataattaattctctcagcttttcatttagtttccaaagtctgtatttttcttttatttttgagaaatattttcaggagtatggaattccagattgacagggttctttctttcagtacctttaagatttcctttgttgttttctgggtttgcactttttcagatgagaagtatgctttcatgtattccctcaccctgtctgcctttaagattgtttctttccctttgattttcagccacttgaagattatatgcctaggtgtgtttggttgtttttgtttgtatttatactgcttgaagtactctgagatttttggatttgtggtttgatgtccttcattatttttggaaaatgcttaattattatgtaagtatttcttctgactcatcctctatttcttctctttctgagattccaattatatgcatattagaccatttgatattattccatagcttttagattctttgttttctttttttccccctactcttttatttctttgtgttttagtttggataatttctgttgactcatcttcaaaatcactgattttgtttccccagttgtgttgagtgtgcttgtgagcctgttgaagccatccttaatccatagaaacagaaagtagactattggttgcctagggttgggaaaccttagggtaggatatggggagtgactgtgaataggtatggcatttcttttacaggtgatgcaagtgcactaaattcattgaggtgatcagtgcacaactctttgactatacttaaaaagcattgatttgaagactttaaattgtatggtatatgaattatatctcaatagagcatatatatataaaatatgtattatataattatatattatatgtaatatatataatatataattatatataatatgtatatataatatatacaacttcatcttttatgttcaaaggctacattgataaaactctggttagaatcaggaaggagcaagacatcttactgatggtgctgaagggtgtatagaacaaaaataattctgaaggaaatgttacaggctgggcacagtggctcatacctgtaatcccagcactttgggaggccaagggggtggatcacctgaggtcaggagtttgagaccagcctgaccaacatggtaaaaccctgtgtctactaaaagtgcaaaattagccaggcatggtggtgcatgcctgtaacccagctactcaggaggctgaggcaggagaattgcttgaacccaggaggtggaggttgcagtgagctgcaccattgcactccagcctgggcaacaagagcgaaactccgtctcaaaaaaataaaaagaaatgttactataactgaagctggtggaaggataggaattattattttgtcccgtgttacatacttgattctaagtgttggaaaatgactctattaagtaggaagtgttcttaattagtccatgtctttatgtttccatgtgttttgtaatttatagttattagtcttataaattttaaaagttccaagtcatcctgatgctttgagttctacctagtggtcaaactcctctctactatgtgtccttggacgcctgacccaccaggtactagtgttatctggtagtgatactgttgaattttaatgacctggctgagagtttccatattacctccttctgttataaaacaaaatacaagtaggcctgtggagagttctccaaactgagaattttagtacagctttcctacaggaggttcactaagaaatccacaaacatcatgtggtagcctaccaggtgctccttagctgcaggaaagatacccatgccctggagtgttgtatgtttccagacactcagaacacttctaagtgtttcttgatgtttctggtatggcataacccccaaaatatattaagcaaaataaagcaaggtgtagaagagtgtgtataatatgttattatttgtatttaagaaaaagtgggtataaaaatatacatgtattttcaaaacatatctctagaagatgtgattacatggctgattctggaagagaagttggtgctggatacctaggagctgggtacctagaagcaggtgtgggtgaaagacatttcactatatacttttgtatcttttcagttgaaggggcaagggaaaacttctcctttgccctctgaaggttcactaaacatcaaatgacaaaaggtggattaatagtagaagaggcacataaatttatttgatcatagttttccatgacatgggagccttcgaatgaagacccaaagatacaaaggaaacgttcatttttatgcttaggttcaataaactgtggacaactgtgtaaaaatatgattgggcaaaaagggtataatctaatgctaatagactgagtagggaaactcagcaaggcctttctgtttgtattcctcctctctgtgcagcatttcttccttctgatggggcaagactctctctggaatggggctcttatgacctacagtcaaacaaggtaggtcagataatttctttatggccagtttttacacagaaaggccagggggagaagttagaataatatttttaggtttcctggctggctttaaggaaaagggattctggtttctataacctgccttggggaagagggattctggtgtccttggaggagaatgagtggccagagacaggagggaagaagaaggtcagagagaaacttttgcttctgaggctgcttctgaagtcttcattttggggtattgttttctgagcccccaaacaatttcaaaccatataactgtatttgctattcaaacaggaatacaagttaaattaaaacaaaatcttcctaggatggttaattaaacttgaggctcagattggcccttgataatttactctttgtccttatttctcatccctggggtcttctgtcttcaggtcttccacccctgatcagttgcctgccacagacatattcaaatattcccctccgtctctgagcctaatagaaactctacacagggatgaagcaggatttctaaaatctctcttgtgactgattgccatattgaacctcaggctttctagaccagtggttctcaaccttgagcctgcatcagagtcacctggaggacttgtcaatacgcaggtttctcagccccacacccagagtttctgattcagcaggtctggggtaggacccaataatctgcatttctaacaagttcccaggtgatgctaattagggaccacactttgagaaacactgctctatcctaaaatagtttctcctatgatggattgatgtgtagtttttgtgttccagttgtgtcttcatttagacatataaagaaataaaaggagagctatgttcctttccatgggcatgcttatagtgcaccattgcccagctctctgtccagccaacaatacccttcaggctcgttatgcctcataagacaatatgcattttaccaccagcagagctgacacatcagaaacctggcatcctccttcatctctacttcccggagcagacattcttgtggtcactgccatcaactccctgtaaagacttaattggtattttagagcaggcactagaagagtcatgctaattactcatttcccttccagtgtttctctccagtggtgctattagcattttaggcaagacaaaatgctttataatgctctttataatgagcattctatttaatgtaggacattcagctcctttcccttgttctcaagtcgttgtgacagtcaataatcccactgcgcatcccaatgctccctcaatccccctaacccttaaccccgtgcaacctgcctgcaccacctttacccacctgcacccccacctccaggatgggtgatgagggcaactcaactttccactgagaaccaccaagacctttattaaattacctgtccagacctttgctttagatccctgcaaaaatcccaagacatattttattattttcctttttatcaaatgttgatattaaaaagttaccaaactctgaggctgggcgcagtagctcacgcctgtaatcccagcactttgggaggccgaggcatgtggattgcttgaggtcaggagttcaagaccagcctagccaacatggtgaaaccccatctctactaaaaatacaaaaattagcaggacatggtggcgtgcacctgtagtcccaactacttgggagactgaggcacaagaatcacttgaacatgggaggcagaggttgcagtgagctgagattgcaccactgcacaccccagcctgggcgacagagcaagatctgtctccaagaaacaaaaaacaaacaaacaaacaaacaaaaaacagtaatgaaatgccaaatgtttccttttgaaaaccctattggtagaattgtccattgttcagtggacaattttccagtgttgttcagtcctctctctggagagagaccttttggagattagcactggagggccctgttacctgatgaagtggcttcgtgtcctcatttgacaaggagaattgtgtgacctctcctgtttccttttttgccatgagtgtcagggaactcggggatagatgtaatgcctgatagggttgaaaaattagcttagaaaatcatttcacccatattatcagcttttatatagttttaatttttacataattaacagctttattttttgttttcttgtgagtggcttctaattatttgagaagcaggagagtattaaatgtctgtggtgcatgtgagttgtgaaataatagccagatgtggcctaatcagctgggcaaaagaatggaaatgacagagcacccaggggcctcccgtgtgcatggggcagggtagggaactgaggatagggagagcagcaggtttggaggctcctctggctggtagaaagcagaagggggctgctgagaatgaagggccaggtgtgctcactggaggtggggtcaaggttaaggaactaagaagcaataggtatccctaaaccttcaccagagatggatatacattgaggggggtggcagcagatgtcctgagcttgacctttctcttcaaggtcaagagatgtcctgctgggattgcctggattagcttatgagacatgtggaaaccattccttatagaaacacctgttctgcttgagctctcatttggtcctgtggccaaacagattacagggagcaactgggtgcagacaaggctggcattcctgaaatgaactttctgctgacacttcctgtccaggtggaaaagagcacctggctgtgggactgtaatggggtgggaattccacctcatcctgccccttctttgagagccccgtctctcccgtttccttttcaaagtgtccctcaaagtgtcaggggaagccacaaccctaaactcagggtttccaccctctctctctcctttgtgatttattaagggattgtgtaaggacgttttcagtgtggaagtcccctgctgaaatgctgtcttagtctatctgtgctgctatgacaaaatacctgaggctgggtgatttacaaatagtagaattttttttcctcacagttctggaaaatggaagtccaagatcaagacaccagcagatttggtgtcttgtgagagctgttttctgcttccaagatggtgccaagttgctttgtcctcacttggcagaagacagaagagcaaaaaagggcctcaccagttcgctccagcccctttataaggttgctgatcctattctccagggctctgccctcttgacttaatcacctcctaaaggtcctacctcttaacactgttgcatcagggattaagattcaacataaattttgggagggaacagaaaacattcaaaaacagcaaatgccattgtgagggcttgatttcctttggattttcaaactatccttttcaaattaacacaccatctggatgggtagcttatggagggctctgaaataagttatttgtccctctgaggaaatggaattgctacttactgtaggtatttatttccctcttaagaagtgagattttccctcagaggaaaacaaaagtgtctgaagggaggagaagggggaacttcaggagcctgggccaggctgagtcgggggtcccgtgttccaccttggtgtggtgctgggggaacagagcatatcagcccagccctgggacagtgaaggtaggagagacactcctctagaagcacagtgctttcccagtgtgttggtgtttcttttcctgccctgtcagccctttattcccctggccatgtcaccgaagccagatccctgatagccaggagccagctccctccagaatgccccaacagccacctacctgcactgcctttcacctgcaggaaggcagctcccatggccttcctccctcacccctgccagggcctctccctagaccctgcaatctaccctgagtaccaccgtcatggttctgcgtctgtcctctgtgggggaagaaagtacctcgttctggttctccttgtaactattgttcctgaactctaaacgtataacccccccacacggtaataaaagccacccatcgtcactgttgggatgcttccctatttctacatagcctgtcccagagtgatgtactcctcccagccgctcccacatcccttttgcgtgtctgtctctgatttggctttcctttcctccttcccacccacccaggtggctcccggctgcctctgctgcagttcagagcaacttcaggagcttcccagccgagagcttcaggacgcctttcctgtcccactggcccagttgccacaacaaacaacagagaagacggtggtgagtgaacagagtttacattatgctgttgaccattcctcctcagtccaccctggggaggctgcagagaggggagctgtgtgtctttctaggtgcccagaagagactgctgcccccaaggtgagatggcacctggccagctgcccaagcaggtaagagtgaaggcagtatgctgtagcattgtctgttgattttggcttagctggtcagaattcttgaactggcgaaggtggtggaaatcatcattggaactagccaggaaacaagattaagggcctgcgggttgccctggctgctgctagaaactgttcacactgcacgctgtggtactccatccttccaagctggctgaaaactttctcctcctgctgctccaggatgctgctctgactaactctggttttgatttctcctttgactccatggttccttggcaagcaggcattgttggggatggaacacaggtggaactttgtgttacctggacccataaccatagctagttctgtgggactgagcagctgccagaacactatccataacctggtcacctgcactctgtttggtgagaaatcctgtgtgataataggtgtagagtgagcctgtttaacaaagacagtgccttctttgggcagctgtacaatagtaaatattctaaataatattccaaaatgtgggtgatcgtttgggatttcatatgtgtaatttggggcttagggtgtttccattgctttctgcagctttagcagtgaggaaggtggtttcccgctgctacccttgaccccctccttagggtctaactactacagtacttcaggggtcctcagctaacatcagcctggggtgagggtgtcagttaactctcagtgcagaggaggctggcagggccaaaaccaataccagtgaaacaaagaaagtgagaaggttggtgggtggtggacctggggaggcatgaattaataacaggaagtgtggtctgtgatttcaaaaaaataatactgataatttcccccatggtgctaaacctgctttgaactatgaccccatcattgacttgagggaatagcttcttagattactttgaaagacatatcgaagtatgtagggcctgctgttttgttaaggaaataaatcccataacattaaaggaatttttttaaaagtgactataaggttggactctaatatggctgataaagggaaaagcagtgtcctgctactgcctgaaagaaaacacagcatatgtggctcagatgggggctttattttaggatttgtgggaggctggaccaaagcgaacactgaacatatgagcaaggcgttctttaaaggaaagccttaaggcttttcacactgtgaagcaccgtaggtagaagatcaaaggatgcacaaaataatgcaagtcccttctattttaaagacacatctgcctggccaaaagtcaggatgaaagtagtgcctctggtactggtgagtgggctatgccagaagccctctttgtttagtcacctactttatgctgtgacgggaacatttgcagtgaggaaaagaagtaaataaaaatgagataaaacttcagttttaaagcctaggggcacatgacaccataggactcacccagtattcctttctttgcatcattggggccatgtgagcaaagctcttgagatacatctggtcagtgcaaaggcagtctagaactcatgcccttctttgtgagtcccttaaagtctgagccaatgggacactcataggtaatacaggactccttagcaagttgtaaacattttttaaatttaatttaattttaaaaaatttacaaataatagttgtgcatattcatggagtacatggtgatgttttgatataattaatatatggtgatcagatctgggcaattagcatatccatcattgcaaacatttatcatttctttatgtttgaaacattcaatatcctcttctacctatttgaaactatataatatattattgttaactatagtcatcctaccatggtatagaacagtagaacttcttcttcttatctagctgtaattttgtatcctttagaaatctgtccctatcccacccttcttcctacccttcccagcctctagtatgctctgttctacttttttacttctttgagatcaatattttttagctttcacatatgaatgagaacacaccatgtctaactttctgttcctggcttatctcacttaatataatgtcctccagttctatccgtgttgccgcaaatggcaggattcattcttttttatggctgaatagtattccattgtgtatctatacaacattttatttatccattcatcttctgttggatacctacattgatcccatttcttggctattgtaaatagtgctgcagtagacatggggatacagacgtctcttcgatgatttccttttttcctttggataaatttccagtagtagaattgctggatcatatggctgttttatttttagttttggaagaacctctatattggttttcatagttgctatactagtttatattcccaccaagagtatatgagtttccttttctcctcatccttgccagcatttgttgtttgtctttttgaaaatagccattctaactgggataagatgatacctcattgtggttttgatttgtatttccctgatgattagtgatgttgggcagttttccatatatttgttggcaatttatatttcttcttttgagaaatgtctgttcatatcatttgcccattttctaatcagattgtttttctgctgttgaattgagttccttgtatattctggatattaatcccctgtcaggtgaatagtttgcaaatattttctcccatcctgtaggttttttcactatttgttttatttgcttcccttgctatgcagaaacattttcatttgatataatactatttgtttatttttgcttctgttccctgtgcttttgaggtcttattcataaaatattttcccagaccaatgttctgaggcattttccttatgttttcttctagtaattttatcatttcaggtcttacatttaggtctttgatccattttgagttgatttttgtataggatgagcggtggggggtctagtcttattcttctgcatttggatatccagttttcccagcaccatctattcaagagagtatccttttcccaaagatgttcttggtacctttgctgaaaatcaattggctgtacctatgtggattaatttctgggttctctatttgttccgttggtctatgtgtctgtttttatgctaataccatgctgtttgggttactacagctttgtagtatattttgaggtctagtagtgtgatacccccagctttgtcatttttggtcgggactgctttggctatttagggcctttcattgttccatacaaagtttaggattttttttctatttatgtgaagaatttcattggtattctttggataatattgtcattttaacaatattaattcttctgatccatgggcataggatgcgtttccacttgtttgtatcctcttcaatctctttcatcagtgttttgtagtttttcttgtagaggtctttcacctccttggttaaatttattcctatttttttttagtagctattgtaaatcggatttgctttcttgatttcttttcagctagtttgttgcttgtgtgtagaaatgctactcatttttgtatattaattttgtatcctgtaactttactaaatttgtttatcagttctaagttttttggtagagtctttatatatatatatatatatatatatatatatatatatatatatatatatatatatggtgtttttcatcttttcatttccagatgtaagaatcccttgagcatttcttgtaaggccagtttagtggtgatgaattcctttactttttgcttgtctgtgaaatattttatttcttcttcatttctgaaggttagctttgctgggtatagtattcttggctgacagagtttttcccttctttctttcaatagtttaaattctattctttcctggcctgtaagattccttttgagaaatctcctgttagtctaatagagattcccttatatgtaacttggtgcttttctcttgatgctttcaaaattctttctttgtctttgacttttgacaatttgattataatgtgccttagtgaggacctgtttgggtttaatctatttggggttctttgagctttctagacctgaatgtccatctctcccctaagacttaggaagttttctgctaatttttattgcattaattgatttccttttagttctttttaaatgatatccatctctttgttgaatttctcattcaaatcttcaattattttcctgatttcatcagattatctcactgattttccttaagattattatttcgaattgtttttctggcatttcatatatttccttatgattggattctgttactggataattactatctttcttgggaggtaacatattttctgatttttttatggttgtgtttctacattgatttctatgcatctggtggaaaagttgcctcttccaattttatgaagtaggctttgtagagaaagacttatatgaatgtgtcttgtgatgtcggttcagtggggtgcatttgcctgggttctaggtggatgcattagtgtagtctctgtgtagtttcttcacctgtaatccacactagtggcatttgtgatttctcagtgacctaggctgaaagagtttgtggtgacagtggtgcagctttgctaggctgggcttgctgggctctttctaaggttggaggatataaatgtaaatgatggattgaccaaatttgggtctagcttgctgggtttgggagcccagggctgttattttggccaggagcatgagcatgcagatgtttggccaacctagtgtgcctgtcaggagtggtctgtggggctgcttttcagactcaggacaggatgcggacagaagtccacttggctggactcaggttgtgtttgctggggactacctacaggtctgtttcttatgcttgtgacacagctgcatggttgcctgcttggctggggggcatgtctgctggggatggcccatggggctctttcttcatctcaggacatgggcttatagctgctcagccagcctggtgatgtgtctgccaggggcagcccatgcagctgcttattaggcccaggatgcaggtgcaagactgctcaactggtgtggtggcatgcctgccagaggtggcccacagggctatatctcaggctgggacgtggacagacagctgctcagccagcctgggagaatatctgctgagggtggtccacagcgttgtttcttaggtttgggacccaggtgcaaagctgctcagctggcataagggcatacctgccaggaatgtcctgtgggtttctcaggcccttttttgggggtgggggtggtacagggccactaggcaggccagggacatgcctgcaaaggggggatgctattatggagctgtttctcaggtcctgagtgtggatgcatagccactttgctggtgcaggggcatatcaactgcttgaaggctcaggggcctctcctatttagaggagggcatgcaaccatttggctggctcaagggtgggttttccccaggcagaactggcagattgttcctctggctggaagtgcaatggcaggggttggtttccctgctgtacaggaccagagtcacagctgatcttgggcccatgcaactggggttgtggctacagccacccacataagcttggtgtaaggaaaatggagctccagtgctggaaggtgcagtacttactggcccccagagcaggatgcaatccagaggtggctgaggtctcaagattgtgccttgctgcagcagcttggctcacaagggatgggagagatgggaagtgcatactttgtgctccgaattcagggcaatgtggctgtgtgaattccagtggctctccaaactgggcccaggacttgtaaggactgtgggattctcctgttgtaaggactgtaggtgtttgcaatgccagtggggaccggtggggatcttctgcttatcttttccttgcaacaagaagtctctcctgactccagacaatcttggcaggggagatagatctgcagaggttgggtggctccatgctgccctcctggacaccacaggtgtatctccatgccctgctactttctaacactctccctaccaacatttcttaatagatgtttcaaaagggcaagtaacctgtagtttcctccataggtattttcagagatgtcagtggaaagtctcttatctgaattctatgactttttttttcttttttttttttttgagacagggtgttgctctgttgcccaggttggagtgcaacagcacaattatagctcactgcagcctcgacctctcaggtttaaacaatcctcctgcctcagcctcctaagtagctgggactataggcacacaccaccatatccagcttttgaattctttgtagagatgggatcttgctgtgttgtcagggctggcctcaaactcctgggctcaagcaatcctcccacctcagcctcttgaagtgctgggattccaggcttgagccaacgaacccagccttatgaattccgtgtttttaatgaagatgatcattctgcttttgatataataactttgaacaatgaattatgatatatatatcaaattatatttacatatgcttcattattatttttctttttttaatgaaagtacatgtattttagagagctctatattgcttgatatataacttgtagttaaatatggggtttgatcatgtttctttaaaaggtgggcattaggaccttgatcaatagtgtaaccatctcttacgttattgtttctatgaaaaattcagtccccttccccagaaaagaatgtaactcccatcaatgtggctaacatgacatgacattctaccaggcatgactttcattcatttaacaagtgctctttgaatgaggagtgaggcaaagtccctgctctcacgtaattttcattctagtggaacaggaagacagtaacatccagcagtgattttaaagtacagtaagagccagatgctgtggctcacacctgtaatcccagcactttgggagaccaaggcggatggatcacctgaggtcaggagttcgagaccagcctggccaacatagtgaaaccctgtctctactcaaaatacaaaaattagctggacatgatggtgtaggcctgtaatcccagctactcaggaggctgaggcaggagaatcacttggacccaggaggcagaggttgcggcgagctgagatcgcgccattgcactccagcctgggggacaagagtgaaactccgtctcaaaaaaaaaaaaaagaaacaataaagtacaataaggagcataaggggatgaagagattgggtagaggggtattttatataggatggtcaagtggtcaagaaaggcccccctgtggaggtgatatgtaagcagaaaacaataaaataaaggagggggtcttgagaagatctggaggaagaaaactattcagggtaggaaaactgtccattgcaaaggccctgagtcaggagtgaacttggtgtggttggaggaacagcaaagcaggccagtgagtgtaagagtgggagggcagagcttaataggagatgagtttggggcagtgagccagagctgggtgatgcagggccgtgtaggccatggtaaggggtttgggttttattctgtgtgtagtgggcagccattggagggtgttaagtggggagcaccgcaatctgactgtgtgagggagctaactgtagggaagtgagagtggaattagggaggcacataggagactgctacagtggtctaaaagcatgacaatggtgccttggatggctggtggcagtggaggtggaggggagtgataagattaaagttagaaccagtcagagctgcttatggattggaagtggagggagaggagtgagggatgaattctgggcctgagcacttgggtggacagtggagccttttgcctggatgggaaatgctgtgagaagagcacatttagctggaggaaatggagaggtcctgtatgtcttgttagataagccagtcgagatctggagtagacagtgagatgtcaaattctggaggtcagtggagagggtgggataagaaatgtgtgtggagatcaccagcttctggatggtgtataaaaccacaggactggatttgatcacctcaggagtgagcatgccagtcatttagagacggggaaaaggaagtaggaagaaaaacaggagagcatggcattccagaaaccaagggaagaaagtctgtcaagaagcaggggtggtgattaactatgttaatgtgttagtgcagccacgaggtgtttaaacccattatcacacaaggaatgatgctctcttggtgatttcctgctttcatatgtgttcgtggacctcatcttcccccattaaactggaacctcattgaagccagggatgatttctttcttctgtttgcacttagagccacttaaagctgtcccttaactgcctcactccaaaagctctgcagtgtgaggttgaggcctgaagtgacgtttcctgaggagctacttttggagttgtgtattgggtgggtgtggggacagtgatgacaaggaagtccaggactagtcccttcctaggcagaagaggctactgatatcccaactctgagtagaagggttgggtggcagaggagaagacagatggaagaagtaggacagatgcacaaatgtgtcagattcttaacttcagaaactgtcagccccacaaacgtggtcatagaacttcaacctgaggaagcagggacactgatgggtcatgatgggctctttgcccactgattgatgcagcagtgggattctttaccatactctgtaaagtacacatgaccccctgctgcagatgaagaaggatggaggagtccctcatggcttcccttgaaggtttcttacacagaactaccagttcaggttcttacaaagactggataatccagatggtacctgtgtctggggagtaattctatgggctgcgctttgggacagcagtggcctcttctcttgaccaggtttcatttctctgtattgatgaggagtacccaggcctgagggtctggccatttttgactagaggcagtatctgtgttggaatagcctgaagaccctgtcttagcctattttatgctgctgtaaaagaatatcacaaaccaggtaatttataaagaatagagacttatttcttacagttctggaggctgggaagtccaagttcaagggctggcttcttgccagggccttcttgctgtgtcatcccacggtggaaggtagaaggacaagagagaataagagagcaagaggagggttggacttttttttaaataagaaacccactcctacaataatgaacccattcctgaaataacatgaatctattaatgagaacaaagccttcattacttaatcacctcttaaaggtcccacctctcaaaaccgttgcagtgggagtcaagtttccaaaacatgaattctgggggacacattcaaaccacagcaaccccctacagggttggacaaactggaagttaatctatataggtaaagggttgggttttctggcaattgggagattgcgatgaggtttggatcttgtcctgtctcttacataaacataatgaaagcagacgacccatagtatcataggaaagcataagagtaatttctggttggggcacttgtgaacactttgacaaaatggaaagccatcttgggggaggcaggaccagcagttgagcccctacaacacaaaggagaccctgggtgcgggatgaaggtggacccctagccctgtaaagtttaagctggtaggaggcctgcagatcaagggttcatcccctggagtttttcttggaacttattactaaatgtttccagataatccctgatcatggggcctgataaaattcattcttactgctaaaactatgttaagataaaagttgtttttattcatttgctatccattaaagccatcacagactaattatttttcaaaagaaagaaaactatgctacagctctgcaagtaacttatgaccagatgttgagatcttgggataccctgccctgcttaaaatatattataagagatctttagacagtaaaatctaaaaataaaacccaaaatataaaaaaagatgaataatagcaaagcatgatagttcaagagttttgttggctttttaattttttatttatttttaaaagaatcattagttataatttcataccagttgctgagacttagatataccaattttgtagtggggagggagggtaattatagaaagcaagagagaaaactttgaaaatcactgttagctcagccgggcgtggtggctcacgcctgtaatcccagcactttgggagaccgaggtgggtggatcacttgaggtcgggagttcgacaccagcctggttaacatggtgaaatcctgtccctactaaatatacaaaaaaaagaatagccaggtgtggtggtgcacactcgtaatcccagctacttggggaactgagacaggagaattgcctgaacctgggaggcagaggttgcagtgagccgagattgcactactgcattccagcctgggcaacagagtcagacttcgtcagaaagaaaagaataaaagagagagagaggaaagaaggaaggaaggaaggaaggagggaaggaaggaaggaaggaaggagggaaggaaggaaggaaggagggaaggaaggaaggaaggaaggaaggaaggaaatcaatcactggtagcttagctgaatagtccatgggtatctgcaagctagactttatcatgcacacaaatcctcgatctaaaaatgagtggcagtggaagtagtggtaggaggcaggagtgaagatcatgtcccattaatttagggtatctgaaaaagacgtggagccatgactgcttctgtatctaccagctttccacttagctgcctgaggtgagtagaaattatattaggcatttccataaccttatccttaactgtgttccctccttttcttagtgcctgaggtgagtctggcagtatctgtacttccctgctcccattcatacaaccatgttcttagatcctggcttgatgtgggttagtcagctgttctaggccagatttctcagatttctgttcttacctgttctgcccaactacaacagctggtgtcctgctggcctttgcctgagtcacaccctcaggtcatgcatccccaccttttacaggcagggttgttagcatgagagccctgctctgtgctctcagtgaaggatgaagggagaggagaagagcaccctaggatgctggtagaactttcagttctcttgccaacaaattgaatgaagttagaagctctccgtaagttttattcagtacagacctggtgtctgatgctacagttaagagactagatttagaaggagggtggtgcacctgttttggtgggaggaatgaatgggatgtaaggagagatgatggtctgtgcatctcagacaaaggaacttaaaaagaggagtcttcaaaagaatgccccctgcaaaaaaaaaaaaaaaaaaaaaaggaggcttagaaatatctcaaatgaacagaaatttgaattacaatccagaagatgaaaatcaacaggaataataagaaaataaggaaacattctttacttaaaaattttaaaaagtcagctaaacgttgctaggatgtgaaggggtagatgacattttaagataaagactatgggaaaggagtttattttgccactatcttttctataggcttttgctaatagctgtgaagggtcttagatttcatatactttcaagttaaggagttaacctgccacagtttcatacctgctggcagaagatgagactcatggggtagagataagggactttatgattcacaacagtaacagtaatcagaacatcatcattttcctgtactggttctttgagctccaacccccacaggttgacaccaagagagccaggtgatacctgcacacacagtggagagaattcctgagcctagggaacttgagagctctgtaatgaacagtaagtgtgcctgcactttgctccatcctgagggaaactctctctttgaaggctgtttgctatgcaaatcttcttgaaaagatagtcgggaacaaaggcagtcagtgcctctgcttgcaagatgtgcaaaactgtgagagacatgaagaatggtctcccaactgttgcatcaataaaaaggaaaggaagctaatgtttatttcatccttgtcatgcaccaagcactgaccaggagacttctcatttcttgcctcatcaaagtttcaaagcagccttgcccagggtggtactgttgttgttttatcggtaaggaagctggtgagtcagggaactggaatatctaggtggaggacttgtgtatgtattatgtacttcttataatgtaagcattgtgctaagaagtagctaaaacttaattagatgcttatcaggtgccaagcacagttctaagagctctccatgaattgttgatttaattcaccacaactaagattatcaggtgctgctgaggaaactaaggcacagtgggtgacagaactgagattcaaatctgcacatttaaccactgtgtggttgcgagttgtgggtttttgtttttgtttttgagagagggtctggctctgtcgctcaggctggagtgcagaggtgccatctctgctcactacaacctctgccttctggactcaagcaatcctcctgcctcagccccttgagtggctgagaccacaggcatgcaccaccattcccagttaatttttgtgtttttttgtagagttgtggtttgccgtgttgtccaggcttgtctcgacctcctgggctcaagtggtcgacttgccttggcctcccaaagtgctgggattacaggttccctgtggttgtgttctttcttcattcctcagagtcatagcaagagggtcatagtcaaactaatgtgtgcccagaggaagtggatgtatttgaaaactgccaagtagaaatagttgaagtgggactgattgtgtttaatctgcagaatgataaaggataagtgatgcctgtcttcaaacatttgtaggcatgtcttatagaagaggagagttcactctgtgtgactgcaggaggcagaattgggtccatttacggggaggcatatcatggctcagcaaaaatcatttcttgaataatacagtgccccctgacatcataagggaatggactacctgtgagagtggtaactcagtggttacctttcaaagatgtgctgtctgggctctgtcaaggtccccacaataaacccctctgctataggagctgggcaatggaagaggatggccctaatgaggttctctagacctttcctaagagagctgaccctgctaacagtgacctgaactccttcccctgccatgccccctgtcccttcttggagcctcaggcctcaggtctgttggacatgcacagagatggtttctgcatgtgtgaggagggtgccttacctcttgagaatccaggaccaccctaaggatctggaggagttagttctgcagctcctcgcactctcaggcctgccctatttttggttccttacccgctatcagcctgtaatcaccagcctcatggctcagctataccctggcaaatctcgttgcacacatgaggcccactgttgcccagtttgggacagaataagattctgtggttctgtgattcactctttccttgtcaagtagcccaagctttaaaaagcaagtgggaacaggtggttgggccagtgctgctctgtgatgaccttgctacggccccctgacaactcccctggtgtagctgtaggcctgggctgagcagatctgatccagatgcaggcccagaggggaaccctgggcaggtagggaaaggaatttggggagatggtaagaaacaggagtggtggcaactggcttcacagtatatgttccactctgctagaaatggcctctgctaggggctaaagactccccagaagtagtcttgtcttaattactctgtggacatctttaaaagaatctcattttcatcaaagggttttaaagagtgatgcttagcccagtgtaaagggcatagtcaagatctgatcctgaaataatatctctgctatcctagatgtcaggagaaactaaaaatatcctcataaccctgaggaattcttggtttattgcacccatctcttttccctctgaacatccttccagaaagtgagagagtgaggaagtgagccaagaagctttaattacccaatctgctgacattattttatctgcgccactgatattaaatctgcacagcattccacttaaatctcagtgctaacagcagcctctacaaacttgggcctttgtccttctgctggctgtggcccatgctctgtttcccaccctactgcaccctccttcagacttcttaaattccgaagctttctgtggcaccggaaatgatctgtctgtggaatgtccatacttcaggaaagtccccgatctgtgtgtgtttattcccaaattctgctccccccaactcagcctggctgtttgtggttgagttctggcacgtgcccatcattacagaaacctggatttggcaggggcattgtgccatatttctattattggcatatttggagaaggaggagaaagtctgtctagttttttttccctctcttttatgtacaaatgaaaatttctgtcttatgttattaacttttctggccaaccagtgaaatacatcttcaatttcaggttggttccctggagtgtggaagttttctcttggtttaatgttgactctgtcgcctaatagctggttcatttagcacccaattggtgctatggttatagctgcaacaggccacatttaaggagggcttccagggaaccagcactgtgttgaggacttcagtcctcatgacctctgagacaagtgttgttaccatcttccccccattatagggaggacatgagctgaaagaggtccaagaactttgctgaaggtcttgcagcagagctggggctggaagccaggcagtgtggtgccagagctggctgacttcagcgcctacttcatgcttccatgcatgcatacatatgccatacatacatatgggagacccataggatgtatgccatcaatgcatactgatgtgcacaccagtgctcccaccatcctcccaggaagtgttgatatcattataaaactctgtcctcagcaagtgtgtattaagaacttactgtgtgcagatccaaagatgtacaaacccaggtcctgctcataggcattgcagctggggagacaaggccttgatctgcagaatctgagctgggctgagcaggggaagcttcatctgttttgttcactgctatgtctccagggactattatagcacctggcaggtagtaagctctcaaaaacgtgatgaatgaacaaacttctaattaaacaaagccatttacatttttacaaataaatgaaagaacacatgaatttctaaaaagtttgaaggacataaactgagattagaggacagccttttaaattatttacgttaagcggtataaaaagctccccatgttgtcctcatttttcttacttttcataggttggtgggcacgatgtgatggatggggtgcttgtggacccatgtcatagatagggctttagaggctcttagatcctgctgggtggggagggcttagagaagagatggaccttgaggttggagtaggactcagctgggtggaaaagaccatgggaggcattccagagctgcccccactggcaggattatactggagagggcagaagcctcatgttttgcttgatagcaatcgttttgaacttcacgacttctcgaagcttggatccttttctgtcttactcaatacttgcctcacttcccaaggcttgcctaacttggttgggtatctaagtgtacatcccttcaaaccatgtaggaatccctggacctgatacttgcctgaattctggcaccagatcaagaagaacaagcttaaacggaggctgaggcaggagagtaaaatactggggagccacaagtcagcaccaggcaagttgacaggaatcaagaggacctggatgcaagagccataaaatcccatgcactctgactcagtaattgaagttcttgaaatgtatcttggggaaataatctaaaggattattatggaaataaaggggccaggtgtggtggctcatgcctgtaatcccagtgctttgggaggccaaggtgggtgaatcacctgaggtcaggagttcaagaccagcctgaccaacaaggtgaaaccctgtctctactaaaaatacaaaaattagccaggcatggtgtcaggtgcctgtagtcctagctactcgggaggctgagacaggagacttgcttgaacctgggaggtggaggttgcagtgagccgagatcatgccgctgtactccagcctgggtaacagaatgagactccatctaaaaaaagaaagaaagaaagaaagaaaggatcagtttatgtccatgaaactgtttgttttaatgaaattggaagcaacctaaatagtaaataacaggggcatcattaagttttggcttgtctacttgctagaatatgatacagtcactgaaaataagatttatgaagagtgttccatatctgaggaaaagcatgaaaaatgaaggcaatgataatttgtatatataattttatttttaaaagtacatacatagaaacagattggaaaaatattacagaaaattatagtatttatattgggggaaaagtcatttgtaatcgtactcacgaccaaacttttagccaatattgtttatttgtttatgaatgacaaaagatgatgagacaagggaactcgggtgagttcaacattcctgtaaagagtcagaaaccaagacactgtctgtctagcaaaggagtaaggacagctatgagaacatgtccaaaataacccggagtgtgaaataacaggttcctggacagaggggacatgaagcctgagcttggccggaatagggtgaatgtggccggggaagatacctttgtcttttgtttttctagaggcttggtatctgtaaccaaatttatccctgagcccgagacacaggaacagggcccatgagtcagtgtttctgtggcagccttctgggtcagtgcctacacaggcagggcaggcaccaaatttgacacagctgcatggggaagatatctttgaagtcatgtcttgtgtctagacttagggagacatgggagtgattagggtagaggtggccttatgtatagcccggctcccctgaatagtcccagcatgagtattcaaagagccctttccattctcaagagctctcatttggataatatgttatgtggtcaccctaattattgaaaaggaggttggaggacattctgggttgatgacagttgctctgctggttgcctctagtgcttaagaggccgtgaattgtccgggcatggtggctcatgcctgtaatcccagcactttgggaggctaaggcaggcagattgcttgaggttgggagttcgagcccagcctggccaacatggtgaaaccccgtctctactaaaaatacaaaaattagtcaggcgtggtcgcacatgtctgtaatcccagcaactcgggaggctgaggcaggagaatcgcttgaacccgggaggcagaggttgcagtgagctgagatcacgtcactgcattccagcctgggcaacagagcgagactccatctcaaaaaaaaaaaagagagagagagacagtgaattaagattccctgacgcagaggtgggcccagcctgatggagaagtggcccaggtgttgtagatgaatacagttctgctgtctatcctgattaagataaccaaggtaattattcccaagctgccccagcatgtggctagaattcatatttaactttgacccaagagctccttttccccttgcagtcttcctcccccatcccacaaacctggtacatgaccattaaaatctcaataagcagaagcttaagtaagggtaaataatttgccagctgaaccttcccctatttgcaaccttttagcattagcaagttcttgacttttcatgaaaaagccctggtatggctagtgcaaaaatcagttcaaatggtagaggatgataactttaagcagatagggacttggcctgagtgggctctgtttacttcctgctgtctgccctttcttctatcggctctgtcaaggcacgttttttgggaaccccattactgagcagactgccaagttgaccatcagtgatctagcctgggagccaagcctaggttcatcttgcaagaaaagtggggtgggattgtggagaaggcccccttccctgtgcccacaggagaattggtgtgaccctgagtgccccaatatgcctggctggacatcttgggagcactgcgaaacaggaggtaaagaccttcacaaagtatctcctcacagacagcctcagctcagtggggcccccagtcaacggagaagccgtgacaggcacagctgactggatgtgtgaacaaacagattaacagttggccctgcatcagggatttccaaagtaaagagacatctaggtctttcatagatgttttgttcagttggttggttgagggacacaggtgacaagtgttggggcaaactctggcttttcctggacttaagcaagaaattaccttttggcacctggacactgttttaagtctctagttaagagataaggggaaaccactgtctcactcaagagagaacgctctgctttagaggccaggctagatatggaattggccgggatctgtggagaggacacctgagcaagcatgggctaatgtcaaaccatagcttcctagagaggttgggtggggaaacctgactttcagtgggggagaaagtaccactgcaaagtcttaaactgaaacaggtgtaagcaagttggttctgaccgcccctcatttggtttaagcttacatcacaaggaacaggtgctgtcaataatgaattcagtttttctcttgagcccagaagcagagcgggatgaagccattaaggtgatagaacccagccctgactaataggtatgagggggaacagaactggggggcaagagttcttcagtgtaggcgtcctgaatctctatcgctgactctgagaagtcccaggggtctgctttctctaagaacagttccatattgggtaatgacaaaaaaccagagtgagattaaaaatggattctttatattgagcgttaatgataaaagctccaggtgatagcattctgttcaatgttatataactgttagaaatgggggttagtagttagaagtgaattgttaatttaatagatatgtttttatagaaaaatgatacaaataagtatgtgaagtactgctttctggcctaatcaatcacacctggaggggcctagctggctggctgctgtgtccaccaggtagaagcttacctaaattgcttgaaagaaaatgttctggcactagaattgccgtttcaaagctttacagggatgataaacaacatactgctcttcagagcactataccaatcttgttactgttggcgagagagagcatctaacactcaataaatgctaggcactccaggctgaatgctaaaaaaaatgaactgctgcctttgtttagcacagtgtccccggtagggtgtggaatttcaagttcaggagtagacaagcatgaagggttttagggcctttgaacaggtcaatgccccattagctttttaattttccatcccactttcctggctcctggggctctatttttctctttgataatctgttttctccaataggattccaaattccctattggaagttgagcctcatatcctcaaggcccatgatccctgagccaggtatgagtgcagctaatagctgatggtggtccattgatctccctgttggccctgcatttgcctgtacttcccccttgcagctgatggaggatcctgtgtggaagggctccctcaccccgagtgcaaatggctccctgtttcagaaagggttgagaggggacacgcactttctcctctccactggaaaccagctgagctgacacctccgagcagaagttcctctttgtgttcctgctgatgggctgtgctctcagttgatcattggttttttccataccttctccaggttctcagaggtcaccatttctttccagttagccccattctagaagagatttagggctgggagaaaaggagaaacatgtgttagcctcattagtatctttggtgaagtgtgaggagaaaaaggtagccatgattgctagaaaaatgagactgttaagggagaaaagtgtgtcgatctctgttatcacccatcattgcagatggcaaaaatcagttgttctcagcaacatcactgactgccctgcagacaacctggaactggagggtgtcctttgggagacaggcagggcatggtgtggaagggcctgtgtgagtcacatgaggacagccaagggtctgactggactcccggccagtcctgccacaggcattgcatgcagctggtgcttgagtgggttcacctgcctacctgaggagcacgacagggaaggtgagaactgtcctgagcctgttggggggattgttcatctagaagagacatgactggcatccccattggcagagccagggccaggcttagagctggcttacatttcctcattttgtattctattgagcgccagaaatgaagcagagagggctgaaccctgacacagtgggccggcccaagcctgagattgaggcccagaaaggcctaggctcaacagacgccagctccagacccagggccaccctgctcacccatggctcacagggagatgcagattgaactcttcgttccagagagtggccaccttgattgggaagggaagcaggggcaggggaggagagggaagtcacagggagactatgggaaccacgggaaacacggccattctgtcctgaggtctgggggaggggcctatgtccgcgtttcacctacagcacttatgtcattgtattgggaggaggtagttgaacctctcaccttatttatagtcctagcgggtattgtgggcactcagtaaatacacagtgatgggtgtgcggacaggtaatgagttctgagccttaggccctagttcttcctgctctgctgagagcacaaacctgataaagcttgagaaccatgatcaggtaaactgttcgaaatagtcaggagagtcccatcttctcaatccttttgtccagctgtggagtaggccttttagacaaacaacagtggcctaagaagttggaatatagaagaggattcctatgtataagaaccgcaggaaattatgaacttctggaatttccttgctgagagggctgtgtgttgtggctgtggcatttggctactgcgtgtacgtcctatttcctgtaatacaaggcttagctcatcactagcagactgacaagctagtctcagaagcagggcaactgggattgtcaaataggtttccttagtatgctccatcctgcttactggtgagaggtttaggatagtgtgtctgagctgctgtctgcagagcagagtgtgcgagtggctctgcaggtgctggagctcacagagagactgccaggatgtgcacctaagattatatgtttagaggtcttctttttgtttgtttgtttttgttttttagacgaagtttcactcttgttgcccaggctggagtgcagtggtgcaatcttggctcaccacaacttccgcctcctgggttcaagcgattctcctgcctcagcctcccaagtagctgggattacaggtgcctgccaccacacctggctacctttttgtatttttagtagagatgctgtttcaccatgttggccaggcttgtctcgaactcctgacctcaagtgatctgcccaccttggcctcccaaagtgctgggattacaggcgtgagccaccacgcctggcctgcttagaggtcttctaaccccagagaggtcaggacactccctcagggcctcactgttagcagaccctgtccctgaaatgttgtggccttaagtcagtttcttctctgtaggccttggttttcttatctatagactgagaaggtgagccaggggctctctgagttctgtgattatgtgcaatctagcagcagagccaggacaggacaccaggacctttgaactccagtccactcccagctcttccgtgtggcatctctaacaatgtgaccttgtcaccaagggtctgaagcctggaatcagagacctcagttcaaatccagttgataataagtagccgttacttattagctttgagaactttggctactattactcaacttctgagtgcttcctttatctttaaaatgaaagtaatacagtatgtatcttatagaattactttgaaaattacagtaaacttatataaagccctcagtacagtacctagtcctcaataagcattcaataaatgggttgtttgtattagtgacaatcgatatgtggttcagtcactgcacttgtctggaccttaggtttcctttctgtaattggaccagtgcttctctgacttagccatccctgaggacagtagagaaagagcatgtattctagggttaggggcttggggtgtagcctgtagcagcttgcagaaagcctggcatttctttgaactcctatttatttgtaaaatctacttacagttggtatcctatacaatgatctgaattttttggttgtaatataaaaatgcttcacccaaatctttgagtaaagttgatgttctagggtgaggtagcctcaaatatcccaaagggcatacagccacacccctctgggctggaggtgggattgaaagtagtttcaaaggtcccttccagctgtgaaattccaggcacctagagtaagtgagtctcatcctcaaaggacctaaggttggtaccaaagaattctaaaggaacctgagaagcgggatccctgtgccctgcccctggtgagaatggacagggctgtgtggaagtggaactagcagaaacagggagagagacagccctctgcagtgaagggtgaaggaggctggaggaagagccgggctgtgtctgggcctgactgtcggccttgagctgatgaccctggcaggtttggcttggcagctctccatctccccaggtaatttccaggaagcactaagccattgtttctcatccacagctggaggctgtctggggaggagccctcatatctcaggagggcagtgagggcagggggtgaactgcatgtggaaacatagagcttgtcacactgccaaggcctcctggccattctgatgcagcacctaaggctggggtctgggcttgtgcccagccagtgggaggagagttgagggagtctggagaagggcagcaaggttttggagagaacacagagatttctggcctttgaatgggaacaatctctaactacattctgggaacctctctgtgcatggggaaagactatctgctgatggtggtgtcagccttgcacaaatttgccagtatgcatggtctcttcctcaggcatgagggattcaaatgaagtcaccccgtttgtttagggcaaatgtaagggttttccctgggcaagggattgatgacttagtcaaattcatactcagcagatgtcatgacaataaaaatctaaggggatatcaatacattcgttacactggaaatttcctgttgtgtaaggtatttgttataataagatttaacatagcttttttttttttggtggggggatggagtttcactccattgcccaggctggagtgcagtggcactgtctcagcccactgcaacctctgcctcccgggttcaagagattctcctgcctcagcctccagagtagctgggattacaggcgcctgccaccacacccagctgacttttgtatttttgatagagaggaggtttcaccatgttggccagggtggtcttgaactcctgacctcaggtcatgcccccgccttggcttctcaaagtgctgggattacaggtgtgagccaccatgcccagccataagatttaacatatcttgataaaccctttctaagcatgttgccaagttggatttgaagttcagaaggactggattccagtactgctttatgaactatatgaccttaggcaagactcacctggtctttgagcttcgggtgttccatccataaagtggtgctataaaatatctcagtatgttggccaggcacggtggttcacgcctgtaatcccagcactttgggaggccgaggtgggtggatcacctgaggtcaggagttcgagaccagcctggccaacatgctgaaaccccatctctactaaaaatacaaaaaaattagccaggtgtagtgatgcgcacctgtaatcccagctactcaggaggctaaagcaggagaatcacttgaacccaggatgcggaggttgcattgagccgagatcacgccattgtacttcagcctgggtgacaagagcaagactccatctcaaaaaataaataaataaataaataatatcttagtatgttgtgaagttgaaatgggatattgattaggaaagtatttcatcagttgttaaataagtagctaaatgttcattttaagtaaaaacccttttggtaacattagctaagtatcaccatcctctaggccctccacaagctagtctcaatcaatgtaatgactatttttcaacatttctcttgacccatctctttaccagatgagtttccttgctcttatatacaggcaccaccatctccctagatcagctctatacagacggctcacctgcttagattaccatggcctgttctctgtgctttgccagcttcagagatctcaactcagtctttgaagatacagtggtccactctggaccctagtttcctcatccataaaataagggagcggactacatgatttaggttctctttcatcgctgacattctgcaatccagccatttttcagtgtgcaaacagtaacctagaatctgagaagatgagagcaatgcatattgtccaacaattataagtaattgatttaaaaaagcactttaaaagcatgaattaaaaaataaaataaaaataaaagcatgaattaataatctattccttgtgatatatagggcaatgtttgtagcaatatttaaatgaactaaaacatttaagtgaaatgtgaaacctgagtcttcatcataactgactattatcaaattgttaccattttttgagtgcttgctacatgccagacatggttagaaattacttattacagttacaatgtattgagtattttgagtatctactttctgatagctgcttaaagctgctgctaatcatactaccctgcagatgtacagatggggaaattgaggtttagagaagttaagtaaatcacccacggtcatccagccactgtgtggcagtagcagggttcaagtctaggtgtgtgtaacaacaaagcctgtgacgtgatggctccacccaagtcctctgtcttgcagtcaccactgtgcttcctcttaggttgtaaatctgttgttactactctcctaggactggtggttaccccagctgtgtttatgatacagctctggacttgaccctgaattaggaattggccctctctctctttagttgaggcagccagcctgagaattgtatgggaaaaaaaccctagatttttatgggaaaaacctccacctagatttagcaccttccctcctctggcgtgttggagaaacccagtctcggctccctcctcacttccctccgtgtgcacctgccttctcctgtcagtgctaaccaaggatggaagtaaaactagaaatccttaataccgtttgccaggctttgggcttcagccacgggaggcagattgtgttgatggatgtaattagaaaactgcaaacctgcttctcaaatcccaggtcctaaaggagttgataaaccaggttggctcatgtctcattctcctttgctgtgtcacacggggaaggatttggaatagaagtatccccaggcctttcagtaatggaagctcgagtcaaccatggatgcaccagagccaaacgagtgatggcaactgcctttggccccaggggtccagcaggagctgtggacagctggggctggtgacagtcttcacttgataagagtctgggatcctactggcaaccatgtcaccgcagcccctcctgtcagcagtgcttcctgctccctcttccaagcggaagacctgttccagctgaatggcttaggctcacatggaaaggaggacacacacagaagcgccttccttcttccctctcctccaatcagtcaggtgttagttgagtcacagagctaatgttttctcaggggaaacaggccatgggacctggtgcctcccctaaactgcatagagaggaccaggggccacatttagaagccaggcctgggcagcttctctcacagttcacttgtgcccatgccctcagaattgaggggtcttcctagcaaagtatcctctgggcttgtcccttaagatcatccccacagaaccagctccctgcagaaagcagagaggcagtgtgtatttcaggccattttagacagaaggcatgggatctacagtctgcaggtagagaacctgctcacagcctgctccaggggagtgtgtgatctgcagaatcatgaggtgcatttccttcctgcaccttcttttctcaagtgggctttcctaggcttctcacagaccactgttggagaggaggggagggcaggacagactcctgccacagagaggtgaccctttttactccctctcctttctgggtctcctctcagtcctgtgaccctacagcaccaatagcacaccctactgccatgggctgcccaaacccacttgctagccctctccctggcttccctccctgccccctgcaagatttctgtttcaaaataactcaaattaccaaatgctggcagaattgagggagtgggagggagaggaagaatgaagtgattgaaagacagggagtatattccatttaccttatgagcaaatgatactccccaacatcctgccccattaattttgctgttaatatctgccattctgctaagggattaaatgagttctaagtcaccttaagtacttagtctaatgcctgacagtaagtgctaaatacatggcaactattattagttctctctttttctcctttttcccctgggattttcccttagctcttccagccccagctcttctctggacagacctcatccaatcagagggctccacctgggagctggccagaagcagaggagctagaatcactgcacaggtgtgggtcgggactgacccagccctcagagtcttcctagcctgtgccgctgtctcacaggtgtgtctcgaggaccaggtgtgcctgcctgatttgcctgcttggcgggcagccctgggcagggagccccaacagaagtctttttggttggatataagctttgcctcctctcctggggtcctgcagcagctcatccctgcctgggcttggatccccctgctggaacctttcctacttgcgcacatgtcttgtggagagctggtggcagtcttagagaaaggtgcactaggacaggaaatgcccagagagacccttcaggccgtgtagagaggaccagagaaggaaggtggctttcctgagatcacacagctggtttgggtggcagcaccacaataagcatgagagtcactgactcttctgtgctatctcaccctccagtgccatccggatttctcctgtgcacctactttgagcaaggttgcttttattctctgagcctctgacagaaactttaaaatcataaaagcagtaacaccattaacgatagcagtcatcatagattcagctcctattctgtgtgagagactaggctgaggtcgctttttatgcacgttgctgaccctcgtaacaatcttgcagctacgaggctattagcagtagccgcattgtacagctgaatcaactaagattttgagagattgtcaattgcctcaagccaccctcctagggattggaagccatgagctcggttcttgttccctgagtcgatttcctgggcttcagtgggctaagggttgtgaggctgcccctacctgagtactcacacctcatctcatagggtttaaaacacaaggcacagttctgcttggcagaatggagtggggggcatggtatttgagaaggagacagtggtggtaggagttcaataagtatacttgataccccaaacttaatcctgagggggtgaaacctaagaatgaagtgagtgaactttaggattatagctggagtgtgcattccgctaatttagttataagcagggctctggttctggctttaattacttttgcatatgacttgtatcgcagaaaacttctctcagcctgttcccatcaaatcccaaataaagcaagaattccagcaggaagaaaacaactccaggagaccaggccttgctccttcacactgtgcgtgaggttaggtgtgtggatttgattagatctgtgtgcctgtgtctgtgtgtgtgttgttgttgtcgttgtccccttttaagaaaatttaaaaataactttctgccaaagatgtgggcaccagggttgtgttgctgagcagaaatgctcctcccacccgtggtctgctgctctgctgatgtggcccagctgatgtgggcagcttgtctgcctgcagaagctcagcccctcctttaatgtgtcttccaagaggaaaggcccaggaagccatggggagggagaggctgcctggtggctcagggaagaactcagctgttgggacaagagtgggctggctttgcctgctttcatgtgggaacccagggacctggatccaagtcactcaaggatgccagcaggaaaccctgagattgtaccccgggcaggctgtgattgtgcccatttcacagctgggaagactgagaaacaaagagtagaaaggatgcaaatcagaactatcatgaggtaccatctgacatcagtcagaatggcttttgtttaaaagtccaaaataacaaatgttggcaaggctgtggagaaaaaaagaaagacacttatacattattacatggtgagagtgtaaattagtccagccactggggcagtttggagattcctcaaagaactaggagttgaactaccgttagacccagcaatctcattactgggtatatagtcaaagaaagataaatcattctatcataaggacacatacatctgtatgttcttcacagtgctattcccaatagcaaagacatggaatcaaactaggtgcctatcaatggtggagcagataaagaaaatgtggcacatatacaccatagactattatgcagccataaaaaagaatgaaatcatgtcctttgcagcaacatgggtatagctggaggccattatcctaagcaaactaacacagaaacagaaaaacaaataccacatgttctcacttgtaagtggaagctaaacatgaggtatacatgaacataaaaacagaacaatagacactctagggattgctagaggagggaaaagggaggggagcaagggctgaaaaactatctgttgggtactatgctccctacctgggtgatgggtttaatcataccccaagcctcagtatcatgtaatctacctttgtaataaacctgcacatgtactcccttactctagaataaaagttttttttaaagggaaaataaagtaaaagttaaaaaataaagaagaccacttttccctttctccttgtgtattttaagaaggacagaaatgagagtagatggtaacagagagagtagggagataggctaatgtggtggttctcaaaatgtgccctggatgtccctgagactcttccagggtcccttgaggtccaagttatttttgtaagaaaacatcatttactttatttcactctcattctctttcaagcgtacagtggagttttctagtagctgtgatgtcacaatagattggatgcaaaagcagatatgaaaatttagctgttttctactagccagacattaatttgcaaaaaggagcaactcttctcattaaattcttttttgtcttagaaaatatatttttctcttaaaatgttatttatgttagcctataatgggcttattgatgttttaaaatgaattaatatttcccagttttaatttccaatactgtaaatattgacagcagtaactcacaaacaaaagctctctgggggccctcaataatttttagaagcataatggggcccaccctgagacaaaaatgtttgagaactactgggaaagcaggtagggggtctcctaggtgttaaaagaataccagctcttcaagaatcagatatgaatcaagggaaaacttaaattcatgtcattgccgattcggatgtccacagtctgccccaaggtgtgagttgcataggatgttcctttggaactatgaaaataccttctcttgctggaggaaaaggtctggacagggcatcaccttgctgcctcattttagaggagtgctccaaggatcattcctgaagctctccagggctctggaccaacgaggcaaagtcgtgctcaacatgaacacagtctgtggagtctgggcctcatcagtgcagttccttatgagaaacacagcacaggagttctccatccatctgcttgctgggcttgcatcctgctctagggatcataaacagggcttcttcagcttagggaagaaagagctgggtctcaggaggaaatatcttatgatccctgggtggtaatcccaggccagatgtgccaaggggttggagtggtgttccaggccagatgtggaattgggagagtgcccagcccctccgaggactcagctctctgcttgacagggtcctccctttgctccacactcagattagaatctgcagctctgaacaagtaaaaataaaaacctgtgagcttccacccctggctcccccaggactccattgagagcctctgcagtggcagccagaggtttcaaaggtcaccccagctgggcggattagaacaacagatctcccggaccgggtgaagttggctgctcagcggaaggcaaattgcaccatctgcgagcagagtcagaacaaaagccccttaactttttcggtctggccctgggctctgtggcgcccggcactccttcggtctccattcttggctggaccttggacaggaacctctgcagtacggtggtggtgaagtgtggctgcctcgcatcctgactcatgtgagagctgccgaggaagaagctgcggtaaggtgtgtcccgttcactggtgtgtggtcctgcccagctttgctccggtaggtcatagcaagtcagcctggcacagccgaggagcagcgcactccggaattaggagtgattagagaacttgtcaggatttgagtgcattgcagagaggattaaggtgggagagggagctgtcagtgcctggggcatttgcacgtgggtggttttgctgcctctgatgtgtgctgttgttggaggtagggttcacggtagactgcggagcctgcttgggagcccctccctctagggaaggtatgatatttccaagatgcccggcaaactgaccaggtgcttcaagacaatgatcatttaaaatgtatacactttgggtagggaaggggataactggtttctctaaacttgttctgtggtattacttgagccctgattttttaaactttttttctgagtcatttgccttatagttacaatctcttttcgctgtagttgaaagtgttcctttctgggttcaagagacaatttaaagtgcttttgatcaaattaaagtccagttaactcaatgctgcttcaaatagttaataaattatgttacttgtgaaagcctcatttagaggtgggcgttggcccaagcatcagggggtgaggggtgaggggtaaggggggtaagggggagtttccagctcttgaaccactgctctttttgaccctctcccctgttttttcttcttacttctctgtgtttcccctttgatctgtgtttagcttgtattgaataagaccccctagctgggtgtgtttgattctagccactgagcattgctctgcattagagaaattattgtagaaatcacccaacctctctggttttcttgattggaatatagtccacaggcttgacaagggattagagaggaacgaggtttggtctaatttactttattattaattttttttctgatagagcattccacatatgtcagtaaccattaattgtgtggcagagatctgtttatgctgatgatggcagtgggtggggcgatgggctgagggtgagcagagctgtttggtgtggctgggctctggtcctgtccgcatggtagttgagtaactctcccccacaaaagcactttgcaagggactagatgttcccttgctgtattgatttgcgtgttccttttctaacctgaagccagacctctcctagggatggatgactcctgtctaatgtgctgttgagatcaagcaggtgccttttgatgagaacatctggggccttcaggagatttccatgggcctctgattttagatcaagaggacttgcacagagggtcctgagccactcctaccttccaggaggatctcaccactcctagcttccagctcccctgaaagcaaaggtagagaagagtcttgtgtcttcaaagccaggcctgacagcagaagggggaggcacatgctctgcccctcttcctctgtacaactcccaaccctctgcctattgcatctctcattactggggatggcaagaaatacctcatttgagatgtgggggcctccgagaagccagcagattttgactttgtaatcagaccttgatttggttttcactttttagctgtgtgaccttagacaagagtagttggctttctaagcctctatgtcttcatttgtgaaggggtgatcattagaactgctctttctgattgagatgggtgcccagcatgatgtcagcacgtacaccttgcttattaaatggtgctgctagtacagacacaaaggtgctgcgggaagctgcccatgggcctcaggccctcctccccaccttcccagggaattctgccatctgcttcctgctactgttttccagtcatctcactcatagacccttgcctgaagatatctggggcttcttgctgtctttggtgaaagggtctatatctatattcagggtggagagacgggcatccctttgggaactggatgataatgatgttgacagccactgctattgaatgccttttatgctatattatgggtgttacatacactctcgttcaaaccttcccttcaactttatgaggctgatatgatcattccatttgacagagaaagagactgaagccaagagggttggagcaccttgcccagctcacagctggaaagtggccgtgtccccgggtttgtggcagggtcacaaaagtctgatcctcatgatacctgtccccaccttcatcccaagtctctacccggtcctggctgcacagtgtatcatcacttcacctctgtggcagaggaggagggcacagggagcagtgttcttactggggtgtggtcctgggtagctatgtgggatatcagatgatgcccattccttccgcagccctgtgtttctacggtcgccacacaaacaacaacacacatgccccactcatgtaactgctgctgtataccaagtctctagcttggcccatggtagatatttagtaaatatattttaattgagtgaatgaatatatcttgatgctcgccattaaaattgtagtatgactgcttttaaatggttctacaaacatatactatatgctataaatgctatagatgctataaatatggcaaaatgttaattgttaaatctaggtgataggtatttggggtgctcattttatcattcaattctactgttctgtatgtttgaaatttcccgtaataattttttaaatttaaaatttctatatcatcaaattcttatcattattttccctgtaaatatgtacccataaaaccacctggtattccactgtatttgaccagttctcactgttggattttttaaaatatagtctatcttctgtcctaaataatgcaaatagtgttcttataaataaattttgggctgtatctctgattctttcccaataatatatttctaaatgtaggattattgggaaaagacatggaagtattttttagaatctttttaccaaattgctttccagaaagactacaccagtttttattccccacagagggtatgagcatgcccatctcatcatggtctcaccagcagtatatgttatgtttctttttaaatgtcatttaaatgaaatgttttggttcatttttaaaaagtaacagcttattcttaatttgcactcttggattattgtcggagccaagagtgttcagtggtacatcctctgtgcattgttcaggtcatatcatccgtccattgatctgttgggctgctttcttctgatatgtaaagacctttgtttggtgcaaacattttattccaggttatcacccatcttctaatgttgttgatagtattacagaatattttaattttatacatatgtggtagcggctctcaacttttccccttgttatcccaacttttacttttcctttcccatcagccaatttgactgcttacaggaggcaagagggcctagtggttaagaatagcagctctggcgccaggtgcttgggttcaaatgcctgttctgccccctactaaatgcatgaacttggacaaatttctcaatctcactgtgcctcaggtgtctaatccacaaaatggggataccaagattatctgtctcatagtgttgttgtaaggagcaaatgagctatttattatttatatttattatttataaagggcttggaagagttccccacatctagtaagtgctacacaagtgtttgcttttattgctacctactgcagggaacctgtgagtcttaccattcaacaaggaattttgtttgcaaagctaatatcttatcagtgaaagagaaagctgggtttatcaagcaggggatgtgccctattacaaatgagcctagtccctttgctgctttcacttgaacttcaaaagagatatccccattttatttttgttagagattattaaatttaaacaaactaattacatgtcccagagagcattgttcatttgtgtcagtttacctgactcacagcataggacttaagtatgtgaccagacagccaaagaaaatgaacagaaaagcaaatctaggaatatggcttctcttcagttcagcagatgtgtgccccacgtctgggccagtcatcagggattttgtggtaagaaatgatcgtcagcctggatctgtccccacctgcacttggaacctgggacagggacactttgggtgtattccaggtggtggcagttgttgtccaatggccttgactggagtccgaccacctagctcttctcaactgcaacgttttcccagcctggttcttcagatttttctatggattttggaaactccccctgaaactccaccatctttccaacaaatcctttctctgtttacaagagccagatttagcttctcttgctttcaatcaagaactcagatatgtacttataataattccacttttggagtcatttgtaaggaaatctttaggaattcgggcatagatttcagtacacatagactcatcaccgggcatcataaaagatttagaaactatccaaatggccagcagtagggagatagttatgtaagtcatacatcaatatgatggatatttgaaaatcaaatttcttaaaagcaacttttcccccttattttaagaaaagttgtagggaaaaaatagaaaacattgtttacatagtatgctttcaaccatgtaagatatgtgtttttctatattgataaaaacaaaattggagggaaatgtaccaccattctgtataatagaattatggatattttcacttaaaaaacttttatttcaggttcacattttcacattttaaaagagctctggagcctgcctgggtttaacttccacttctgccactcaatagctgtgtaatgggcaagttattccacctgtctgacctcagcttctttatttgcgaaatgatgactatacatacttcatggggttgttctgaggattaaaacaaatgagataatataaaaagtgcttgatacagtgcctggaacagaatgtattctcaataaatgataacttattatttttacatattggtaattttcaagttttatgatgaaatgtatttaaaattaagaataataaaatatcacaaaagagttgacgatcgctctaatgagtagtcgtctgttacttctcatgtcagccccttgttctgctacccttgccagccccagtcacatcttatctagtccccagcaggccctggaccaggagtcagggcttaaggtgttcttgtcagtgataccatcattttgctctgtctcctggggcaagtgacttaccctctctgggcttcagttataagcagaggcattagcctgggtaatctgaaaacaccccccttctctgatgatctgtgatcttggagccttgttcacaatctggtcctcagaggtgggatgtccccccatgcctacctccttcccttcattcagccaagactctccctttacctcacccagggtccttgccatattaaccccaaactaccttcctctcttggagtatggatcccatttttctatagcctgtgagctcttgcagttcaggctaaagcagtttctactttctgccagaagtgcttaatgtagatgttggtcctgaagagttagtgactattaaatacagattatagatatctattataagaactatttctccattcttgtccccagcttcccctttcctagaagaaggggtcagtgaaaagatggaaagttccccacagggttttgaggaggcagggcatcgccctgggaaccggagtgtttgtctgggatgggctctgccttgtcctggcactttgtgtataaaagacagagcctctcatcttcacagaggagctgtgggtggacactgacctaactggggatctgctccacgtaaaagccacacctccagactggacacacctgatgcctgaagggaagacagggctgtgctttgtctgatctgaccttgtcctcttccttcctttttgcagaccatgggggatgtgaagctggttgcctcgtcacacatttccaaaacctccctcagtgtggatccctcaagagttgactccatgcccctgacagaggcccctgctttcattttgccccctcggaacctctgcatcaaagaaggagccaccgccaagttcgaagggcgggtaagaagtgtggctggatggggaggctgtggggaaggatgggcaggggccgctgctccttgtcaagccttttcctgggccggctggatctaatagaaggctcaattttcttttggaccttcatgtaaaacgaacctgtgccacttttctctttcttttgtttgtgatgggctttggtctgtgctggagaacttgggggtggggaggacgctgcaagttgaccatcctgtgatgttttgctgttaatgtaggttgtgttctgggtacatgctatataattacagaaaaagaagacgcggtccggtggcaggaagaatacagcttgggtttatatatgtcctcaaatctggacagttgagaattgactgtaatttttctcttgctttttccgtggaaggagagtttagttagccgaccttcttgtacatccatttggtatacccggagcagtgataggacctctcatttcacttctgtcacctgtcataaatgaatactggtcacttgccgttactgggactccacttcttcttctacaaataggcatgatcattccttgtctaccttgtactcaaaggagaagagaacactgaagaatagttgtactatgactcagcagtctaagagggagctcctgaaagcttgtaggagggggtcaggtggatgattctttttgcatgatgccggaccttacctttgtgtaagtggcaggtctggctacgtggttgtctggagagtttgcaggggttgctgccttgaaaatggcctggggctgtactgaattgcatgctgtgcatggacctgtgtagtcaagactgtttgctaatgattctgacctactagtcctttcatatctcttaccagaagattgttggggatgttagtgatgttcctgaggagtctgtttctctctgggcactaccaggatgagggctgtcttctgttgccctgactctggttccctctgtcctcttatcctcatagctaacaggagagaagcaacaggaagaatcgctgggggctcataaatgacttagatgactataaaaaggaatgaagtactgactcatgctataacacggatgaaccttgacacattatgctaagcgaaagaagccagacacaaaaagccactgattataggattctatttatatgaaatgtccagaataggaatatctatagagacagaaagtagaaaggtggtcaccaggggctggggggaagagagatggggagtggctgctgataggcacaggatttatttggggctgatgaaaatgttctgaaattagtactggtggttgtacaacttttcaatatacagtaattataaaatactgaattatacacttagaaaactaaaaagtaaaaacatttgagaaacggatcagacagcaaaatggatcttaactgcacacacagtctcctaccatactgcttctgagacataaactccttcctcaagtcaaacaaatatggagaggaagagatggcggcctctatgtcatgtgatgatgcttttgcttcctttgctgaccttggtgtcatgaaagaaccatgccttgagtgactcgatttggaacttgcatctgctgagcactggccaggagccaacacactggagttctttgttgctcagtgtcctctggttggcaagccatgccttctatgtggctaaggtttccttctctgagaaaagacaactggctgtttctgtatttctggcccacaggggtggaagaagaaaagttgatagatagtaaaagtacttcatgaagttagaaagtatactttggtaagacagtatttttcttaaggagttgaaatttacataacataaatttaaccattttaatgtgaacaatttagtcatttaattcagtgttgactgcagtattcttaaaatgtagctttttctatgtgaaaattttatttttcttatatggatgaaatagttgaccttgtatattacatgtggactatatgtcaaaatgcatgtgttccttatgagtcagactgcagcgctacttgaccacttaccacctgacttgaattaacccagaacaatgccttggcagcacactggtgtatacagaagaaagactattccagagagacgtcgaaagcatccagctgtcttgcagagacaaatgcagagggagagactgtagaagaaaatgccctggaagctagcatgctgcaagtgtgtattgttagtgtaggaaacaacacagagacttttgcatcagggaagggccacatcacatgatcccagaagaagagagctggttgttctgataccaaagacgaagttaaacagggggtgtttctgacctggtgacctcaaagaagtgaaaagttaggtggtgttagcctgaggtggcatgggttttgagcaggagttgctggttataataagctccaaacactcaaaacttgcagttccctattgggcatagtcagtggtgatctgccttccaatgcatgtcagccttcactgttggggccacttgaccttgcctgcagctgacccctccctccaggtcctgggacacacccctccctccaggtcctgttctaggtgctcaatcgtcacggaaccagtcctggtatcactctcaggatggcctcaggagcacatttctctggtaactgagctcttgcagaacctcttatgagtgactaacttaaaaagtatgccttcaagcaacttcttggacccaggctggtccctgtcacagctgacaggaatcttcttcctggcctctgcccacagcacctctgcctgctttcctccgtgaagttgcgcccacggtggaggcagtggagggacctaggacttcccagcttcttctgaaagaggttcagggaccgtcccatcactgagaagcaaagtggacaccacagatgtgagaaagttctaaagatttatttcctactgcctttggagctgccaatcagaagttcttcaaatgtgtgcttttggtttttattctcgtaagacgttaagaactgttgcctactctgccccatttcctttttatgcctgtttttagacaaaggacttaatgaaccacttccttcaataaagctcctctttctatctagtgacttgggtgacattaagatgggataacaggcaccccctgggggttcaagcctctttccaaggagctccaaacgacgagatgctcatctctgtgggctcagtccctcacagcctttagggcttttccaccttgtgggagatacattgggtagccaacacataacccatgaccaggcccctttgcctttgccctgttccatgatggggtccactgtagaggcttccgttgcagctaagggtagcccagtgacacatttgggctgaagtcagatagggagcttctggaaaagcccttgcttttctgattaaaggaagataaaaagacatcactggtgctctcatatttcacccttccgttgcttcctgccttgaatacaggtgtaatgcctggtgcttgggcagccagattaaaaccatgaggcaacaagcctgcacgctaaggattgtttgggggcagggggacagcagtggagagagtgaaaagaaccagcagctaagagacacaaatcctaaagctcaaagcctgtcccagatacaatctttgcagtgattcacacaggaaatgttaccgaaagtattcctaactgataaatagctcgcgagatgcatgtggagatagtgtctccttaaatgaagggaatgaataggagagaagacattgcacagggatgggggttccttattctgagttgattgtggtcctgcagtgaaatcattctcgaagaattcattcactccctggctgtggccattaggcttgaaccagcagggcctagggtttatgagaggaagtcaacaactactatttgattagcatctactgatttgacctaagccccttccctcctctcccctctccttcccatctcttcccttccgttccttctttttttttttttttttttgctttgccagcccaaagcttgaggagactatattttcaggaattaatacaactttatctcatttccacctttagacccaggcaaccagatccctcttcccgtgcccacaacctagaagcccctgttcctttatccagctgttctctctccatagagcagcagagcaggagacctgtctgcccaagggatacgcccaccggagccaaacctcccccatgtgctgggcacccaggacccaggaattttttaccaaatggccctgagcacacttctaacacctgtgtaggcctcctcccatgaaaagatgttgctaggcctgggggggcggggtcaaagggcagctgtttgcttgggaggacagtgaggtagatgaaaattcagacgcgcgctctgtgttctgctcacgtgcctagtagaacaggatgtaagtagggtggggcgagaagtgcacaggactgcgccactgtctggtgttcactgctgggcctcaggggtggctgggggcttccatgtacagacagccagggctccacgaatgccaggggctggtggaaacacccctagctgctctgttgcccatgctggtagctgaagtgttgatgggctgttttccccagcagagtcaagtatgaaaagagcaatggtgggaaaaatgctgaaattactggagatttcttcccttctaccctggaatttattcttatcagaaaaaaaaagcaaacatggtgacaagccctggctgtgctgtgactcagatgagctaatactttagtgtctcttgagaagtacagcccaaatgaggtttcggctcacactgctggccttagcgtttgctgaggtgggctttgtgataaagagccagccctggccctgtcaaggcatgtttctgtctaagctgtggaaggtggaggaagggaacatgagaatactgaaccatggaagcatgaataattcctcagtttccactttatacaatagtgtatctgtctcccaataactttcaactcagttcacttccagctcagaagcagtcagccaccatgtttagcactttaacaatgagaacacatggacacaggaaggggaacatcacactctggggactgttgtggggtggggggaggggagagggatagcattaggagatatacctaatgctaaatgaattaaatgggtgcagcacaccagcatggcacatgtatacatatgtaactaacctgcacattgtgcacatgtaccctagaacttaaagtataattaaaaaaaaaaagaaataacaaatcaaaaaaaaaaagagaaatttgaaagaaatgtctggtttgctttctgtcctcaggagtcttaatgatgtggttctggagaagaatgtgcatatagaagagcaagatatgacagtgtataattaggtgcttgaatttcttcaagaaatagtttctactataggaattgagagattaagatgaggctgggagtggcttgaagactggtttcctgctctgatttctgcccttccagttcatccttccttctgctacttaagtgatcttcctaccacgtggatctgacggtgccacctcctgctttatacgctggaaccttggatggttccccttgcatgaaattctgcagcactgcttaaaaggccgttgatgaccagctcctcaccctccagccttgtctcctttccctcccttcttccatctgctgtattttggtgatggtcctgctcccttggcccacacaggcacagtgcaaatcctttgctctagccccaactttgtggagaaagggtaaacaagaagcatattttatctccctattggtttggggttaggaatggggtagatatgatagaaaggggactaacatatttgttaatggcttattggtgctaggcttacaatcttaatcattttatcctcctggcaaggcagcttttatcctgattttttgtagggtaagaacctgggggctccaagggattataacatttacaccagtaagtgatggagccagttttaatagacctaagtctcatgttcttcctgccgcatgacactgccccttcacatgtctcatctggttccttgaacgcgatgaccgtttcttgtccatctttgaataagatgaatgcctgccatatgatgaatgctcaagcagtgtttggtgcccctgaggagaaccacggtggtgaagtgtctaagactcccggtgtcttgccattcaagcccataaggatttggccgtgtacttcttctagggtcctgtgtctctgttaccccatcagcactccctgcctggcttcagagccctcattccgcaccagccacacccctgtgcacctgcttcctgctcctccacagcctgtgcctatatcaagaatgcccttccttctttccattctacgcagcctcaggatctgatttaaattctacctccttcaggctactttcctaatgcttccttttaaagcatttcattagagtacagaagagccatggttataggatgtggaaaattcacaataatcatataagatcattcttgactaatagccacaggaaagagttgactactttggccttttaaaaaggtattattcactaataatctctgtgcctataactatgttacaaagaaaagcatgatttaaatgctaaactatttttaaaacaaaaattcagacaaagttaaaagttatttgccttagccctcacttctactctatataggtggccaccattaataatgttgagtatcctttcagaaatgatttatacaaatattagcatatatctgaatatccttgtatatacacaaatgggccatgtatacatagtaacctacaatttgctctttctatttttttgtgagttcatagtaggaaatatatatttatggggtacatgagatattttgataaggcacgcaatgtgaaataaacacattgtagagaatggggtatccatcccctcaagcatttatcctttgagttacaaacaagtcaattacactctttattttgaaaaatacaattattattgactataggtaccctgttgtgctatcgaatagtaggtcttattttttcttttttttttgtacccattagccatccccccctcctcccccacccccaccctcccactacccttcccagcctctggtaaccatctgcaacttgctctttttactgaatgtctttcggtgtttttgttttcacactagcacacagatccacttcacagctctaattctgaactttctaaccctcaattgttcccttctctgaacgcctataatacttttatatatatatgagactcatttttactctttatcaattttttttttttgagatggagtcttactctgttgccccaagctggagtgcagtgacacaatcgcggttcactgcaacctccgcctcccaggttcgagcgacactcctgcctcagcctcctgagtagctgggactacaggcgcgtgccaccacacccggctaatttttgtatttttagtagagacagggtttcaccatgttggctaggctggtctcgaactcctgacctcaggtgatccgcccacctcggcctcccaaagtgctgggattacaggcgtgagccactgtgcccggcctactctttatcagttttttaatcaatttataatttgatccattattgtttatcttttgcttcttcaatgagagtgagctgttcaagatacagaattgcattgtccaataggatacctacccactagtcacatgtggctacttaaacttaaattaacatgaatttaaattaaataaaattgaaaattcagttcctcagccgcatcagccgcatcagcactatttaagtgctgaatagtcacatggggctaatggctaccatattggacagcacagattcttgaacatttccattatcatagaatgtcctttcggacagggctgattgagagccttctcacacataattcaacttcccatactgtatatcactaacccacagctagaagatagactggaaatagttgtcccattcacaataaaatgaaggcattacattcttgagaattaagtgaattctcaagattcattcaaagaaaaatgtgatctgttgatgagagaatctttgtccttcatcttcattgtagaatgctaaccttgatatcccagcaagcttgaatgtgctcccaaattttccacaggtgtctattccacgtggctggtagcccaggtgtcacagagtttccaaagtactcaaagggaaagcagcagtatgagaagtggcagggcaagtattactgaaaatttaccatagtcaacagctggtggtcactttgggttcaaaatggtggactgaacagatgtcttaacttcccttcctgacaaatatgacatcgaaataaacatgaagcagtccaaagagaatgcattcatagctgcgctaaaaacgtgagagggacattagtggatgagagattttcttggcattgcattgaaggacatattagctctgcctgcagaacagttaaggggtgaggcttcagccatatatttgagattaaaggatttggagattaggagtggatgtagggcagaagtcggggtgattaaaggaaagcctatttactaaacatgtatatggagagaattgaagctcctgctgtagatgttagtttataagaaacaggatggaagtgtgttggatgtgccatcatctgcccacttgctccatgaccaagcctgtgactatgaccaagtcctctatgtgaagcctgctaatagacattccccatgtggggcttgcagtccgccccctcattcagggagataggactactcccaagaggtagaaaatccacagaagccacctgcatttggaaactagttcttcagccactgatggttaacagttaattcatggacaccagatgtctgaaaacaacatttatacaatataatattgctataagaaaattgttgtttttaaaaatcaatccatagacaaaagtcaaaagtgttcattatagttacagtacagaaagtaaatcctgtaagttttggcaagccgaaagtagagggatggtgaatggtaaggtagagacagaaaaacagaggaagagaaaaatatagtgacactaatgtccccatcttacacagtgggaagtaaagagattccacctaaaatggatggatcaaataacaggtttaagtatgtgacttaaaaccataatgacagaggtaaaaaaaaaaaaaaaaaaaaaaaaaaagaaagtcaacccatgagccgtatttggcacacagaccttttgtgtttggccagtggtgttctcaaaaagtttgagcaaagatttgcaaatggaaaatgtacatatatgattcgtgtataagtggcttttctttacaaatgagagctggcaatgtttccacatggccacactggcccagagggtgccgtcactgtgtctgacattagtttccaggtcgttatagtccccaccattccaaggcatctcccaacactaaggacaagtgcctgttgccagtgaggaccttgcttttctcctagccaagtctatattcataatgggaaagcaggaaatggacaggaagggcctcgtgacatttcttgtcccagcccacattccctacatgtgtttcctgcccagcctctgtaggcattggagttagtgattatgctataaatgtccaataaaagatctaaaaatcaagtcaaggccaggaagagggaggcaccgtaagccagagaaatttctcatcactcctgtgggactccactaagtgctgtctaaattcttaaatcaagaaatagacacagagcaaaataaaaataattaaaagaaaaaaagattatgtcaagggttatagctgagaagtaatactgttgcacggaggggaaagataaagaaggaaagaaacctttagccattttataccctcaactttcaccttttactttgtacacattcttattgcttgaattttttgtaaacagtagacaggaattacttctgtatattttttaaaagcacaataaaaatgcctgcaagaagactcagtacagctgtctgagttcaatgtccagattctatttgacagatggtcaaagatgaatacacagtttacagtgaaagaagtgtagacaaagtccgggcatggaaaatatataacactgcatttaaaaaattacacaactctgctggcatttaaacaaatggaaatcaaaataccttaaaagtatttatgcacctaaaaaactagcaaaataagataccaagagcccactgctggggctgtgaggaaacaggtgaggttttcctttgttggaagtactgattattggttcagcctccttggggcttagattggcagaatgttacaagggcaataaaactgttgatgtgccttgccaagaattctgcttttgacactataacttaactcttaaaggagaagaaaaaatgtagttgctacaaagatgtccaaagcactatttttaataacaaaaaaggaactagtttgtactcaaaaggagatagattattatacaaacacatcaatgtggcaaatattacataatcacctatttgtcattgtggtagctatatccataaatgaaaatgcgtgtgaataacaaagtaggaagaaaagtagaacaaacactgtgcacactctgatcacaaccatagaaaatccatcaatgtgttcactacctaaaattagaagaggatttggaactgtatgaatagaattattttttgttgtaagttctttaagtgtctgtgtttttaaaatttctcagtgatggtttacttactagatggctggccctgtctagatatgtctgtctctctactaataaggccttaggctcctattgttttaacgtgtttccaattatctcgactgtctgccttgaaatggaaacaaagctgagtggcaaaatgaccgatgagagataaagagaccagattggggttttcttcctcttaactgtatactcaaagtggtgtaggggatctacacaggcatgagcgatagcactgaggtctggttcatttgttcacatagatacaatttctggagagcccaggatgttcagattccttctaatatctatcttccttccaactctaagtaaagttaataagtaagacactactttcataaataatgaccaatgtgagttgagcctcctctgtgctccagactctggagatacaaagaaaaataaaacatgattgctgtcttcagtgatcttgcaactaatgaattctcaatatcaaaacagaaaattaaactttccttcctctatgaagccttttctagctcttctacctcattgcatttctttccatttccatattccaagagggttgtattctgcactctacaatttagattttaattagataattaacgtagtgtgttgtggaaagagccctggactggggttctagttcccacatagttgccttaaactttctacaaaccactaaaccttcccgagtctcacattccttcttataaaatcacgattcagatgatccctaagacgcttcaacatctgaaattctgtgatgtgtctgttgtagtgtgtgttctctgttttacatgcctagtttttataaaacacacctcggtgccagctcctggtagatgcccagtaaaaagagattatttattcagtctgtaagttttctaaatattaatctcttgtctccttaatgttctgtttttatttaagaaagattttgagtgtttagatttgattcattcaagtaatgtttatgaagcactttaccatgagctggctactgtgtaggctgtttgtggtttgaggaggtgcttggggagggctggccatcatttgtgaggactgtggtgttgagatctacacacatcaggctgagagttggaccaaatcatcttgaccgttgctcccatcttcaacattttattattttattcagtgcctatttgtattggagttggtgttggagttttctttgtggtttgttctgatcacatctgatttttaatagtatgccataggtttgtgtggcattttacagaaccccttctagttttgttagagggtagagagtgctagttaccccctctcccatttgtcagcacttggggaaagatatgcagaatgaaatggagggaagtatgtgcatggagggccagtgcctctaagagcacagcaccctccaggagagctcgactgaaggatgaggccaggcctctagtgaccccctcaggattccatttgtccagccactggagggcagagttactggagacttggtggcccagtgctcccagagctcctccctcagtcccttccaggcttcatctactgtgagggtcttcccaacaattggcttggagcacttcctctctggccagaagcctccagttgttctgactgcagactcctggcctggcatttgcctttctccacgatgtggggctagttccccagaccagcactcttcccagttgccaggccctacattccctgagcaggtcccgggatttgcctcttggacttccatcatcctttctaactggagcccggacccctaatctgtcatagtgctaccctgcttcttccaaatgtcacctcttccagggagcccatcccacttttccttgccagttgtggtctctttcctgctgaatcaccctggggctttcctgtactgtgtatctttggctttatgttctggttatttaagtacttgtctctagaatgtgagcctctagacaatctcttattcatctttgtgttctctatagcacctaggacagtgcccggcccgtggtagatattcagtcagacttggttaggtgatggctgagcagggatggatttaaatactctagggcactgcagtcagcccgtgatgccaaagtgctgtcatttgcaaacgtgtttactgggcagcttgtcggctatcttaaggagctgcctctcttaagaccaacagtgtgatctggaaggagggcagttctggtatcatgtgcttgggtctttgtctttaattcagtctgccctctgggctgtagtttcctcatcctataaaatgagagagttgaaccagatgactgtgatgccccttcctgttccaacataacatggtttcataaaaatacatttatttctattttattttattttttgagacagaatctcgctctgttgcccaggctggaggacagtggcgcaatctcggctcactgcaacctctgccccctgggttcaagcaattctcctgtctcaccctcccaagtagctgggattacaggcacgtgccaccatgccgggctaatttttgtatttttagtagagatggggtttcaccacattggtcaggctggtctcaaactcctgacgtcaggtgatccacccacctaggccgcccgaagtgctgggattacaggcatgagccaccgcgcccaaccataaaaataaattttaaacaagattttggagtagggacctggtggttttatgagcatgcttaccagttgaccccactgctacgtgacaggctgacttaagtgactagtttgcaggttcgttcagtaaacactaatggtatgcaggatgtttgtactcatgcaataaacagatgacagagaaaaccaagacactgtccctgtattcaaaggtttgacatcctcaacttgctgaggctctaaatctgcacttcccacaccctctacatgcacatcaaccttgagtgctggcatgtcgtgtgggaatgaggaagtgtgttctgatgtcacacattggacctgatgtctccttcaaattaatccctgtcccctgcctctgctgaagaactctgaaataaaggcgggtgggagatggtgatggtgagaagagacttatgtcctgatagtgatggtgaggatgagcaatagactcacttgttcttctctcatgtggtggcacgctgagtccctgagcaactcctctaagaattgcaggtccctctcagccactcagaaaactccagcagggattacggcaggacgaggtgggggcaggcagagcctgttgagagctggagtttagatggtgagcacagagtcccaagcctgggagggaggttgtctgtggagtgtgaagaacttggctcaacccggccaccaaatgctgggaagcctgacaggggagtgaaaaatgagcctggaagagttggagccaggaaggcaaggaaaatcaaatcaaatctggatcctgacttaaaaggcattaggctgaggggagccaggcacctgaacatactttccacagcctgtcatgctgggcctgcctcatccgtgtgcaaggggacgttgggcccagggagactggttcccaggccaccatcccccagccagtctgctcaggcgcaggcacaaccccatcaaatgccatactctgttgagctagaggacaggagagctgctgtggctcagtcccgaaaggagtggggaaagactgtttctggagcagactggcgccagtcagtcccccacatgcacagtgaacactggtactgaattaatgaattatctgagacaaagctcttttgtcataaactcaagtcatacccaaccccacccccactcttcatttttagctgccaggacatagctatttggggtttgaagtgaaattctggacaccttagtgctggaatcattcgtggaggcactttgtcgagagtggtttctcaaggtgggatcctgcagaagccactgggtgcctgcagggtcctacccagacccactgaggtgagaccaaggaatctgcccttgaacacactgtccctaaacaggttcttctatgagccactcaaggggcagctgttagtctccagagatggaaacaaaggtcacacctgcaggtttcagccgcccctgggcgagcacatgggaagtggctgggcagtggaggaaggggtgactgggcttctgcgtcttgcctgattttacttctgagggtggcgggtctgacaatctcaggccctgggaaggggctgtctgttgatgggctgctcgagcatattgctgacttatagattggtgatttttttttttttttttttttgaggcagagtctcactctgttgcccaggctggggtacagtggcgcaatcttggctcactgcaagctccacctcccgggttcacgccattctcctgcctcagcctcctgagtagctgggactacaggcgcctgccaccacgctcggctaattttttgtattttgtttagtagagatggggattgatgattcttattatcaccattatctccccattatcaccctcccgaggaatcccctagtgcaaatttaataccacagttatactctataccatatatgtgtactggagtatatctgtgtgtatatgtaaaaagagtaagactttttgccccttactcctgagaaccaattatcgcccccccttagggatgatattacccccttgagaatgcatcatcatatagattaaattttataatgcttagaatcttcttctggagtagaggtgtggagtcagaatagagaagggaaaatatgggtaggaaataataaacctggggtaagaatagcatacagaaataagcactgtacagtcttgtattatagttgttagagatgggctgcaaatatgactattagctttctggaaatcattttgtctgtaaaaaataagcccatttgctcaggagatgcagtcaaaggcctaactagtgggaactctggagatcacgtgtgggtatatacacatgtccctgtgcataaacaaggagctgtctggatgctagaggtggcaggagatgctttttgggcagtagactggagacccctggctctgtcattgttctgtgttctatctcccctcctaccctgaactcagatcaccactatcgtctgctccacaccctcagcccagttcccaagctggctcaggccccttctcactgctcttcgcctcatctgccttgtggccctcaggtctctgttctacacttggtcatgcttcctgaacctccccaaagtttcacaggggaagagagggtgagcgcaagactcgagctgtggcagagtgtgggtatatacctcagggtggaccagttcaccttgacctcttcttcagggagcagtggccagccccgtgcttataaacatgggcttgccagagctcaaatgatcaaaaaacatcaggacaggaaatcaagaaactctgtgttgtggggccatggaaagaatagaaagcacagatttcgtagccaggatatctgagtttgaatttgttctgcttacattctctaggccccatagctgagatgggaataataattcctacttcccagcatagttggagggttgatgcaatggcagatgtgcgcaagcacatagcagttgcctaataaaacaatgggcatcatagtactatagtaatacagtcaggatcactgatctgtccacagcaccactctaaatggcttactttgagaatgttttaaagtaaaaatgcaatattctacttaagaaagcagataagcaaaggtagaaagaaggctaaaattacctatggttctgctttgctctcggtctttattattgttttgtttaatcgttctgtcctatagttattttctaagctgggggtttcttttgttttcagcatagggataactacaggatctacaggggcatagtggcttgtggaagcatcacaggccatgggtcagacttgatttttaattcaatcccatcctttaccaactgtgatcatgagtaatttgccaactctccaggtcatgctcctatctataaaatggggataatactacctataatatggcattacttaagtgaaatatctttgctgcatatgtaatataagtgctcagtaacttttagtcataactaaaattattcatagtgttttgtatcctgcttttttcagccaacatagcatttttcaaatcactctgtcaccataattttaatggtgaatattccattaaatctgatatgctaccatttactgaatcattcctctgttggcagttatcttgatggtttccaacgtttccttttataaattaaattttcatcaacatctttatacatgaagtttttaattccatatttaatattatttccttgggattgattagttggcagaagagaggtgaatgggacaaggattcgggcatctttaagcacaagtactttccaagaggcttgtcttcttcagcttgcactgttatcagtaaggaagaagacatagcaccagttttcatggcccacctgctccctgatctgtgagattcaaacttgccttgtcacatctggggcacctccctccaccaactccttcctgccccagctcgtagcttggttccctccaaaccaagaatccttcagtagacctcagtctgtatctgccctgcagcttggcctcttgtcctgctgccacacggggaccagcagggcctgcaggtaccaagcggtcaggagggtgggaggcaggaagccagagagtccagtgagagctgagaccggtaatggcgtctgctggggtggcagagggagcgagaacagcaagcagactcagagatcaggcctgttcatcctagtcgtcagaaagatcaagacagcctagggctcaggagacctcagtgcctaccatgatgcctgacacacagtaggtgattaagaagtgaaaaccaaaggctgggcagtgagagagccgtgagtttaaggagaaccatcttcttcccagaggttcactgactttcactgatagaggacctcattaaatttcaagctaagagactcttccagccacacagggtcgaatgttgaactacttggtacttgtcattcccctttttctcttttcttctctgcatatcatggtcctggcccacatagtcattaattttaatcattccattgaactcatattcttatttagagtatatttgtcaatttgtcttcactgggctccagactaggagcctttgggttggatactgtctcccctaatagagagtgagcatcctaaggcaggtgccacatctactgtactgactctaaaataggtgcacaacaaatacagagctgggttctaagaggcatgaaatgctaagactcagttcttgctcactaagcattaatgcagcctgattgaagtactaaaatgtatgtgcatgcacacactttcctgaacttacatttgttttgtgagatctgccgatgctgagagccaggtgaggtaccccatgcctataatcccagcacttcaggaggctgttgggggaggattgcttgaagccagcagttcgagaccaccagcctgggcagcaaagcaagacccagtctctacaaaaaatagaaataaaaaaaattagctgggcatggtggtatgcaactgtagtcccagctactgagaggctaaggtgggaggatcacttgagcccgggagttcaaggctgcagtgagctatgattacactccaacctgggtgacagagcaaaaccccatctctaaaattaaaaaaaaaaaaatttaccatgttgaatctgtcttttccatcttccctattagagtaggcactcattgtgggaggagactagatccttaaccttctttgcatccccagtgtctagcacagtaacggtgaagggtgctcaacgagcctttatccagcgcataaacaaacactagtagtgaacaagaccctatgctctatggtcggtatattaatacaataaaatgtgcaacaaaaaatataggaaagaagcattcagaagacctcatgaagaaggccggtttcattctaggcctttctaggagtcattaatttattcaattacaaaataagggtgtggtgtttaacagtgctcttgaagaatactcctaaggggacactggtgaaatatcttgccaaaagactaggaagccttgccataactttttgatacttggaactttcttgcccgtgattctgtttgactcccctgaaaagtagtgagctatggaggaacaagcctgaatctggggaccttgtgtaaattacttatcttctttgagatttttttttcttacctataaaattagtatggtaacactgaccttacagcggtattgggaggattaactgaaatgatttgcataatgtagcctgtacttcccgagaatgaacgcccaaccccgtccatgcttgtacagcagggggaggagtaactgcctccggaggactgtgatgcagtctccactgaccctgcaaaagtattgtaacctctgcctgacctgcttgtaggttgcttaggaggagagctgagaagtgacaggaaaaaggttttgtatgcagtttatgagttaagagaatattacttaattgtgggtttgatggaaaacattatgtgaggttggttcagatctttccagaggtctgccagcaacctcagaagtggagccttattgaaaacagctggggagaaggttggcgcccagcctctccttgcttttccatgccccagagctgtctcactcagtggactgagctcagccccaggaccctgccaagggctctggcagcctcagctggagacaggcagtggctctgcccagcttggggctccatctcaaagatcaaaaccagttaagccaggagtttgccaggccaccagtcagtatttcttccaggtcttgaaattagccactgacttgagttcttgcaggatgagttaaccagtgcaacgttttcgtggcaggggtgtgggctgcctactggatgtgtgatggatgggctgtgttgtcctttgaagtcctcccagctgtcctgctgggcaccagctagagaatgaggatactgttcaaagcacagccctcccatatgtccattcagaagcctcaccctcctctgctacagaggcttttctatcggaaggctgctagctttgctacagctgaagcccatttggttttatcccaactactcaccaaccatgtcgatttcagctgaattttcttgaagacaaatatggcatgccactcccttattctttcatttcaaagggacatttagtcactgccagtctcttgttttatttactttctaaaaatgtgctcctactaaatttgcataatttgaatttcagtaagtaaaatttttaaatttttttactgttcatgaaagtaaaacgtgttccttactttaaaagttttgacatacagaaagtatagaaaacaatcccaccatccagtgatgacagctatttacacattagtagatttcctttttatttcttttttttctattgtaacaaggagaaagtaaatcgttaaaagttacattatggatattaagtaactggttttatatgctgcctttttagttaatgctttctcatattctttaaaattcttcaagataaatcttaatagttgtatagtattttggtcttattatttcaaatagactatgtttttgatatgttgatttctaatatttaatcttttaaataaacataaacatcttcatggacatctttgataattcctaagagatattagaaatagaattattgaatctttttaagtctttggatagctatttccaaattgttaaaaatagccttataaggtcaacattactatgccaattttataggaaagaaaaatgaagtttaaattactacccttccttcagcaatgtttaagaatttaattttctcacactcataagcactagttatcactttacctattaacacgttttttaaatgaaacatatcacattttattttacgtttgtttgattaattttaaacatttttatatgtttggctacttcagaaacttcttgttcatgtcctttacttttttccttctgtgttctttttatttagtcatgcaaactttttatatcttaaaaagttcaccttttttacacatatatttgaaatatttttaatttgtttaccttttaatttttatcctaagtttacttttgtacagaaattttaaattttagtgttcacatatctttatgctttccactattagtgtcatgcctggaatctctaagattatatccacatttcttctacctttttttacttttaacattttaatcaaaatggatgtttctgtgtgtaatgtgaggaagggatcttgaataggatttttttcaagttatccacacttactgaataatctattcttttcccattagtttgaggccacctttactgtatactaaagtcttatgtatagagtttgttttagcatttttctggactatttcattagtcaatatgtgaaccaaaatggttttaataattgttgctttttaacattccatatctaatcatataatcctactggttacttttaatacaaggacaaagtatttctctttatatatccaagacttctcgtatgttgtttagaaagttttgaaactttaattatataggatcttcacatttcttaaatttgttcctaggtgaagtgcatgtgcatacctttcctaatcgtaatagctactagatatggaaacagttttaacttttgagtaggttataactggctaaagccaatatcagaggtgtagacggttcccaaattatgatagttcagctttacattttcaactttatgcaaaaatgatacccactcattagaaaccacacttcaagtacccccacaactattgtttttcactttcagtgctcaataaattacatgagatattcaatgttgtattatataataggccttgtgttagatgaatttgccaactgtaagctaatgtaagtgttctgagcatgtttaagggaggctaggctaagctatgatgtttgatggagtcactatgttaaatgcattttcaatttagaaaattttcaacttaggatgagcttattgggatgtaacccatcataaattaaggagcatctgtatatgcatagcctttaatgcttttatcattgaacaaaaattactaaaaattagtgagccaatcattcaactcgcaaaatcaaagactagaacaagccgaaggaaagcagaagcaaaacatttatataaaaggagaaatgattgtattacaaagagaaaaacaatatttaggaataaacttaaggactggtcttagaaataagacataggcaaaccctactaggccattcaaagaaggacagaaaatatacctaacatttggaaatgggactctaaccactgatctgtagttgataaaaatgagattttcagggtaaactccgatttgaagatcttgaaagaagtagatgcttttctaagaaaattaacttaaaaaaagttgaaaacctgaaaagttcagtggaagaaactgaaacagttgaagaaatatatcctgagaaagttctggatccacatagttttatagatgagttcattaaaaccttcaaggagtagatcattccaagctctgtatttgtagcacaaaggttatttacagtatgaaatggaatatttctttcatagtctctctcacctttatacattcagttctgtgaaattcttggaaaactaggattggggttgtaaggcatcttagagggtaggaaggcttcttttgacaacatcccagccagatggttctccagtcttcttatgaacattctggggacggggatctaccgtgtcacagttggtccatttggttgttgaggcattgctggtcttacttatatgaacctaaatctgcctctggagaattatggaccgatttatccttggtctgtcctctggcactacatagcatgtagacttttatacaagagctcatcatacatttgaagacagatatgccctccttttggtgtgttttactccaggctaaatagaccaacttccatcaactatactttatgttccttcaataaacatctgttgagcacctaccaggtgccagccgggcactgggcatcaccccctcacacaccttgagccgcttcctcaatatcctattaacacgtggcacttgtacctggacgcagtctgtcagtgatgcccatgtggaatgggactgcccactccctgtgtggacaccatgctctgttaatatggcttaaggttaaataatgtttaaaagactcatgctcggctcctttcaatgttagctgcccttccacactaattttgtctagttgatgatttagaaccttcacaagacttattctctcctaatatatcttgattcggacctttgttttattttattttgagaaagcattttgctcttattgcccaggctggaatataatggcatgatctcagctcactgcaacctctgcctctgaggttcaagtgattctcctgcatcagcctcccaagtatctgggattacaggtgcccgccaccacgcccagctaattttttttttttttttttgtatttttagtagagacagggtttcaccatgttggtcagcctcgtctcgaactcctgacctcaggtgatccacctgcttcggcctccaaaagtgctgggattacaggcatgagccactgcacccggcctgactttgttcttttagaacattgattctatcagccaatatgtatactcccaggattaatgccagctttagtactcgtgagcagccttgcagtccattcaagtaataaattcataataaataataataaattcaacggaataaaaatgttcaacaaaaacaaaagaggaagtcctgggacctaccagagagaccatgacattaatttaaaaatacttattgatcacctactatgtgccagtcattgtgctgggaattggtaattcaccagtgagccaaagctttgtagctctttccacagacagttacagtctagtgcgattagacaggcaggagtgactgtgcacacagatgaattataagccgtgatgaggcccactgaaggaaaacccagggtgcagtgagagcataacagcatgacttagtttgggaaatcaacaaaggtgtctctgaagtgacacccaggctgggatataaagattggagaggagagacatcagtcagctagctactcagtgctgccaaaaggaagtggccatgctgagtgtggagacaagttcagaataggtgtaatgcctgtttccctctcatgagtaagtcacagtcttgcagtaagttgtgccaaatatacctggaatgaatagaaacataacccgtgttactggcataagggctgtcacctcagattgtcatgagccattctggtttaaaatattctcatttttccagtaaagttatccaaatatgcttggagttccagtattttgatgttgaaacttttatagcaccaactccttcttgcacctggaggctgctcgtaaatctctcatcagataatgtatcctgatttttttaatggaaaatatggtcctgtgcttcgtgtagggcagagagaaatgtggaaggtgatgtcatggtgattagttgtctcagattgtctgggacaggcctgattttaagtagtctgaactgtgatcagatcaacatgcactcgtttttaaaatgtgaccactgtagataatagtgtagatgctgcaaggaggaagcagggcaagatcagaggcagccagagtaacgggaggctctctagaggcagagcaagtggtcctggagaagcaggcagagagggggagagtgcacttgcgtggccttttggaattgctcctcgcttggctctgccagcagtgcatatttctaaggcccctatcctgttcaccagacagtgtatggtgaagatgtttcgaaaggacacaattaggaggaaaaatctgatgtgtgacacatcccatagacaaatagaaatagaactatgattatccccttttgcgacaaggaggtaagtgaaaattgattgtatcagcatttagccctggctttagaatattatttttcagccttacaaacaaatactacctacttagaggtggatctgggtccccagtacctaatctctaggtgtatttagagaactaggcccactgtggccaagggccaggagcagcagtggcctgagccctgcatggtgttaggggtctttgccttagagaggggctgggtgggtcattcaggtcagggctgtccttactgaatgggtcttcccttcaggtgacatagctgagcagtcagtgctgagaattctgactctgtcctcacctgcatttggtggcagtccttcccaggggcagaagaaacagctgagggccagggaaacattgcttttttcatttccccctgaccagcaaaaggaagggaaaaacaccaagcttggaaaggggaccctgaccctggacccagttgtaaagctcttaagacagaaaacggctttggaataagcactgctctcatgcttgcgtcctgcagctgggggcaaagggctctccaggcatgcctgcttcttttgggctgcaggttgtcctggttcccctcagcttctagggcaacagccctcctggacagcagtgtcagccgagtggtcactgtgagaagctgctgctgagaggccaggagttcggtcagcattcccagagcctaggggctccttcagaagccaagtggtgatggtaggagtccaggctcccttaggctgaagaggactctctagagtgtaacaagtttacagacccttccaattcctaacccgaagctggcccttttaacaacacaaaataaagtcatcttctcaagggccaccaggcctctctcagcagcccactcccctgaagacacccacaggcatcattcatccttagcaagtacttcctgtcacttcctgacacccccatgggactgacacccacccatccttacttcttccccactcctcagacctggaggtcactatggctaacgtgcttagtgcagcaaaggccttagggcagctctggcaccagccatgcatttgtttttgtttttgtttttgttttgagacagagtctcaccctgtcacccaggctggagtgcagtggcgcaatcttggctcactgcaacctccacctcccaggttcaagtgattctcgtgcctcagccacctgagtatctgggattacaggtgcaagccaccatgcttggctaatttttgaatttttagtacaggcggggtttcttcattttggacaggctggtctcgaactcctgatctcaggtgatctgccaacctcggcctcccaaagtgctggaattacaggcatgagccaccacacccagcctcatgcatttgtttttaacagacgaagaatgagttgcgctgcgcctgaaattctctgagctgggtggtctgagcagttgtctgtactgagaccaagccctacctgcaggcttctcaacccactgcttttgtctaacagtggctcagctgggccccagcccccgccaattcttcctccccgaggatcacagacttgaaagggacactggcgggaggaggaaaggaaagtttgagttttgttttttactacgtaactgggcagcttttccctccatttttccagatgcttctttagaaaagagatttcagtggcatggactgggaagtctaattctgctttaaatgtgtgttttgaaccaggactctgacccctttggtgctccccagcccccaaacaggccaccaacaaatacccagagaacaaccgcaggcaaggtttgctcacaatgggtcctgattggagggttgttggtatgtgtttcttttcttttctgcaacccctgggccattgccctaaaattcctgagcaatagcttgtgagagggctgtgccctgtggaactaagttggcaagagccaatagatcaggcggaagtggctgaggagagctactctggttcagcaagagctgtttatgtgctggcacgacctggaatctgcctcggctcacaacctggggtctccgaggacccctcctaaggcgggcagggctgttgggagctatctcgcttctagtgcaaactgggttcaccctttccctacaaacccttgggcgccagccccagccctgtaagtcacccctactgctgctcccctggggcagatgctatattaagaggtggtcctcccttcttgctcaactcacagcaacacctctgtggagccctcaccctcctccgtgctcccatggtcctcagcacacacctcttacacagccctgactgcatgtgctgtgggcctcgaggctgcgagccacttctgggcggcctggagcctgtgtggtcacgaggcagagaagggggaatgagggtggagagaaataggcaggccaggtcttattcatagcacaatgagaactcattggaaattttcaaaacagagagtggctttggtctgatttatttattataaggcagtgtaacatttggcaaagggataaacatatagctaattgaaacagaacagagagttctgaaatagatttttatatattggctcattgacttttttattgtggtaaatacacatgaaatgaaatttaccactttaaccatttttaagtggacagttcagcggcactaagtacattcacattgttgcacaaccatcaccaccatttatctctggaaccttttcaccttgtaaaactgaaagttcccacccattaaacaataacttcttacttcctttccctctagcccctggcaaccaccattctactttctgtctctatgaattttactactctaggtacctcacataagtggaattataatgtatttgtgaccgtcttactttacttagcataatgtcttcaaggttcaccagtgtagcatatgtcagcatttccttcctttttaaatttttccctatgtaatgccaaaccacagaaccttcctttttaaggctgaataatatcccattgtacacatatatcatattttgcttgtccatttatctgttgatgcacatttgggttgcttccactatctggatgttgtgaataatgctgtcatgaatgtgggtgtacaaattccttttttcttttgttttttttcctttctttttttttttttgaggtggaatctcactctgttacccaggctagagtgcaatggcgcaatctcggctcattgcaatctctgtctcctggattcaaacaattctcctgcctctgcctcccaagtagctgggattacaggcatgcgccaccacccccggctaatttttgaatttttagtagagacggggtttcaccatgttggccaggctggtctcgaacccctgacctcaggtgatccacctgcctcagcctcccaaagtgctggattacaggtgtgagccacgacacccaacctgggtgtacaaatttcttttcaagtccctgctttcaattattttaagtatatgctcagaagtggaattgctggatcatatgataatggaactttaattttttgaagaactctgccattttacatttccaccagcagtgtgcgacggttccaatttctccacgtctttgcccatacttgttattttctattgctttttttaaaaataatggtgtccttaaaatgagtttttaaagaaagaaaatgaaaacttataaacctatgaggacagaaagaatgaggagagacaacagcaaatgagagatgtcaacaaactcgtggatgatggcatgtgaatagatggttggctgagttgggtttcagtcttctgacgcgctatgcctgtggttaggagagtaggcaatgatgaagcaattggaagatgacatacttccagagcctgggttgcgaagtgaagctgaaaactggaagatgaaagatctgataaggagcagtgaggccccggttccccgctgtagtccatgccccagacccctctcctcctgtacacccaaggagactgaaagctcctccgtggagaggccaaagctgaccagctgtcacgtcctagacatgaggtacagctgcaggcagggcaaagcgttgtactcaaaagggagaggggccgagtgaaagtcagcatgtggaaaataaccaacttaccttcccaccctgcgatggtcttccctcactcagtgtactaaatgctggtagacagacttcgttgctgtacccaccctccaccccacaccaccaaagcagcaactaggaagatgcctttttatggaaactgattatctcaagggagaagatctgcagatattgatgttgatgttttaatttcaatccctctaccatgaggtctgacacattgacaggtcccatctgtgcacctggaactttgtatttcctcacttacatacaggaaaaatcagtaaaggatcatcagatgtccaagggaatcctctgttatggaacagacataaagaaccgaacaaggaaccaagtagaaacagaagactgcaggaaacagaacttcaaagaagtttctctcacctcagagataagatgttatgtctattaagcaagaagagaagacaattcaaaacaattttgagaaactgaaaaagggttttttgaagttaatgatagccaaaataataaattcaatatactagttggaaaataaagtcaaagaaatctcccagagagaataaaaagactgaggtagaaaaagtgtgaaaagaaatgtaggtcagtctaatagggctcatgtccagttcatgggagttccatgaagagaacattgaggaaaacagtagagagagaattctcaaaacacaaacattcctcaaaactgaaagacatgcattgccagtaatgaaaatatctaccaacggtctgacggacagtgaacaaagacccacaccaagtcaggtcatcatgaaattctagaatatcagaatgaaaagaagattctaaaagtttgaaaggaaaacacacacacaaccccacacacataatagttcacagatgatggatcagggagtccgtgtggcattatgcctctcaaacagcaacactggatgccagaattgccttcaaatgccacgaagcagtatcttcagagttctgaagaaaaaaaaaggtttccacttaaaattccatctccagacaaaatgtcaattgagtataaaggtagaatgtggatacttttggaaatgccagatctaaaaattttaactttccatgcattcattcttagaaaactattggaatggtattctatcaaaacggtggcatagaatgagaaatttccaagaggatggtgagggaatgtcccaggaccactatgcatcaagcccagaaaacatccagtttagattagaggaggatgacaaaatgttccgggagggttatctctaaaggagaaaaaaataacagcaactgatgagttatctgatgcatttgaccattactgagaagaatgtatggttctcttaagaagttggagtccttaaaaaactaaggatatcaaagtaaagcagttattaactccaggaaaaataaaaagttcaagatatttattgtaatatactatgtggcatggcagtgagcaaagttagaatgtagtgaagaccacaatttttgtcatgtcgatgtgtaatgtcattttgtgggggtaagggatggatttatgtgggggcagatttgagagcttaaagtttacattccatacagagaacttaagagattgtcttagtccatttaaagtttgtgctgctataacaaaataccacagaccgagtaatttataaacaataggaattcatttcttacagccctagaagctgagaagtctaagatcaatgcaccacttggtgagggccagtctttctgtttccaagagagcaccttgttgctgcatcctccaaaggggatgaatgctatgtcatctcatggtggaaggccgaagggcaaaaaggggcaaactacctccgtcaagcccttttctaagggcacttaaccccttcatgaaggctctgccctcgtgagccacacctgagccacaccttctaatgctgtagcattgatgattaagtttcaacatgaactttagaggggacaaaaacactcaaaccatagcagagataatgcataaaattaaaaagaataaagtaggccaggtgcagtggctcacacctgtaatcccagcaactttgggaggtcaaggtgggtggattgcttgagcccaggaaattgagaccagcctgggcaacatggtgaaaccccatctttaccaaaaatatgaaaaattagccaggcatggtggcatgtgcctgtggtcccagctacttgggaggctctgggtgggaggatcgcttgagcatgggaggtagaggttgcagtgagccaagatctgccactgcacttcagcctaggtaacaaagtgagaccccatctcaaaaaaagaaaaaaaaaagaatattagttgtgtaagactattgtttaggaataatggaagaaatatcagaagaaatgactaaaagcattgaaggtgattgccctcaaggaagtggaaatgggagtgggagggcggcctgctttcttatgacttatagtaccaattcacattttaaccaggtacgggtgttttggtgaggataaaaatatatatattttttgaggcggagtttcgctcttgttgcccacgctggtgtgcaatggcatgatctcggctcactgcaacctccatctcctggattcaagtgattctcctgcctcaggctcccgagtagctgggattacaggtgcccgccaccatgcccagctgattttttgtatttttagtagagacgaggtttcaccatgttggccaggctagtctcaaattcctgacctcaggcgatccacctgcctcggcctcccaaaatgctgggattacaggcgtgagctactgcgtctggccgagaataaaaatattttaataaagatctgggtttttttagcctaatggccagtcagacactgacattgcttgagaaacaacttttgattccttctctgacatgattctctatgcaaatcatgatgcctttgggcagcttgggacatggggcagacattcaagcataaagggacattttcatgaggctgctgtctgccacttgtgccaggtattttccagcagagtcaaagagatgctctcctggccacatggatacaggtggcataaaagatcctgctttcatagccccacctgctccactccgtccctcagagccgccacctgggagagtgagcagaatgcatgctttgtgtggtggattctgacccaacgtggagcaggtgttgggtcacagagacaggctgcagagatcagaaattctgaaacaaagccaaggaagccaagtcatgatgttctcagggtgttgagaccctcaggtcacttttgcccacccttgcttttaaacagaaattgtcagagaataagacagaacaatctgtggccagtgtctgagtcttgggcagcaggctctgctgatggaggggttatagtctctgtgttgtttggggagcagccctccactccattcctactgccagtgaagtatgtctctccctctctccaggtccaatcatgactggctaaaaactccagatttattatccagatttatttcctgacactcacccatccttcttgaaattccagggctgcattagtcagtgaggcagaaatccaggggatggtctctgtctccaaggctcaaatggtattttgggagtggaataatggcacagtaaaactgcagactggatatttgttttaaaatgtgttttttaataatacataaaaacaaggatcacttttcaaattgggtttcggtctttaaataaaaataataagccaattcaaccagagcagaatgttctcagttaaagggttagatttttacctagttaagagtgtgatgccttgaagttgtctataagaatgaaagttgtgtaagatgaggcataccaagcccataagtttatatgttctgatatttcttagggcagaagtagtttcatgccattaacagagctgggagtgaaatggagtttagggtacctcattataaaaaaaaaattgttgactttgaagaaaagaagagaggaaaagtctaacctttagaatctattaatgtggtattgtacatgtgctatctcagttaattataaacttctcagccaggcgtggtggctcatgcctgtaatcccagcactttgggaggccgaggcagatggatcaccttaggtcgggagttcaagaccagcctgaccaacatggagaaatcctggcttaactaaaaatacaaaattagctgggcgtggtggtgcatgcctgtaatcccagctactcgggaggctgaggcaggagagtcacttgaacccgggaggcggaggttgcggtgagccaagatcacaccattgcactccagcctgggcaacaagagcaagactctgtctcataaatacatacatacatacatacatacatacttctccatggaagtagattctgatatcatctgcactttgcagttacgtaaactcagagccaaataagtaacttgctcaatgtcaggcagctgatgattgatgcagcccacatccacacatagatctgtctgactccaaaggccatataccttcctgaagtaagtaggtgggacttttttttgcaggtgacagaaactccagctaggttaagcaaaagatatgtattgtctcatatacctgagcgggtccagagtctaccacagctctgtcaactctgtctccatttcttctcttcactgtatatatcagctcttattctccagatggcttcctccttctgggaggaggcaagaaaatagataatggggcttgggagagaacggctgcagataggctaagtcttacatcttctcagttttgggtctctgtgaaaagagacagctttggtctctcaatattcaaagataaagttgcagggaagatctctcattggctggcttggaacatatgcctattgtttgagaccaagtgctttggccaggaggcattttaccaattggcatccccaccgggtctaacacataatgggtggaaagggaggaggcacttcctccaaaggagaggaatgctgcttacactggcaggcaggagagcctagcaaatcaaaaccacgtcaaaccacagcattaatttgttaaacctctgcaatgccacatgcctctcattaatacttaatatgtctgagagtgcatctctatttggtagcagaaactggagagctgccacagaagagtgatctcctgggcttgctcctccagctgaagacacagtatccgtggagacccatggtgagagtacagccagaaccccaaagttttgtgtagaggttctggaaagcctggagccccacaactatcccagaagggctgggagttaaaccagaaggacatctgttttgctatgaaaacaatgcatttgggggaacaaggaaggtatcaacgtgagaagttgcccatcacacttaaaattctatgtctttggccaggcacagtgtctcatgcttatgatcctagcactttgggaagccaaggcaggcagatcttttgagaccagaagttcaagaccagcctgggcaacatggaaagaccccatttctacaaaagtacaaaaaattagctgggcatagtggcatatgcctatagtcccagctacttgggaggttaaagtaggagaatcacctgagcccaggagttcgaggctgcaaaatgagctgattgtgccactgcactctagcctgggcaacagagtgagaacgtgtctcagaaaaaaaagaaagaaagaaagaaagaaaaatctgtatctttgtttggctgctccaaagggttttagatgcttatatcattaaaagggaatcaaaaagttgcatgtgttgataaggttggtctagataaaaggaaatagatctttttgattaagcggtccagaagggcttgaattgtaacccccagctacggagctataacttgccttgtgttttcagtgacagaaacaagtcctcagccttgcagatgtcgaggtgcagggattcctatgtctcgggtcataggaaaagaaagcatgccataggaagtgagagtggctgatcacagagaaagagactttgagcatctgtccctggagacccacatggcatttgctgagccattgagaggaacaattctctgcattctggttttatttacacggaagcacttttgtcctcattggtttacaagttggacatgggggtggggagcatccagcagtttaagcctctcactaattgctgtttttagttggtatggtctcttcctgatgggttctgtgggttcagttaaggcttttgactgttggcaatgggattattcaaagccttaattaagtgcctgcctgcttatggggctgagtgccagttgctgacacagacgcaggctctgaagcttggtcatgccatgcccctggctcacccttcactcttcaccctcataacatacccatgaggtaagttttatagacattttctgtggtctgatttgtttggggtgttaatgttttccttcttttttttttttgtgcaaccacgtccatttattatctgagtgagcttatacttggagatggggcagaagaagattgattcttcttcagctaatccctcagcaccattggttttatttcctactatttttcagtttttaatcaccagtcctcttctagtcttttatcataggagaaacaacacttgtaacagggtaagaagttcacagtaatgtgttacaggcaggcaggcaacaatcatgaatacatagacagtgttgcagaatgaggctttgtcagcttaggggagatgtccatctagaagaattccttaatgtcccctcctccaggcccagcctttcccagcatcccttcagttacttaacaatcaagtaaatactcagtggcaacccctcgggtctgttgttcccagccctaaagattcttcagctcactgctcatatcttcttggtgcatcttcccaatccccagtgtcctgctgggcagtctgttttctccctggcctcagctcaatcctgctttctctccttcctggtcttcctccatccctgatgtgggcagagcctcagttccttcttcctgctcatgtgacctatctgcggttgggccaccgcagctgtgccctgcagctgtgtgggtttgtagtgtgtgcattgcgccaggccctgccagacaaaaaagacatgcggcagatctgcagaatcagcacaatcaccccctttctgctactcaccaagcttggagaagatggatatgttgctttgagtcttggaggacctatagggacaaagaatttgcccctgctctgagcacaggctatggtagcccgtcctaagcaactgaggataagttgaaagcccttgatatatgttagagaaaaaccaaaatgtttagtgctctaacagatgttttgcttttagtcattaagtaaatctcaaggcagcaccaggttctggaaactgcctctcaagtgagacaggcaggtagaatgcagtggccaagcgactgcctgcctgcagctcagctttctcctcaaccttcagcaagcacagaatgagccctcattccttttaaaggccttttgaggccataaaggtttttgaggacattttatgaagctggagcacagttttactatttaaaattattataggggttatggtgactatatctttatttttatgacaagttgttggttatacccttgatttatttgataccgggcttttgttcaagaatacaacctccaattaaatgtggttactgtgtcaagaatgcgattctctccttagagtgaccctctttggtgccatttccaaaactcattgtggtgaaaactcagggctgtctattcatgtttgtgagcatttcttctgtggttacttggttttctcatatggaggattagagggtactaaggctgtgggttggacccagaggagaatgcaggggaaaggaaagaatcttccctaagaagctaagtgggtcaccatttaaaaccataatacttcagagatgggaggaaccttagataccaaaagcaatttcctccttaatacaaggaaggaattacaacccaagaaagctaggacaccaagccaggcccagagtgtgcaggccttggcttgcatactagcctctctgtaccacactgactctcctaggggtgtcttaggtacacacctggcaggcaccaatcctgtcctattacgaaaacaagggaatagcccaagacttgcttatggtgtgattataaccttggtgaaccatttgacactttccaaaagtggggagcagatattgctttaacctataagggatttagggtctcttggagatagacgcttatgaatacttttggttctacagaacttacctcaccaaaaacatgaatttacgatgaggcatggagacaaccactcaacctggaaaccaaaattatggtctccaatctgccatttaagctgccatgtgagatcatggcaaaccatctacttctccaggcctcttttctaggctacatgggcccagtaaaacgactggctttgtgagctgttgtggacattgttggtgccctacccgtataccttcattaggcccattcccagctgctgtgagtgttggtgaggacttgcaggaaggggtctctgaagccctatctgaggttctgcttctgggtatccaaaccaaagacatctccgtcatagctgcaagagtcaagtaagagtctatacatggcagccctctgaaaactacaggaccaaagagtttttactggctcttgatgaagatcctgactgtaaaaatcccagctatgacttcttggtggaaggccagtgatgacagcagataaggcaacctgggagggcagggctgttgtcatgcatcccaaggatgtgaacccaggcttattccttcaccacccagaggtccagggtagtggcagacagtaaaaacggattgattttccatattgggagggcaagtattaaagtttcaaatcattcagaccttggaactgaacaaggtcacaaaaattcctgcctttgcttcaggtccaatgtgctataaaagtatcatagtgaactgcaactttcttaagtgatgccagtttcagcatattttcaaatccctaaatatttattttaagagggcatttcagaggtaagcttggggtatgtgtagaaagtgagaggaaaagagaaagagacagaaggattgtgtccctgaggtctggaacgtttgcaatgtccccagttaatcattgatgccccagagcccagtgagccaccagagctggccctgctgcagggggccagtatgcttgctaatggaatgccaggacgcctttggcgcagttaatgatttacctcctcctagttgcagtgcttggcactcccattctctgaagctgatagaagcctgggtagaccagccctgcctaatggagtgcaggagaagacaatgatggtttgcagattcactgtatgagcagagtcctgaggggccaccttctgtaggaaagggtttcacacgagaagaatactttaacagtgtaattgttgtctgatgttcccatgcatgaacgtttctgcctttagggccacaagatgacatgattttatatgggcgcatgacatctgtcacctttaaacatgcataacatttatttgcatggctcttttatttccgctactagatttaaattccttgaggccctcaacaaattaatgaatgtgctatatacattcattatacagcacactaatataaaagaaatgcattttttaagtaaaattcttttttctgttttgcaaaggccaggtgtactattgcagaactctcagaaactaatagttaactaaaaagaaaggaggagactcacaatcctaaccacccagagacaacagctgttaacacaccattttatattacagtggctgtgagaccctgtgcatcccaatggatgcggtctccttcaacactgtcagcctaagttctggaacacttgttttggtgaggctacaatggcttcaggcattgttcacatggcttttggggaatccactccagagtctcagcatttcctccaaagtactcaatctctgtcatgagtatagtttagattttgataggaaagggatatatttttgtttccagacattgtaaataagatggaccatattgatttggagttttattgttgtttctttttcactgaagcttgaccacaaattagtggggacagaaaggcagtcttgtgagattcacaaactggcactgaggggtgactatatggaataatcaaagagggattgttcactttgggagttttccctgttattcaaggcttccttccttaggaagaaatctgcatcctggttacagagactctggtctaagggtgggctaggggctgagcacctgggaagaaaactgagcacagtccaaagacaacgaccggcgctttttagcatagctctttcctcgcttagtatgcttagggaagagactgtatttggatgcccaggcctgtgtgcacatgcgccaatatagcatcactctgtgaccttgcagggggtgtgagtaggattattgctacagatcagtgaagcctttctttgtaaatgcaatttgggggtcattcagtgaattttgattttgcttcatccgtatccattctctctttccttgaagtgaatacatggataaaactattgctaccactgttttgtaatgcaaacaactttgttctcaggaagctcctatgatgccttctactttccagtgctaaaatccccaattctgggtccttggctgtgcattagtgagccattctgaaccctaatcctccaaagatgagttaattctgaagagcctactgagtttcaagtgtttgaaggcccttgggggacttcctttctttaaaactcaaagtgaattcttttctttgaatttatctctgcattttcccctcttttgagagatgtcttctctctgactgggttgctatgaaactcagatgattgcaccactgtactccagcctgggcaacagagcaagactccatctcaaaaaaaaaaaaaaaaaggaaactcagatgagccaagtacttagagaagtgctgaacccttagcactcagcaaatgtcagctgctaactacagttagagaaaggcaagtggtctagagcagcactaccccataggactgtcacaaggcctggatgtaattgtaacttttctagtagccacattaaaaagtagaaacaactgaaattaatctgaatacatttaattcaacatatcaaaaatactacttttcaacatctaatccatatttttaattattgagatattttgcccttttttgtattgtcttcgaaacccagtgtgtaatgcacacttacagtgcaactcagtctcactggccacattttgagtgctccatcgctacctgtggccagtggctaccgtgctgggcagtgcaggtcctgaaccttgctactcaaggtgagttccagggaccagcagcatcagtagcatctgtgagcttgtcccaactgcagaatctcaggccccagcccggacctgtagaagcaggatatgcattttaacaggatcaccaagtgatttattagcatgttggagtgagaagcactggtctagaatccccgtactcagtcctggccccctgggattctaatctaattggtctaaggtgggacctgggcactagtgtttttttaaagctcccctggatgattctaaaatgcagccgggcttgagagtcatttgcatagtggattctggacccaggatgcctgactttgccaccttctacctttgagaccttgggaaattgccaaaactctctgtaccttgatttccttatctgtaaaatgaggatgaaatgggggcgttatgaggattaaatgagttaacacatgtaaagcactccaaacaatacctgacacagagagagtactcatgaaatacaggctcttaccctttcttctttttcttgaaggtccggggttacccagagccccaggtgacatggcacagaaacgggcaacccatcaccagcgggggccgcttcctgctggattgcggcatccgggggactttcagccttgtgattcatgctgtccatgaggaggacaggggaaagtatacctgtgaagccaccaatggcagtggtgctcgccaggtgacagtggagttgacagtagaaggtgagtcccaggaggcccgagtccaggagggagctgagctctcagttaccccaaggcctgcagctcctgccttagccctctcttgaaggatggaggaactgacaagagaaaacacaccccatccttgaaccccggaccttccaatctaatgggagagatgtggtccctgcgaacaagggaggcatccaggagatgatgtttgtcaaactaggtatcacctgtctcctgcttgagccctcccatggcttcccctcacactgcagctgaaatcagactccttaggatggtcttacagagccccacccaatctggcccctccctagctctcagacccatcttctgccactctgcacctgttcagcccaccgtggtcacacccacctctggcccttctttgagcaaggctacagggccttcacccttgctgttccttctgtaaaagaagagcccttccctcagcctctcacctgacgctcctttcacatccttcaagtctgttctcagatgtctgctccttagaggccctttcccaaccatcccagccctatgactctccatcttctcaccccactcgaggtttttcttttaggacgtattaccatctcacattgcagtgtcttctccatcccccaccactaaatggaagatttaggaggagatggactttctctgctcattgccttatctccaacatctagaaagcttcctggcacatggtagatactgaaatatttgaggaatgaatgaacaatgtttttatcctcattaacatcatctttagcgtcattatgaaataatacatgctcattattaaaaattatgtaactcagaaaaatatgtaggaagtaaacacatcaatgtgttaacatattagttaaaagtaattgcaaaaaccacatgacttttgcaccaacctaatatttttgtctttttccccactctgtactttaaaaaattctgttaactttaaaacttctaggagaaaaattggaccataagtaaaatattttttgctactagtgtgtccttctgccatgctgaagccactccactggaaagagtatctctagttcaggtccctggctgacacttaaagccttgatatcaggaaggacatggggtctgtcagcccctcagaagtaacacaaggttcccttgacccttcccggtctttctaagactggaagtttataaaccaaggctcagactcacttctcctctttcagaagactgtcctcccaatctggttttcaggggacactagatggagaattaaggtagtcagggaaggttccagaagggggcgaggtgcacctgggccaatggccgccctttgccctgttttccctgtctccccacaccacagaagggccaacaggctgtttcacagagtggagcatgcatagtttggatgctttccttaaattctttaactgagtgactcacttactctaatgacctttgagtgcttttggctggggcattccagatggaaagtggcccctgctcagaacctcaggatggacctcagctctgccatcctggtgctgtgctttcccctacatgaaccccctttcaatgcctgaactttgtgttgatgcctacaaataaaaattaccctgttccctcttctgagttctgtttagagctggggaaattgagaaagcactgagttatgagtttgtgccaatgagatgtgtgactctaaacctctgcacctgtctttctgcaggataaagggtttgactttggtggtctctacaacctggactagcccttgttttctatgatccacattaagggaagactggagtctgttaggaatacaggggaggcatataaaacctagataatatgaaaacgttttcttcaatccctactgttcaggaagtgagatctgatgtcatgaccaagcaggaaaatttttagtagctcatggtactcagggcaggggaaaggaaatcaggctgagggctgtagaggaaggagagcaggctaaggctctcaaccccacccctcccctttggttttcatttggggagactcaggccctcaaattaaaattaaaatacagttaattaaaataaaattaagacataaaatgtaagatactttctgtcttctaactctaggagatagagaacagcctaaaggatgcagctctttaaatgtgtgtgagtcctatgcacattctgcttctgcagcaagaccgattttaagctaatgtgtggtttggggccaccccacagacctaggcctgaaagagtccactctgggcccttctgccatggatgagttgctggctgtgccaggctagcccaaccctttacaaaggaaacctagcagcccaactgccttccctccagctctctgtgctatgcttcttacttggagtgagcagaggtccaggaattcagagtgtaattcatatgtggagttttgtaatcctttagtggtcaagtttaggaggcagtgttgtgcaatggaaagaaagtcaaatggtcttggattgaattttagctctactaatttctaactatggagaaattaaccttcctaagccttacttccttttctgtgacttggagttcatggctgccccacagtgtggtacaaggataagcacagctagtaggaagtagcacccagaaagtggtagcttcatcattgtttgaactggcattagcatccttagagctacttaaaaagggaaatctgcaagagagaaagattcctcatctgacgtttaatgtagtgatcaggcccaagaaacattcagaatcccccaagagaaccagtgccttaatgagggccatgcagttattcagggccttacatgatggaaatcagccttggtctgagcccctggaaggctatctgaagacagctctgacacttgcccacctccagaggtcaggtcatgaggcttggtgcagagcaaggaagagacgtggtacctgccctctgagaacttcctctcccgtggaggaccacagacctgtcctgtagagatttaatgtgagccacatatataatctttttttttttttttgaggctaggtcttgctctgttgctcagacgagagtgcagtggtgtaatcacagctcactgcagcctcgacctcctgggctcaagcgatcctcctacctcagcctcccaagtagctgggactataggcctgcaccactacactgagctaatttatgtatttgtatgtatgtatgtatgtatgtatgtatgtatgtatgtatgtatttttctgagacagggtcttgccgtgtcacccaggctggagtgctgtgacatgatcttggctcactgcaacctctgcctcctgggttcaaacaattcttctgcctcagcctcccaagtagctgggattacaggcgtgtgccatcacgcccggctaatttttgtacttttagtagagatggggcctcaccatgttggccaagctggtcttgaactcctgaccttgtgatccgcctacctcagcctcccagaatgctggggttacaggtgtgagccaccgtgcccggccttatgtatttatttttttaaagatggggtttcaccgtattgcccaggcttgtgtaatcttaagtttaccagtagccacattttaagatatcaggtaaaattcattttaataaaatacttatttaacctattatatccaaaatattaccatttcaatgtataagcgatataaaaattattaatgagatattttacattcttcaacatctgggatgtattttacacttacagcacacctcacttcagaccagctataatgctgagtgctcaatagccacaagtggctaacagctactcttttgaacagtgcagttctagaagctgccacctgaataggaataaacaaggtttacacagaacaaaaagagaaagccacatggatgaacaggtgttgatatggtttggatgtttgttccttccaagtctcatgttgaaacgtgatttccaaggttggaggtagggcctggtgggaggtgattagatcatggggatggatccctcatgaatggcttaataccatccccttggtgatgtgtgaattcttgctcagttagttcacatgagatctggttgtttaaaagagtctgggacctctcccttctctctctttctccctctcgtcatctgacatttctgctcctgcttcaccttcctccatgattgtaagcttcccgaggccctcaccaagagcagatactggtgccatgcttcttgtacagcctgcagaaccacaagccaaataaacctcttttccatgtaaattaccaagcctcaggtatttataacaatgcgagaacagactaacaggtggtgagtagtcctgggtcatcacacatccacacagtgagcatcggacatgaggtggagtgagtgcccaaacggtgggtgtgccccagccccagtggtctcagtctgagaaggcctttgacttttcaaggaccagagagtcacttcaggtaataaagggttaactttaaggacataagctcaggagcccagggaaagccaaactggcagcccccagaggagatccagacctcagatggatcacccaccttacaggattggttagtgcaaatgcatgtgcacagaaatcacctggcgaatctggttgaaatgcagatgctgattccataggtctggagcagagcctgggagtctgcatttccagccgccagttgatgccatgctgctggtccacagaccactcttggagtagcaaggagggatttaattacatgtgtgatatattccacctagtacagtgattctcaaacttgagcatgcatcagaatcacccggagggctgctgaaaacactgactgggctggagccgtctgcctggctctcccctcccagatggtccaagcacacctcctccctacccccagccacccctcagtgccgcagctcctgctatccacacccgcatgaaactactgcagtgcagaccgaggctctgactatgtgagagagagagggccagccagcaggtcacctagactgtgacagcagaagggagaatgaccccctgtcacaagatttaagggagaagagtagccctggtgaccactaaggcagctctggtggtgccactgacaccaggattctcgggccaccttgaattcgtaggaaatgctcctgtgccatcttttgttgccactgccgtttttcaggggcagatctcttagactccttttatcttcatgttgggttggattgatgacattatacatttttaggccgtgtctatttatactggctgagttttaaattactgtgttcctcctggatgtttgtcatggttcttcttttggttctttttgctcttatttcttttggactgtcttcctttatctaacttttctacccatctgaaggacctataattatatttcccatttatgttctttataaatgcttttcaacctctaaaactccccaatgacttcattttctaggggtatataccctattttttaaaatctaggcagaatcttaaaatgctctgagtttttgtccttttctgtctcattaaagttaacaatacaaatgtgatagaaagggaaattattctttttgccccaccagactctttgctgtaaaatagttgtgtgttcaagactgcctttgcagaagcagccttactcatttagtatacaaaagagttagctggaaagttacttggtcccattctgttcttgaaggatgacttccaaatttcctttagctggaatctcttccctcctttatcttcaccatccactttgcctttgcctctttttccctccaaaatacacacaggttgcccttgctggcctaacttagatttttgctactgatgctccctcctttttccatctcgtattcctccacctccttctcccatctccacccctggcctttggtagatttaggcttttcccagttgctgttagttctagcctcttcttcattcctcagattttattgaactttgtgctaggatataaagaacaataaagctcaaactcctagcctcaagcaatcctcctgcctcagcctcctgagaagctgtggctacaggcatgtaccaccatgcctggcttcacaattctttatacttgaacttatttgtctttaaattgtaaataaagccgggcatggtggctcacacctgtaatcccagcactttgggaggccaaagtgggcagatcacttgaggttaggacttcaagaccagcctgacaacatggtgaaacccgtctctactaaaaacataaaaattagccatatgtggtggtgggtgcctataatcccagctactcaggaggctgaggcaggagaatcacttgagtctgacatgaggaggttgcagtgagccaagattgcaccactgcactccaccctgggcgacagagtgagactccatctcaaaaatacgtaaaaaataaaaataaataaataaattataaataagtattttaaatgtttttcttctccactagaactgtaagctccatgaaggcaagacatgtctctttttatcagttactgaatccccagtgtaaggaacctagcacagggcctgagccatgataggtctggcctgtagaaagagctcagtaaatatttgttgactgcctctgtagctgcctttggtacttcatcccctgtactaagaaagggattccgttcctagtatatataagcactggtcagagcttcaacaagtagactaacatgtacaacaaaatctagaataatatctgagccttaaaagaaagagtgcttcaaagaggagaattttggcaaaaatgttattcacattgagcaatttcagtgacctttagttttgacttttttcattccttttttcttcaataccaagtttaatattcaaccagaaattctggttctaggcacttctccagaggttttcttaagccactggccctaaacagagacagtaccaccctctagggggcacttaggagattcatgggggcccttttggtttcccagtgattgggagtgttgctggatttagggggcaagcactaggggtacaggatgggcttcacagcaagaatcttttcccagttcctcacagtcctaccagaacagacaccacaaatatataaatcggtggttccttagtcttcaataatacaaaaaaaaagagcccagtaattgaagaaatggtcatcatttagagggaagattaaaaggaatgaagctatcctccaaaatttttgaaaaatttactctgcacaaattttctactaaatgaaatataacatttctatctatatataattacctcatataattgtatatatagatagtgctgttactacactattgctctgaaaatgtggatcagaggagacttaaaactcttaatattagaagcaaatagtattaagttaatggagatgcataaaatgtaggcatcttattgagttttattgccatctcacattttttaaaactttggggaacagtaataaatctatattgtaaaaaaattatgtatttccattattttttggagatgactgctgttttcatcctagcacatgtcttctctatagtctcttgttattatcactgttcctttgtcaaaaccattcactgaatgtgtatttcaaggtaaggtgagattttaccttgaagtcctgtgataaattttactgtgataattttcttactactcaaccccgtatcataaaacggagaattgttttaacaccacattaatacattaatcatctttctaaaaatgttctctacttcagtggtctgtaacttgtcttgctatgttatcttcttttaaagttattttcttctttcttttttatataatacatctttttatttgaatattctagtgtccactgtagacctgtgctctttcactttgctgtgctacttgtacagcatgatttttcatcattcacttttaaatctaaacatgcattaggagttaatgcaagaatctgccatttcattgtcatctaatgtgcctgagcacttatgtaaattgaaatggtcatgcttgaacagttgcatattgaaatccatatttttataattcactttcgctctatatcaccgtaatgctttagttaaggctttacatttattttctttttgaaattatcacatacgtgtatgtgtgattagaagggaattttgatcagggtcgcatggggatatcagttaatacgtgttataaaaagcggatatttgttctgatagagtggagaaccactattttaagtaatcctcaaaaaacactttgaagttggctacaagtagggtgactgctccccacttttcctggaacagtcctagctttctcctgctatcctggcatgattattaattgcatctctctcagtgttgagagtctctgtttggatgataaattatatcaccgcacatttttagaagcatttcggctcctttcaattttgatcacattattcactttttgagcagtatgttctgacccgattcagtctttctgtatcacctgacaaacagagctaggtctaccttatcccttccaccactgaactttccaatcctaagacctgccagcattctcttttacttgtctttgaaaaatctaagatcaaataccgtcagtgtcttggcctctcctttttctcagcaacttgcttctgtcctcaccagttctcttaactcattcttctattttttgcatttctactttaatcccctttccacttatttttctacataaccttactgttctgccagattttcatacttttacaaaattaattttgccttatctaacaatttgcaacttcaaatttttcctataaatagaccctgttagtaattttagcctaaattctttttgtcttgatgtgaactctctgttaactcatattaaaataagcatccatcaattccatttttagctgactgctttatgtgatatgttttcatcataccctcttaccctgacatagaagtatctctccccagcattcttttgctattctttgggaaagtgccatgtttttgcttttatttattttttaaggaagaaaggaatttaagccttttggattaagatatttagctcccaagactttttaaaatgctcagtctaattttttttattgtggtaaaatatacatacctaacataaaatttaccattttaaccattttaaagtgtacaattgtcattaagtacattcacagtgttgtgcagccatcactgctatctcattccaggacttgtttattaccccaaatggaaaccccatacctattgagcattaattccccatcccctcctcccccagctcctggcaactactaaccaccatctttctctatggatttgcctctcctggacatttcatatgaacggaatcctatcatacatggccttttgggtctgagctccttcacttaatgcactttttcaatgtccatccatgttgtaccacgtgttagtacttcattccttttacagctgaataatacttcattgtatggatgcaccacattttctttatccattcatcagttaatcagtctaatttttataaaatctttattcccagatgaaatgagtgatacagtagtgtgggtagtacaatggatggtacacggatattttgtgatgaaatgttagagactggataatgctgttgtatggagcgtgtttagaaggccctatccatcctctatttggatgccagattttactttcttcctccctgcccctttttttgcaactagattatgtttttcatgttttatttcttctttaccattgtatttataggttttagaaaatacagctgaataaaattactcagagtaccacaacccccaaaataatcagtattaataacatgataccttttcttgtcattttcctgtctttgggtattttagttttacctaattatgatcacattaaataggtaattttgtatgctgcacaaaatgtatttaacaaatatttaaatacctacaatgtgctgggatttgttccggatacatctgatgagtgaataagaagttctagtggggatatgggttgggtctttagcatatagatgatatttaaagctatgggactaagacctcctgggagaaattagatggagctggggagaggcccaggactcagccctagggtgccccagcatgcaaaggttgagcagagaaggaggttgagagaagatgaataacctggtaaaagcaggaaagtctagaagagaaagtgctttgaaggggagtgggaccttgtgtcagatactactgagcatctgagtgagatggagacagagtgtcaaccattgggtttgacaagattgtggctgggatggagcccagtggagcggagaggatcatagcccatttggagtgtgctgaggaacgaatgagataatatcctaacatgtacctgcacgtttcagatattcttaaacataatttaatggcagaataagatgtctaattgtacattttacctgactacttattttcttcctactgagtgacatttatgttgcttctaactttcactattacaaataagataaaagtgaatagctgtgtaaactttctcttctaactttagcgtcgtttcctttgaatggagtcacagaaacggaggtgctgtcccaagagcagagcatctttaaagcttatgatttttcctcactcaagtatttccaggaggactggacagttggctctgcctccagcagcatctgagggcccagcatcttgactgtcagttgggtcctttcaaaacaagtctctccttttatcaatttagaagttcttttacttttgaatagagaatggaatgacaaaaaccaaaacactttcaggaatgaaaactagacacagctcactaagtaatgttaaacagaaatgcctgtatcgtaatcaccaattatatggagccacagcttaaatgtgatgccagtgtttgttattaatcccttttcactaaagttctggtggaatcttaaaccgggtgtggctgatgaaaatagccatgatttttctcctccacacctatgttcttacacagtcatataaatgtgatcagagtcaaagttaaggaagtttactcttttgcagtaaactccctgcaaattccccacagcaactgtctgctgatatcagaggatgactctaccctccctgggatagggttttataaacatccccagcttgcggcaaaagaagaacaactttcagggtgatcatcatctcaaaaaagacctcttcctcccaccccacccctcaaaataaaactcccactactttagagttatttcatggtgacattgtgaattgtccctcccagctgcaggagctggatgaaaggagctaaccccagctgccttgctggctttgctatttaatggcctcctgcctagcacggcaacagctcacccaggatcagcagcgcccagtaggatagcgcctactatggcctcatcatctcacctaggaccgactggcagtgcccagcatagcagcgccttgcccaggactggcagtgtctagcatagcagcgccttgcccaggactggcagtgtccagcatagcagcgccttgcccaggactggcagtgtccagcatagcagcaccttgcccaggactggcagtgttcagtgtggcagcactgcagattctgcaggagctgctggctccgctgtagctcatctgcagtgacctgtcctgctctctttcagcttgctgctacttgccaggccttaagtggaagaatggagtgttgattgtgtcagtcaagagtaggtgtggtaagagataggcatgggcctttccctccctccctttaactgagaaaatgttctggagaggtcctgaatcacccccaaataatccccaaaatggaaggtagagcgtactaccctaacaactcagcagggtggttgagagttttagaatctggcagacctgggtgaatttctgcactgttactgactttgtgaccttgtatggatgacttaacttctctgaatcttatttctctcatctgtttaaaaaataggataatgtagtatcagcttcataaaattattgcaagaaattcacatgataatgtatgtaaacacctaccatagtatccatagtgacacagcccatgctcagtcaagattaatgatcaccatcactatcccacccacccctgctgttgaatctttttactttcattgctccaagttggtggctcagacctgactcatcaactctttttcttgcaggaagttttgcgaagcagcttggtcagcctgttgtttccaaaaccttagggtaagtcctggatgttcaagacagagtaagggttggattgctttcctgctgacttgagcaggataggtctggggagtaagtcttggctctcctaggttataataaccaaagggcgggagcctagtacaatgagatgtgtcatttacacagcacctcctgacctggctgcctctgtgattggctcctttgactggcccagctgctaaatgtaaggaagtgggagaggtggccagagtctgcagtggactctaacaatcaaggcaatagtcagaagattgaaataagcaagcctagaagaggcgggtaacagtagctgctgtaacagacaagcctcaaatcacagtggctcaacccagggaaagtttgtttcttactcagggaaagttcagttcagatatcctggaacatggggagagccttccacattatcttccaggagcccaggcttcttccattttatagtttcatctcctaggcccttgagcccccactgggccttctgcatctcaccagcagagtggacgagagactgcagagcctcacaggaggttcttatgagtcggccctggaagtggcatacagctcttctgctcatggtctcctggctaaaacccaggctttcagccagggctcagtggaattcaggcatgcctaactgcaaggaaggctagtaaatgaagtctagctgcatgcccaagaggtagaggaaataggttttggtgccacacatttttctagagagagcatgagaaagtttctgaggcataaaattgggaaggctacactttgatggcttctgaccttaacttagtgcctttgagtgaggtggagagaggatggttgaattgctgccttgtctgggactggattctctgccaatttccttacagggatagattttcagctccagcagtggagacccgtcctagcatctggggggagtgcccaccaaagtttgctaccaagctgggccgagttgtggtcaaagaaggacagatgggacgattctcctgcaagatcactggccggccccaaccgcaggtcacctggctcaaggtgaggtttctgtctgccctgaccctgatccagcctgtattagtctgttctcatgctgctaatagacatacccgagactgggtaatttatgaaggaaagaggtttaatggactcaccgttccacatggctggggaggcctcacaatcatgacagaaggtgaatgaggagccaagtcatgccttatatggcggcaggcaagagagcatgtgcaggggaactcctctttataaaaccatcagatcacatgagacttattcactgtcatgagaatagcatgagaaaacccaccctatgattcagttacctcccactgggtccctcccacaacacgtgggaattatgggagctacatttcaagatgagatttgggtggggacacagccaaaccatatcatagccctagggaccctgaaaattcagggttagacccttcaactagtaggagtctttccattctgttcctcctgtttcaggcggttctcaggggttctctgtatgtttgttagggatgcatgttcctgtccctattacaactctccctctgttactcagaccacagtgttctgacaattctcacactcacaaaatagcagaaaacttctgagtcaagacaagcctgacaatctcaagagtggactgtgaagttagggttctaggtgttaagccacagctccctggtttataaagcctgtgaagctggataagtcatttgacttcttggaatcctggtttccttatcggtgagatagaaataataccacctacctcaaaatattgtcaggagcctccatgtagaagggatttataaatcattcagggctgggggaagtgaagcttaagggggagaggtgggcgggcagggaggcagtggcatggggttggggatggctgttaaacagggcagtgaggatcctaggggaacaggtagagtcatggccaggggaataggtttttcagagttggaatgcctgggtaaaagtgggtattgacaccttttacctgcttcctaattctcttgaactcccctaggaaaagaataaaaggaatggggaggtaaggaaaaactgaagtgaggaatatgggatttcctacctcaaactcaggctcctttgaaacagttttcaggcaactgctctaagcaggacagagcaccacaccacatccacagacctcaagtcagggcccctgaactgtttaaagttggctctctgagcacattgacagggcccacagcagaggacgctgctgcccaggccctggagtctatcccactaggattggcaggaggcaggaggacacagccagaaggtgagcagatttgtatgaccaagttaccccattgccatccacagggaaatgttccactgcagccgagtgcccgtgtgtctgtgtctgagaagaacggcatgcaggttctggaaatccatggagtcaaccaagatgacgtgggagtgtacacgtgcctggtggtgaacgggtcggggaaggcctcgatgtcagctgaactttccatccaaggtatcgaccagtggacggctagtgcagaacgatccctgcctggtgccgcaccctcctagaggagctgcttgttcactgcgcacctgtgtgtgtatacacctggcccactcacacacccaggcactccccaggggcaggtcttttttttttttttctcttcagacagagtcttgctctgtcgcccatgctggagtgcagtgacatgacctcagctcactgcaacctccgccacccaggttcaagcgattctcctgcctcagcctcctgagtggctgggactacaggcacacaccaccacgcccggctgatttttgtattttttgtagagacagggttttaccatgttggccaggctgacctcaagtgatctgcctgccttggcctcccaaagtgctgggattacaggtgtgagccaccacgcccggccacaaggggcaggtctttgacaagaagaaagggtgaacagggcagcgcagacctggccacgagggaagatgccctgtgcttggctgccaccttcccttgtgttcccatagtctcccccaccatgtcttcagtcctttcttctcacccggactcccttttgtatctgtggttgccaactggaagaatgaatgttgctaacgtcttgccatcaccccaaatttaacctgcccagaatttactgataatttactctgtctttcaagtcaggcgatccttcgacttgaccccctctaccagggttcccatgttccttcacacccagactggactttccagcatccttttgacccctgcctctttctccttgagtcgtcagccctgtcagttcttccttgtaagtcttgttgaacacgtctcctccttacagttctttggttcctcaagtccgggctgaggagggagtgcagggatggggaaggggctgcatgtcactttactggagcaggaactcgggggtcaggaagggaagtggctttcagtccttcctccttctttgtccctctcttttcttctgatttttctgttctgcatctccttcttcttagaaacgattcatctttgctcttgttactttttttggcctgggtatttttcacaatctacagaaagaaatatatttcacagtacattgcaacccagaacatgtatacataggtaaacaagtttcaggaaaccatcctgaccgtactgtgtacagtgcatgctggtattctctatttcacttgacatcactaaaacaagaaatcctggtcctgaccggaggacctgacttggtggctcactgctgaataaggagatgccaccagacacccagagcaatgtgtgcctgccctgacattcagttaaatactattccctcctgatggacttcatgacaaaatatgttgcctgatatttgttttaaaatactcaaaaacaaataaacgaaagaaaacaaaaatggatatataagactggcaaaatgtggtatctccttaatcgtggtgatggctttcagggtttgttatctctttctactattgtatatttttaagtttaccatgataaaatttgagaaagaatatagcaggaaaaatatgtattttatgttttttctttgaagaactggataacattaaaagtatgcttttctgtacactggtaagttacagcatttgggtttggaattttcagtagatgtttgtttgtccctggattggttttttttccttctgtttagtgaacagaaacagattccatgccctcagggtatggtagcaccagccactattaagaagcccaaaggacagaacctgaagctttgacaatgtactctagggctggggggagttcaaaggccaaagacgttcagcaccagggaagctggaaggagccagcagggtgggaccacggtgatgaggaagtgcctggggagggaaattttggtgtatacagcattctactaacagtctttccacccttccccctttttccaggtttggacagtgccaataggtatgtctaggctttgtgacttttacgttttccctcttgaaatgccctgcaaggatgttaccgagaaatgccctgaatttctgaatcatcttatggggcagaagaattggccatttggaggatgttgttttattttgggtgttttgtcttgttctcctattgtaatatgacacacgggttctatctcaggttgctgtcagtattgagactggaaaactcagtgttgccacctttcacagtatctacacagtctcttctctggttagcatcctgaggaagaacactgctctgagaaggccgccttcctcattccagggcggaatctgttcactcatccagcccagacccagcaggagcctctttcctgtgtgtgaggctcggcgctagatgctggatgtgcaggggtgggcgtagaggagggcttaaaccacacgaacgcacattaccaactgggatgcgtctgtgaggaaggacaacaggaaggcactgattagaatagaggggcagggaagccatttcgggaacttggtatttgagctcagacctgtgcaaaggaatgttagctggtgaagaaaagctcagggagtgtgctccaaacagcagggatagcatgtacaagctgtgaaccaagagatgggcccatggggacccagaaggacgccagtgtggccgcagcctggtgaatggcaggccaatgtctgtacgatcaggagctggcattcctgtgggccctcttgtggggctcagtttcattcttaaagtagtggaaaagctgttggaaaatccttgggcttgaaatgacataatttgattaatgtttttaaaagatcgactatggtcgctgtatagaaaatagattagagagggcagagtggacacgggacaccggtggcagaggttgaactacggaggcactagtagagaagggaactgtagggaaagcagggctctgggcagggttgtgggacaggcaagtgtcgggaatggctgcttgtgctgtggcttgggaaactgggcaaactgcagagaaagatgctcttacttgcccttaacttgtgggcttttgtgatccctggaatccgtgcttgtgatgagtaatatttgtgagtaaccagatgatcattctattctcccctctcctcacccaccctacccccaccctcaccaccacacaggtcatttgtgagagaaacaaaagccaccaattcagatgtcaggaaagaggtgaccaatgtaatctcaaaggagtcgaagctggacagtctggaggctgcagccaaaagcaagaactgctccagcccccagagaggtggctccccaccctgggctgcaaacagccagcctcagcccccaagggagtccaagctggagtcatgcaaggactcgcccagaacggccccgcagaccccggtccttcagaagacttccagctccatcaccctgcaggccgcaagagttcagccggaaccaagagcaccaggcctgggggtcctatcaccttctggagaagagaggaagaggccagctcctccccgtccagccaccttccccaccaggcagcctggcctggggagccaagatgttgtgagcaaggctgctaacaggagaatccccatggagggccagagggattcagcattccccaaatttgagagcaagccccaaagccaggaggtcaaggaaaatcaaactgtcaagttcagatgtgaaggtgagtagaggtaattagggtcaccgattgccaaaatgtagccccttggtggccactcccttccttcagcacccagctagtctgcatcacctatatccactcatcttcttggactagctcccctagaaaaccaccttacaagggccttccccttaggagtgactcattgtagaaatgccctttattctggagagacccctaacagtagcctgttgtttgctcttggatagagtactggccctggccctagttcttaccaccctagaagaaacaccctcattatcgccaacatcgaaaagcaaacctcatggtctcctccgccctttcttccccttgcctggctttggccaacctggagaccttgcccatcacgctgtattcatcctcctcaaggcccctgactctctcaagaggtttcgtcttgtggagtgtggttgagggtgaggaagcagactcagaggtgggagggcagctccacaccaaactgagccctttcctccagctcacaccttccccacctacctcacaatcacagggtgctctccagggcatagggagctcacgttctttacctggccctgtagtttccgggattccaaagcctgaagtggcctggttcctggaaggcacccccgtgaggagacaggaaggcagcattgaggtttatgaagatgctggctcccattacctctgcctgctgaaagcccggaccagggacagtgggacatacagctgcactgcttccaacgcccaaggccagctgtcctgtagctggaccctccaagtggaaagtgagtacacttctccaggtcaccccgcattctctgtgggacaaccattcatggggtgcttcaccttctgcagatggttcatctcctatagccccctgccttggtgcacagcccgacagaaatgtcacccccaatcacatgccaaggccaagtgtgttgctctaggccagtgattcataatcaggagttcacatcagaatcacctcaaaataaacatgcatggccccacacccagcccaactgacagctacctttcctaggtccctcagctgtttgaatagtgccgtgactcacgtttgtaaccacagagaactgagtgttcattaaatatacaggtttagagtaatgtgagatgatgtgggatcccacatcttttatgtttattgtactgtctgtttataaaagtaatgcatgttcattgtggggaatttaaacaatatataaccttatgactcagaaataaattatattttaatgttttttatacaaacttaccattgtggtatttgtatactgctttctatcctaatttgctcatgtgatattaacatctttttatacaattcttggaaagcatgacttttagtagccatataatattgcatgaaatggctgtatctaatttaggtatgctgttatttgttgaataattaaattgtttccatttttcactattataacatacctatgataaatattcttgtacctgtctatctctataaaatttcccccttactctaaatgcatatgtaagccccaggcccatgccatacccttgagaaatgcattaacaaataccacaagagtagaatctgcaaattgcaggctgctggaaactgtggaacaaataactttcacccattttttttccacatacaaattgcaagcaaaaaaaaaaaaaaaaagacaacctatagaaaacttatattagaaggtatatagtaacatcaacaattacaataatttttgataatcttctgccaatcctgactgagataatctttaaaaagtttttatgggaacatcaagagaatttggacactgataagatttaatataaaggaattcgtggtgttttaagatgtgatggtggtcttgttacttttttttttataagttcatctgtttgagagatatatcctgagttatttactggtgaaatgatatggctttttatatttgacttagaaataattcatgtttggggagcactggcagggatatcaatgaaataatattgatataaatgaaagttgagagatgggtacataggaattcactacactgctttgtctacttttgtgtgtgtttgaaaattttcaaaatgcacatttccaaaagaaaaaaagagttagtgatgtatccatatagtagaatgccagacaacatcctgtagactgatgctaaaacatgttcaagatgcactaggaagggagaggagcaaagtacaggctcatgtgtaaatggaagaaaagatctgtgtacacacatgcaaaagatgcctgtgtgtgcacaaatcatttctggaagagcacaaaagtccctctaggaaggggaaactaggggttcacaggaaggaatggggcatcttacttttcactgtatactgttgattcactgggattttaactgttgtttaactgggatttttactatcctcgtgaattcctttacaagaaatattatccatgccatttgcaggtgggagtgctggtaggcagagttcacaggtctaggagatcaagcctcatcatccaggccaggtctctatccctgcgcaggggacagaaatatggtgtcaggtccaccacagattaatggcgtatccagagggcctagattctcctgtggcttcttctgctgtgaattcatctaagtctcacagaagactatttttagcctgttcgcgtcatggggtaatacatctcaggttgattccctatcttgttgtgttttgtgtgacagctttattgagatataattcacataacataaaaagcacccttttaaagtacacaattcagtggtttttaatatattcacagagttgtgtggccatcaccatcatctgatttcagaacattttcactacccctcccaaaaaaatcctacccattagctgtcactccctgttctcccatccccacaacccctgatagccactaatatactttttgtctctatgggttttcctcttctgaacatttgatgttaaatggaatcattcaatatgtggccttttgtgtctggcttctttctcttagcttaatgttttcagggttcatctgtgttgtagcaggtgttagtacttcattcatccatgtggctgaatcatattgcattgtatgggtatagcatacagtgttttgtttatccacgcatcacttaaggtccatgtggttgtttctactttttagctatggtgaaaagtgttgctatgcacatttatgtatgagttgttttcaatacctgttttcaattttgatgtttagaccacatatattgttgggtcataaggtaattctggatttaaccctctgaggaactaacaaactgtttttcaccattttacattcttctagcaatgtacaagtgttgcagtttttccacattctcaccaatacttgttattttcttgcttgcttgcttggtttcttgctttttttaaaaaatgaggtcttgctttgccaatggggctagagtgcagtggcatgataatagctcactgtaaccttgaactcctgggctcaagcaatcctcctgcctcgcctcctgagtaggtgggactaaaggtgcttgccaccacactcggctaattttttttattatttgtagagatggaggtctcactatgttgcccaggctggtctcaaacccctagacttgagtgatcctcccacttcaacctcccaaagcactgggattataagcatgagccactgcactcagcctgttttctattttttcattatagccattcacaatcatctgactatgattttttttttttttttgaaacagggtctcactctgttgcccaggctggagtgcagtggcgtgataatagctcattgctgcctcaacatcccagcctcaagtgatccttcccacctcagcctcctgggtagctgggaccacaggcatatgccactatacccagctaattttgtttatttttgtagataaaaggtcttactatgttgcccaggctggacttgaactccttgctcaaacagtcctcccactttagcctcctaaagtgctgggtttacaggcatgagctgccacacccagcctgactgcaattttgatttgcatttctctgatgactagtgattttgagcatcatttcatatacttattggacatttgtatatctccttcagagaaatgcctattcaaatactttacccatgttttaattgcatcatttacttttttattgttgagttgcaagagttctttatgtattctggatacaagtcatttaccagacatgatttacaataatcctctcccattctgtaaaggctggattatttgtcatgtgcggccacagaagtccctgcttagttagtttagtgatcacctaattgattggatggagagttccttaaatgccttgaactaatacttttcccagcctttgccaaggggctctgtgtgtgtgttacgcccatcttcagtgctccggccagcagtttacagctctgctttagcctttactttctgcttgcaccaaagctccaagtcagccagaggtgagacaggagggccttcttacatctttcctgggcaggctcacagccctgcacaaccatttgggctcctcagttctcaggaatctgtcagagcttttcaaagtcctggacatctcattccccagtttttcctttgaagttttttggtcaggctcttgttagctccgaatgatattgctgtctcaagtagctataatgttaaacaattgctactgattgattttaacaaacatcctggagacagggccatccacacagagtaaactttgagtcggattaaacaaagacaacccggaaaatggagtcgttgaaggagctgccagacagggcaaatagtgaccattctcttacgcatggggtttttcaggagctctgaacccatcctgccccttgctaagtggctgattttcacaagtaccataggtactgtcggttttcagagttaccccagagctggggcaaggggcacaagagtgaaaaagcacatagcttgctgttcttaccaagattcagctatgttttattgttgttgttgttgttgttgttgttgtttgttgtttgggagggtggaggggcagggtattgttgtttggggttttttgttgttgtttattgtttttactttttagagacagagtctcgctctgtcacccagactggagtgcaatggcgtgatcatagcttgctacagcctcaaactcttgggctcaagcaatcctcctgcctcagcctactaagtgagactacaggcacatgccatcatgcctggctaatattttaattttattttttttggtagagacaagagtcttgctatgtttcccaggctggtttcaaacttctggctcaagcagtccttctgccttggcctaccaaagtgctgagattaaagacttgagccaccactcctggatgtttgtttgtttttattgaatgctcctcagaatgttgcaagcctgtggttaatttctggcattctgaaaccgttgcttttgactctttttgccagtattgttgttgcttttatggaggagtagatcttcagaggtctttactttgccattccacatcctatcttcttgatgaagacactcgcttttctaaaacttctccagttcctaaacatcctagctaattcttggcagatgagtttaccatgaagcaggtcatctgatgggtgttcttttagctcctcctacatacttctctctttctgttttcctatactacagaatacctgtctgtttcccttcccaagacttctctttctgtcccttcccatcttcacaaggatctgatctaacaatgatttactctctcaccacttcttcaatctttccccttcccttattgagagacctcttttttctccctacaagcatgctgtagttgtccctatgctgaaaaaggaaagaaaatcttccttccacttgagagcccctgcagctcctactctatccctccactctctttcatccctagactatatttgcctcaagtagagtctctatgcacagcttctacttgataataacagctaacactcactgaggatgtgctatgctgggttttgtgctaaatgctctacctgaattgtttcatttagttatcccaacaatcttacaagaaaatcatacccatttcctagataagaatactgatctttagtaaggttaaatgacttgtccaagttcacatgccttgtaaaagagagcatatttctaacccaaactgacctggcatgaaagcctatatccttttttgataactcccaaaggcatttctctaatgagggagttcaacactggccaaggggagggatggagagggtgcctccccacaccttctgggtggtctgtctgaccctccctcagtgccaggcctgtccaggtacaccatcactctgtcttgtcgctgccctcccatcgcctatcctcccctaggatctggaggagaaagtgcagctgtacagtcagagctggctgtaaaacttggcttcagcatcgagttcaactatgggaaattagtaaccttgtctgtaaaatgaactcaagagaacaacctcataacattgtcgtaatcacatctggaaaagtacctggcacatagtaggccctcacatcttattagctttcttgcccataaacccctgcagtataatatgacatttcttctcatttctgtattgaataggctctcttgaaaagcaccagtgatatatcttctaagcaccaaatccagttccaccttttctcagctatcagccaccttgacacatgtacagcatgttctggttgtcatagaagagattatccctattgctcttaattaaggtccccaaactagaaaatgtcccctaattcactgatgtagaaggcttttggaaagttcagctcagcagttctcaaccagaatgtgcattcaaaccacacaagggcatcattactgcatattcccaggtccccggcagctctgagcccttgacctagaatggggttcaagctgtgcttagaaaactggagcacatgtgagtcctatgattcagttctggaattggaaaaaaatcattgtaataatttaaaattgaaatgtcctcacctgtgagcctgtggcttatacaagtaaagagatactcacaagattgtgtaatcactgatgggacatattaaagaagataagagacactagaaaatagagtaggaccaacaagcaggaaggagctctccagaggctcgagggcagcaaaagccaaggcaaagcaggaggcacctgagtcacagaggagagaaggcaggcccaggttctaagcaccccagggctagggtgttttgtgactgtgaaaaagcccctgcgggtgactctgcttcaggctccatgtccctacatcactggtgctgcctgtttcttaagcatgaagagagagaagccaaaggcaggctgccgagggtacccaggtgtccaggacagtgaggcgtgcctgggaggctggggtgactgcaggcatcaccagagtgggcaagctgtgatctgagctgacctgtccttttccctcacagggcttgccgtgatggaggtggccccctccttctccagtgtcctgaaggactgcgctgttattgagggccaggattttgtgctgcagtgctccgtacgggggaccccagtgccccggatcacttggctgctgaatggtgagttccccctgccccagctctctgctcccatcccctgggccctttggcgctgcctgaattctcacttatccctctgagccatttatgccttggacatcctggtggtatgagaaggaagcacagggcacaaagagagcacgggcactgggatcctgctcccgactggctgagcaagttactactcctgtctgagccttgagttctccatctacatggcaggaatcatgctgcctatgtgcagggtggtggttgtgaaattaaattagattatttctataaagtggttaatgagatgcctgacacataggggcatgagcagttggatttcttttcttatggccaaactcatagtaggccctcaattaatatttattgagtcaataaatgaacaaataaatgaataaactaatgaaccactctcaaagtcgcatgagggatcttaccttttatttagtggcaggtggttctgggactcacagaccagttattctttttaaactgatagtcctatagagactcgccaactcttttttttgtcaagtaaggtcctttaaaaaattatttgccgtatattatcacccttttctttttaaaggaccatttaatttcaacagtgtgggagaactctgactttagaagactgagaactgtccattaaactgataagatggagcagggactactgtggggatccccagggagggtgaaagagcccctgctgagagtcaggagacacaggcacttgtccttctccaccactgagtggtcgggtgaccttggacacttcacccctcggggtaccagcttctttatctatgagaagatagggtggaaaagaaggtttgggatctcagctcactctcatacctaatagaatacactccttaagacagcagtgggccaggtgtggtggctcatgcctgtaatccgcactttgggaggctgaggtgggtggatcacctgaggtcaggagttcgagaccagcctggccaacatgatgagacccccatctctactaaaaatacaaaacttagccgaacatggtgccaggtgcctgtaatcccagctactccggaggctaggcaggagaatcgcttgaacccagaagccagaggttgcagtgagccgagattgcgccattgcactccagcctgggtgacaagagcaaaactccaataaataaataaataaataaatgaaagagcgagcaagcgagcgagcagtggtccccaacacttatgcaccaaatagtccccatttgtgtctgcgtcattgatgtattgcctgtgaaccttccttgttggtgtagtttgctcaggctttgctagaagctgtctttagtgagtaagaggaagtgccatctagtcttcctacatgtagtgttcttgggtaggtaagtgagaattgaggtctgccttccctcccagcccttagcaaaggacagaagtcctattggatccagtgattgacttcaaggaggcagcctccttgtggctggaatgcaatatgggcgttaaggactaataacggagtctagactaagtatcaacaaacattttctataaagggccaggtagtagctattttcagcttttcaggccatacagcctctttaacaactctcaactctgctgttgtggtataaaagcagccataggaggctgggcgcagtggcccactcctgtaatcccagcactctgggaggccaaggcaggtggattgcctgagctcaggagttcaagaccagcctggccaacacagtgaacctgtctctacaaaaaaaaaaaaaaaaaaaaaaaaagcaaaacttagccaggcttagcaaaacttagccactgcactccaacctgggtaataagagtgagaccctgtctcaaaaagtaaaagaatagacaatacataagccatagacaataagtgaaagaacgagtgtggctatgttgcagtaaaactttatgaatactgaaatgtgagtttcacataatttttacatatcatgagatatattaattacctttatatttttcggccatttaaaatatgtaaaaactattcttagcttgcaggcgctacaaaaacaagctgcaattagcattctgcccaggagccatagcttgctgtctcctagtttatacatcactcaagacggtgttttctcagcgactcttagcgtttccacacccattccactagagggcgatcatgctcaagttgggtttccttggctgctaactttagtttaacccagcctccgagctgggagagcctaatgtctcccaattctgatgtgccctgagccaacagctcctttctggggcctccatcccatcccatgtttgtggggccacagtgagttacgttccagttaaaggagagctctcaaaaggcttgtcagcacatgtttggacagaagagacacattggcggcagtcagggaatacactggtattgtcaaggaagagaggtttggagggtaccattgtgacaaaaagtaaaaacaaagagcagtgctcacttctctcagtggcaggatccaggcccctgcctttcccagccctcggccccacttttatgaaatgcaataggttgagaggaatcttcccctctagtcctatgatgtgcttgctggtctctttgccaaactgtcatggagacatgaagtgttgctatgtgcagaagaaaacactgcattgcagggagacgacttctttctgtactgtctcccttccccactggccgaccccaattttatgaagtgcaaaccaggaccctggggcctggcaagggaagaaactgacagttgcttcctatatggcagctggacacattcctgctccgaggacagactcttcagtaatgagattttttttttcctggaaatgaaaagtcacatcccagaatgataaactcccaggaacatagagcattaaggaaaccactgaagctcattgcatgcactcctgtctccatgcaggactttatgttacctggaacatgtcacatgtaagggactctggaaaaaaggagccgagtcatttttagttccctatatttatcttttctgtgaaccctaaaatacacctaattgcatagaagaaacgcacctaactgcaacagtgggtgggggatgcagaattgctttttgataaatatctacagtggaaaattgaatcgttgtttctggagacatctaagtggagctgggcaccccatgttcagcctgggaaagctccgttttgcctgaggctgggctatgggccagatgaccgtgtaaaagtctctccaggctcagaattctgtgaagttgaggatgtggatttggagactgtttaacacagaatgcccaaaactctgtccctttccctcctgcatttttaattcctccagattctccctcccccatccctctaggccccgtcttcctcctccaccacacaattactccctttccttcatctccttagcccctggctctttctccagcccataagcctctgtccagctggctggagatgtgcatggtacatcattagccctcagtggatctgagcaagcatgacaagtctcagcgtcatgacagcagcagccctgctgaggacagggctcccgtccctactgccagtgctgcctggcctgagccttcctgtgcttcctccacagggcagcccatccagtacgctcgctccacctgcgaggccggcgtggctgagctccacatccaggatgccctgccggaggaccatggcacctacacctgcctagctgagaatgccttggggcaggtgtcctgcagcgcctgggtcaccgtccatggtaggagcctctgggcacctgggtagaagcacctttcctgcaggcacttctgctttggaggaagggcacatttgtagaaaatggtatcatgagctcaaatccagggagcagaggtgcacatggcactactccacaccactggcagcggcaggtgccgtgacagaggagtggctgctgcaacctcttagggacagaggagagggtccttaaaaagtgctgcacctgcaggtaggaagtgagggagatgacctccaggagttcacagcgacaagggtgtcatcagaggtggccttttcctcaccccctcactccactggggccatggaaaggtatgggggaaagagatagggctcccttagctccagaagctccaggtctggtcagaagaaaacctcgcacactacaaaaggacttgggagagcactcacgtattccctgaacagtcagtggcctcccagtgaccccttacatgctgggggaccctgggtcacagcgtgcacactgaggcttccagagggtcacaggttgtcccctttctgccccccttctactcacgggcccaggcttgtttttacacatcagcagcctggtctccagtaatctgattatcatggtcatccattcatcagccaagcacttagtccccgggaactgcagggagcctcagactcaagacagatctgtctgggctgtggtatcagcaggcctggtgacagttcccgtggaagtgcttcttgggtccagggctttcaggtaagcctgatcccaccatcaccctgagcctatgcccccggctcctgtgcatgactgggtcctctggtgctagcactgagtgcagcgtgactggtctcccatcagacaagcaggaggatacatctctccattccccggggctcaggcctgtcaggaacatctccgtgttgtatgagtagccactgtctgggaggctgcaggaggaagtttcgcagaaaaggaaaggggaagaaacatttgtggcttactgtgttaaatactttcacctcacccgtattctctcactgagacctcagtagcctaggggacaaggatgctgtcctgatttcagacagaaggctctggaagtctcgggaattgaatgtaacttgcctaagcgcatcacgttagtctgcaaagctgcaccctggagcccacagcctgtgactttcaagtctgtgctcattcctatgccctgacctttttcagaggacacatcccctggctcaaaggggaagactggccactgtgggctgggcagtgtcagtcccttagggatgaaggaactggcactgatggagaatgtgactgacgctggctctgtgaagctctctgccgggagtgagcacgagaaactggtccaccccttccttccaggaaacccaccacactgggttcagagcccagctctggcctctgggaatttgcagccagattctggtttacaaacttactcatttatcctcatagttctaacttcatgactccctgggagccaggtggggagctcaggaaattgtgataatgagatttcagaggaaacctgaactgctgagaaccttgtctctgaggtccaggaagcaggactcacctgggggctcttcttggaggccagcgtggccaaccccagagtcaagtaaggggcagcaagagtcagaatgctacacgtagagccgccgtggctcagccctctgttttctgatactccctccacagccacagccaaggactaatccaatgtctgtcctggcttgcctgtgtttagattggattagagtgacccagctgagctaagagtcccctggaggtgggagtcccaggcaaaggatcaagaattctttagggccatcctcctgactcccgggcctgtgggggctgggacctgaaggatcaccacccatccaaaggaaaacaaaaagcacagagaggtcccaggcaaaaactctgccaaggaagtttggatttgctcggagaagaggcctgcatgacagaaccccctcccagtgtgggggatgtactgggctataaagaccagacaggctcagataccataaatggtgaacaaggctgaagacgcagccgcacgctcaggcccggcagcatttgggctcttggcataggattggagcagggtgagcctggcacagcgacaccccctggcacggtgccctgagacactcaggaggctcggggctgctccctgcgctgtcctctgctgtggagtttttctgacttgattggcagccccgttggctctggatcctcgggacaagcctgggctgggggagatgatcacagtggaggtgtttgttccctactgcactgatggctgcttcacccctcccttagctgtccaggtccagccctctcttgcccttagtgtggcaccaggccacggtggggagcatggatgtggagccagcggcctgggtgtgagtcctgctctgccacttactagccctgcaccctggcgttttagcattccagacctcagcttcctcttgtgtgaaatggagatgctgacagtcgcggtactgtgaggattaagtgaatgaatgtgcaaagtatccccagagcataggatagcacacaccctccataggtatgtgctgtgattatgattgtccagcagagcccacctttaaacaagatacaatccttacaaatgccaagactgaggaggggttttcccaaaggatccactttgctacagtattgtgtgtttgtttggccatcagagaatcagaggagggaggtgtccagccagacacaagccatgaacactcgtgcctgcttccaagggctctggccacaaggtggcaccatgcagcaacgcgtgtccctccagttgtcttctctcgggggtggttgaggggcagctctgctgcaagcaagcttattctgagagctcagcagataccgtgccaaaggccagatgcaggggctctttctcacctctcgccttttgccgagattttgcaatcatcgagattgctggtgcagccctcagacgcgatttctgcagccagcccttcatgctttctctgccttccctcctcagtgactctcttcttctccaaatcctggaaactcccacaaatgtcactttctctgggaagcctaccctaatcaccccagaatgcgttccctgaacaccgtgtgcttctagtattacacttacttatcaacaagtctttactgcgcgcctatattgatcagtgccaggcattgttctggggaaactgcagtagacaggacagctgagggccctgcctgcagggtgcttacgttctgatgaggatgccagcagcagtcagcacctggcctcatttcaaatgctggcacgtgctgttaagaacatgagcaggtcacaaaggaataattataaagagaaaaagccagtgagtggggtgtgtgaatcgaggagggtgagagggtgtatctttagtgctgtgaggaagcctcagaggtgtccatggcctggggaaagagagctctaggtgggcagcacagcaagtgcaaggccctgagtcaggagcaaggttgacccattcgaggagtagcaagacagcagcctctgtggctgcagcaaagtagacggggcagtgtgatagaaagtgagttcagaatgcgggggctcaccattccaggcctctggaggagaggagaaaacaatttactccgtgaaaattcactttcattttactctacttgcttaattatcttcctctccacactgtaagctccctgcagggagggatcacgtcatactgtgtgtagagccaggcctgccatgggagcatgcattccctgaatggatgagagcacagaggttgccgaacctcccctgcagtgcagggaggcattccctagaattcctcgcttttctgggggctcagtgcccattagggtgtgcaggaaatctgcaaattaccttcaagagtccctcaacagggctaggcacagtgtctcatgcctgtaatcccagcactttgggaggccaaggcaggtggatctcttgagccgaggagttcgagaccaccttgggcaacacggcaacacaccgtctccacaaaaaacacaaaaattagccgggagtggtggcccatgcctctagtcccagctactcaggaggctgaggcaggaggattgcttgagcctgcgaggtcgagactgcagttgcagtgagccgtaatcacaccactggactccagcctggatgacagagcaagaccctgtctcaaaaaaaaaaaaaaaaaaaaaaaaaaaaaaaaaagagtccctcaacaaatattccttctttccccaacacaggctagggaaaaaaaattccccaatagttaaccaagcaatgaatgtctttcctcctgacccaggatgagtcctgatccaggatgattaattcaaattcctgcagagcccaggaatatctgaaatacagtatatatttcacagcgtttggactgagtcattgctgggggcttccttgggctagaatatttaaaattttttccccctggagtatctccatcaaggctaaaattcttaagtgtctagatttattaatagcctgccagttgtgcccatttgacatagtttctcagcctaacggtttgtttatttaactgaaggcctagtgggcctgtttaaggcatctaaggacataaaatgtgggtaggttaaaaagatgaaaagatcatctctagaatagataataaaatataacaagcatatttattagagtatttgttttgatgcagagcttctaatgaagacaacaggcatcagtgaagtcagcgtttgcttggcaatgagtagaggcacagtttgttttcagattaataccaggcactctgcggggcagcctggagccacctcctttgtcttccctggttatgcacaggtactttggacactatacaatctatccagttaacataacgtatggatcctgacctcctcaagcttaaaaacactgacaacttcttaaatacttacattggctacagaaaaatatattgaagaagaataaataccagttttaacttgccttttttatatatattaagaagcttagtttattcaaaacatctgtccacaagcctttaaactgtaagaaggcaagcaattaattacatgttaaaatttataaccaatattttcattttatgtaggttgagtacagaattgggtttgtgtaccacatgggttctttgtgttacagaaagacttctgagcatatacatgtacgtttgtgcccatgccatagaatttgagcctcattttactaatagggccattatagagctttataactctccacctctacagcccatagtcagtcataattacatagagacccagatcaagaatgctatccagaatcgcaggattgagctcctagtggcaaaatgtgacccatgtgatgacagtgtaactgagagtgtggcttccaggcccgcactgggagggaacagtgggtggtttggatgccatacctttatgtttagagtgtgattatagcttctaagacagtggaaaggctgtggtttcagtgatccttgcttcccagctagcaaccctatcattactggtcagagatcttttttgggatattatacgtcattgttcctttcattcttttcctcgcacacttctcttcccatttgcttcttaagttctgggaggaagggaggccaaaagaaaacaaggctatgggaggaaaaatccttttaatgccacaaagtagccattttgctgacttcaagaaggttctgtttggttaggagacagacttttgtttaaggggaattcagatgccccggggatttacagcttgcacaaaccccctggaaatgggaaggggctgtgtggcgtgtcagcagggagaatgtaactcttctttgatgaatcctccagagttaacaatcctggaatttagggaaaggaggaggctggtggtgatccctggaccatgctggattttgaactccaaataaagaaagatgggggcactgtgcttccatggtgccccctcaattggtgatctgttgaatttccatagtataacagggtttggagtgaatcagaattgctgttggaatggcattttgcattgtaataactaaggaatacagctcatgttcaaagcctaaggaaaatatttggtagatccaagattaaggcaaacatgtgttgaatgcaaatttggatccaggaccttggggcttcagaaagtagcaagttgaccagcaaatgttggcaggtagaaaaacacacttataaggagaaattcagaatttagttgtttttcctactaaaacaacggaaagaaaaggaagggctgtgaagggaagacaggagaattattgtagtgcagaaggagatggcagatcctggtcagccaccaggacaaaggcaacagtgggttcctagtgtcaggtcctagaggaggtaaaggcctcactcctggtgctgggtttgaagaagaggctttactggttattttataagaagaattagtgcaagaggtagcaaactgctcctaactcttcctctaaataaaagctttccaaaacgccatgttgggtatcaatttatattaggtttttaaagtaaaaccactatcaatttgtttttaagaaggaattgtttgataggaaagtctaattggctagaaaagctggcttgttttatttaattctcacaacaactccacttgacacttccgaattcactttacagatgaagaaagtgatgctcaggaggtgatgtcagctgcccacagtagtccaggtgatcagcagcagcaccaggccaccacctgcttcagcccatgggctttctgcatggctgctcttggatcctgataggtcatttgtttgatgcttttgcttcaccagagcgatcatttcatgtttagtttcatgactaggaactggcttcaaaaacaacttctagtgagtcaaaaacagccaaaatggcaaggacggaaaaactccatgggtcagtagaatcataaaggggagagtgcgtatatctgtctgtctctcattctctcccccttcctttgcttcccttttccccctctctcttcctcacattgcctctttttctttctcttctctctgttcttccctttctccattcttgctctttcttaagtcctattaacagcttcgtctacatggcatcgtttttacttgtcagcaatctgcttgggcttattcttagtcattgtgcttgtctttcccattggacgacagcccgatcaatccttttccattctgtcaaaatgggacagtggcagtttaatgactgagtccaggagtgaattggctaataccaagtaacagagcaacagataaatgcactttagatccttaatcctaggcaaggaaagcaaggagactcagccctttctgcactccagaaagaaggccctctctgggctcagtctcagcagagcagcaggaagcacagctgtggggaaacccggggtatatttagtttggccccatttgagctgggcaagtctgtcactgggtctcagcaaagcatcccttgctatttgtgtgccatggccagtgggtgtcctcccaagacgaagaagtcttgggctctctgagacaaccttgtcactgggggcctcttgcctcagaccctggtccttaaaccaggatgatgctagaaggaggccaaggacaagcagagaggagtgactcccagggtaatgggtagctctggacatgaatatggatgatgacagaaagctcctcacagaattgagacctgcctctgctcccaggacagtcaagggaaagcacccagaccaggaccccaccagcagcatctccctcctcatggggcatcgcagccccaggaccttaggacaggcgagcttctttctctgagtctcagctccctccactgtaaaacagacacaatctgcccaatacttccgagatgttgagggtaacactgaattagctatgaacatcttttggaatcctggagcgctgggctttataaggaatcatcgttacatgaaagttctggtttggggggtttttctcattggagttattatcaggttgaatttccacaaccaaaggagttagttgggttgggaaagtcagaaaacattgatttttatactgcttgtgtgccatgtattgttctagctgttttatatgttactttctaatcatctaaaaccctgcaatattaccatgcattagactgatgatgcagacatcatacttctcagtattatgttgccataagtttggaggagagaacaccgaggcttgctttgggaaggttgcttcagatcacacagccagggccacgagttaagaatgccagtttccatctgtcctttcgtattttacttaagtccacagaagagtgagcagaaactgatagaggctagaggccagagatgagccagaataatttgtttggctttggaatgaattgcaatacacacacacacacacacacacacacacacacacacacacacacacacacattgtgttgctcttttcacctggcttgtctctgttctgctttagtttttctcagttgtcaaggatctaggatgtgggtcagctgacagtgtgtttgtcctggagcggtcaccatgggcaccgttggaggagactggttccctttgaagggacgcctacgtaacatcccggccttgtcatcagaaggcctgggcatgagctctgggtctgcccacactggccccatgatgttagccaagtcacttcccgttagttaagtctctcctggtctctacaccagtacagtggaatggtgagttgggactgggtcccaccttgccggtctgagaacaggctcgttctgaacattcactcccaatcatttccatcttcccttctttcttgctgtagggctttggggaacaaaacacaggaccgggggcaatgagtgacaccgaactaaatgtctgccgatcggccggtttcccccaagttcactcactcatctcctggagggggtgcaatgaaagcttgtcctcaatttactttgagatatatcccatgatatttttaagcaacgcatttgtattcctaatagtatttgcctcaggtcctataaaaatgagtccataatccttgggtgaagcccagactccattggttctttgactgctgataaacccattgagtaattgagcccaagtggatagatgtgagtcagttctcatgctaggctcgtacaaatgttctcattgataatgaatggttgtacaaagtatttttacctattatctctttaaaactacccaaagtcctgtgatgataccacgactccccgtagagaccgatgaggaagtggggcttcagacggaggcagacttgcctgaggccaggatcccctccacagctgcaggtggaaccagtgagctgccaggtgggaggcagctcccaggccaccctttcatgcatacttctgagctcccaggggagggagaggcagataggcttttagtccccaatggctgagacccacagggtgacttggctttgccaaacccccaggaaacaggggctgtgggaagaacccagagaaggtggggttgaagaggagactgccacaggcttaaaggggagtgcgctggagttggtgacgttcccgtagcatctaggaatttgagcccatctgcatgaagctctgtaaggctggggactcgctgagattgcagagaggcaggaacagggaatgctatagaaagacaaaaacattttgtccttgagccttctcagtctgtgcaagacaggaaattcctcaactctcccgaggcagccagctctcctgactgctgcagcctagtgagagaaacgagatagatcaatgcatttccaatcctgtgcccccaagcccactcccagagcttctgccaaggcccctggcggccctccatcgaaggctgcggtgctgagtcagcagcaccagagagcagcaggggcctgagagccccatcttccaaggggaccgtggggggttacctgctctcacactcaggctccatgcccttcaactgcacctgctttgggggaagttttcctccagcctcctggaccttcccagcctctccccatccaggttcccagaggctgggctaggagagttctacagtaggcctgctttcattttcagtggcagtggataaaaattcggtggcaactttggaggtgacacctgcccagatacattacataccctggaaacctccccatggctccacttcctgaagaaggtctagtatttgtggtcctgtgttgagaagaacccaaaatgcctgtggccctttccccagaaacttagggtttaagttagagatatcctaaccctccctttctcaacagttgaacctgccaaaaacaaaaacaaaaattgctaaaatggcattactgaaagtcaagctgcctggctcacagaaccaagggagagaccagaggctgggcagccatggcttgtcctgcaccaggattgttccctgtgagacgtggatggcagggccagccactctgcagtcccctccccttcagctcctgtgaggcagggattctaagcatgaggaaaggctgttcacccacctccacaagaaactgaatgtgagtgaggcgccaggcctctcaccctcctccttgacttgccgacacactccctgtctcagagaaattgattttttctcccagtttttattgaggtattattgatgtacaataaactatggagacttaaggtgttcagtttgataagttttgacatatgcacacacatgaaacctttgccatgatttttaaaagtgaaattctcattgtccccaaatgtttcctcatgcccctttataatccaaccccccgtcccctgccccacaccactactgacctgctttctgtcactggactttgcattttctagaattttatataaatggagtcatccaacatgcactctctctttggcatcttcctttttttttttgagacagaatcttgctctgtctcccaggctggagtgcagtggtgtgatcatggcttactgcagcctcaacctcccaggctcaagtgatcctcccacctcagcctcccaagtagctgggactacagcttggtgtctttcattcaacataattattgtgagattcatccctgttgcggtaccctcagtagttcattcttttgtgttgctgagtaatattccattgtgtggatatatcacaatttgttttactcacctgttaatggacatttgggtcatttctagtttgcagctattgtgaatgaagctgctctgaatgtttgtgtacaagactttgtatggatatgtgcttgcgtttctctcagggacatacccaggagtagcatgactagatcctaagggaagtatatgtttaactttttaagaaactgccaaaatgttttcagaaggttctgtaccacctgccatgtatgagagatgcaagtttttccacatccttgtcaagaccaattcctgggatgtgatgtctttttatttttagccattctaatgagtgtagtgtctttggcttttgtgaggtgcttaaaacctcctaggatgggaatggagcaccatataattatcgaaaatgacaaagaagctcttcagttctgtcttatgagagacaccaagatgtattgttaaagggatgccaagcattttgtgtaacgtgctttcatttacttttttaagaagaaaataaatgcctgtttgcttctatatgttacacacgtagatcatttctggcaagatgaacaagaaactgaaaactcgttgcctctgaggagagatcactggtggctgggggatggggtgggagggagacttgccatactctttggtaccttttgaattttgtgccatgtgagtgtatcatttatctgaaaaataaataaaatattttttaaaactcacaaacttataagaactcattgttcattcctggctatcaggcaagaacatcgtcattgccaagcagagaaatgggaggcatcttgttcctaatgatctctagaaactccaaacactctttatctgttagctgccagtttctggtgggaactgagcatcaacacagtcatgtaccaagtggtcatttagtctgtgtttgttgaatgaatgcatgaatgttcaccccacgttctgttttctaccacacagaaaagaagagtagcaggaagagtgagtaccttctgcctgtggctcccagcaagcccactgcacccatcttcctgcagggcctctctgatctcaaagtcatggatggaagccaggtcactatgactgtccaagtgtcaggtctgtctctgcagctctctcttggggattaacatgaaaatggtcttggttgcaatgggtattgctctccgaggacccgctcagatccttgatccaccagaaaatcagatgggaccatcaggtgatggacccaaagaaatggagactcttgtcctctcttttctgccttctctgggtaggattttctggattcatgattaaatggtccagaggaagaagatggccatagagctagagcagtgaaagattaatttgaaaatatagtgtggccagtgtagctggaaggttttgaagactggtacaaaaccagattatgggccgggcacggtggctcacgcctgtaatcccagcactttgtgaggccgaggcagcagatcacaaggtcaggagatcgagaccatcctggctaacacggtgaaaccctgtctctactaaaaaatacaaaaaattagctgggtgtggtggccggtgcctgtagtcccagctactcgggaggctgaggcaggagaatggcgtgaacctgggaggtggagcttgcagtgagccgagatcgcaccactgcactgcagcctgggcgacagagcaaagactctgtctcaaaaaaaaaaaaaaaaaaaaaaattatgtgagaacttcccaaatctcagaagatgttctcagttgcactattcaaattttaaggtcctcccaacaaacccatgaggtagatcctgtttgaattcctattttactgatggggaagtgaaagcatagagagttgttggagtgtttcatccaatatcactgcattcagcgcagagttgctgcatggccggggaggacctccctaaccaatcccccttcccctcctcctggttcagggaatccaccccctgaagtcatctggctgcacaatgggaatgagatccaagagtcagaggacttccactttgaacagagaggaactcagcacagcctttgtatccaggaagtgttcccggaggacacgggcacgtacacctgcgaggcctggaacagcgctggagaggtccgcacccaggccgtgctcacggtacaaggtgaggctgacccactcagagcgagtgggaaggagatgctgctgcagcccctccaaaagtgatttggaggcaaggaaaccacatgaggctactttgttcccactgagggccctctcgtccctcagtcccaccccagccccagaggccagctccctgtccaacatcacaagctctgactgagtggggctgcctttcccagctttctgaagtccctgccctctctgggttactggtgccaaggtgcatagagtactaagagggaaatctgtaatacacttaacaatttggcagcgatagattttgaggtgagttataggcttaacagggtccttgccattagataacatatttaagaggagaggcaagttaagcacacataaagtgagtgacaactcttaatcacacgcattggatacagatcattagcacctggctcggtgccccgtgccttctgggctacctccccttacattggatatacagtcatgttaatattatcctctgagaatgtatccgagatggatgtgcaatgagaagggtgtgctgcatttgtgtatccaatcacagtgatttctggacaatctgttacttgggtgacatgctatcttcccatccttcacctccatggagaattgagtggacactgcctgctgagggacatccctgtttagctctgccctttgccaatttccagagcctcacgatggcacccagccctggttcatcagtaagcctcgctcagtgacagcctccctgggccagagtgtcctcatctcctgcgccatagctggtgacccctttcctaccgtgcactggctcagagatggcaaagccctctgcaaagacactggccacttcgaggtgcttcagaatgaggacgtgttcaccctggttctaaagaaggtgcagccctggcatgccggccagtatgagatcctgctcaagtgagtctgcatgtccagccagcctcccttaacccttccctccaaattcctagctcccctaacctgggtctgggcagccagaagaagcacaaactgatgtggggcttggacttccaggtaaagcaagtgcgggctcagtgctgctcacaagcttttgcttcttccacttcagtatagcaaatgttcattagaactttcccttttgagctcagttccccagaatcctgtcttgttacatccttgttcccccattatgtggtgtatggtgagtatgaaggaaggaggaatggatcaaagttggaaaagcagggggatagggggaatgcatttgttatctgttgctgtgtaacaaattaccctgaaacttagcagcttgaaacatttatcatctcccagctgggaatttggaagcagcttagctggatgattttgaagtttcagtcaagatgtcagcaggggctgcagtttctgaaggcctgacggacactggaggatctgcttccaaggctcactcccgtgactgtggcaggaggcctcagctcctcactggttgtaggtgggaggcctcggctcctcactggctgttggtgggaggactcagctccttgcgttgtggacctctccgtggggctgcttgagtgtcttttttagcatggcagctggcttccccagagctagtgatcgaagagggagcccaggtcagagcttgcagtgtcttttaagacctacccttggaagccacacgccatcacttccgactttgttagaagtgagtcactaagtacagcccgtactcaaggggaggtaaattcagttccacctcttggagagaagaatttgcagacattttaaaactaccacagggaggctacctttccccattacttttttctctccttttcaagggcttgctaggttacatgggaaggtcagctccatgaggcacactgctacatttccatgaggcacactgctacatttccatgaggcacactgctacatttccatgaggcacactgctacatttccaggcctggaacagtggagagcccatagtcgacattgggtagctatttattagatgaatgtgattcagaaatgctcttttaccttgaaaatgccctgtctcttaaaatcctatgccagccctggattgatggagacagaatgccttctgtgggtcctggggttggtgtaagcatcgaagaagagcatttgtttgcacctaacctacaaataggaggtcgtgccacatcctgaggatggttagacctgtcctggcccgggtgcctgaccactttgcaaggggctttctcgcctgtactttatcatctccccatgctgagcccatcatgttcacagctctgagctacaaataagctctagagctaaatgccaaggctactgcaaaacccaatatgtaccccatccccttaggtcctttgtgaccatgtgctttatacctgaatcagttatcttttgctgcataacgaaccaccccaatacttaataactattaaaaatagctcgtttatttttaaagcagtttcattatttcttaggagtctttgggtctcctataaagttctgctgatttaggcaaggctaatctcagctgagctcaatgacatgtctgttgtggtcaagtgatgggatgcttgtgagctgctggtccccctactattattagcggtacactcagaatgcatcaactgcctttgcattatgcttgaactagttattaccaggaaggccactctgcctccaaaatggggagaaggtacacgcttaccccctaggtcagtacaaagaatggaaaccgatgatgtgtaaaaatacctgctgatgatctcgtcagtatagaaggagtagcactttgagataatacttacattactcaagccagacatcctagaggagatgagcttgtttggggattttgatggaaaaggaaggctgaatcttggcaaatgtgataaggcttagctgttgagtaggccgagcaagaaagggtggggtgggggcagagccaagcaaagggctgtgggaagtttgccaggccagagaggaggcgtgcaccaggaggtcggcaggcagactgtctggggccagctggggacagtcataaaatttagactgtcccagcaggaaggggcttcagaagttatccagcctcatcgtcatttaataacgggggacactgaggtctcagggtcgtggacttgcttgtggccatccaaaggcaagtaacagagcccaagttcaagccctcatcttttgacttaaatcagatgctcttccattccttatggctctgcttggggagtttctcccaagtgcacagggaactggaaggacctgggaaaccacactggagcctccagcctgcagcctttgcctctttttcttccccaaagtccagcctcttcattcctttcggaggccactgccctggccttggctttttccccacctgagaagaagcaagtcagtggagagtttcctgagggtacgtggcaggcctgccagagacctcactcctccagcaacctagacgtagagcagggtgcctttcgaggggaatgactggatggctgggaggaagccgggggtccggtgtgcagggggtagaggggtgggcagatcctgcctgtccctgctaggattgtgaggcaggtatgggtgggtagtttctgcctctcttcccttcctagctcttgtctactgtaccaaaaggggaaatgacaaaaagtcagctcaaaattccagctggaatacttgaaacacttgacacttgccaggaaattagttcttttttatttattttttattttttgacagaatctcactctgtcgcccaggctggagtgcagtggcacgatcttggctcactgcaagctccacctcccgggttcacgccattctcctgcctcagcctcctgagtagctgggactacaggtgcctaccaccacgcccggctaatttttttttttttttttttttttgtatttttagtagagacggggtttcactgtgttagccaggatggtctcaatctcctgacctcatgattcgcccacctcagcctcccaaagtgctgggattacaggtgtgagccaccatgcccggccgaaattagttctttaaagtaatttttccatatagaacccatccaagaggtagatgattcagggtgggacaggatccaaggctttgtaaccagagtggaactcttattcagagcttagtaagccaaggcaaaaggactctttgtgaaaggttcagtttataggatgatagccccatatgctctgtggcagctcctgggatggggcctcatcttcagccccggccctgattttgtaactggttatgtgcagatgtcaaagatggccccaagaccctgttccagcagcttaggtgatctgacatgtgggtcccaggcaggaggccactatgaactttataggctgcaaatgaacccatggtttgctttaaaggcccagcagagatttaagggtatggctgtaggaatagttactgctattgccctgccaccaggtgatccacttaatgcgtcagcctttgtatcccaagtcctccacctttctctgaccccttagactgctgggggccacagggtaaggcctggggctggattggacaggagcccttgagaggcttgtctgagtctgtgctccccaccttgagcacaggtcatggaaagtgacagaagcccttacctgcttcccccatggggagaatcggcttactccagcttgcggcacagggctgtccaccaccaaagcctcagaggagtccagctggggtaaagccgccatctgggcagtgtctgctcctgatgtttgcatctgggctgtgttctactggtgacaggaggaaactctgctgaggagatgctgaaagggctgccaggcaaacacagcccttgggcatctcatcttcctgctccatgtcaacccaggcaccacaaggctgtgcttaaaggtaggaaaagagtggcctgacactggccagcagcctggcagaagcagggtgacctcacacagttattctacaagctcacccaaagtccataagcctttttaagtgttgagaactcggggcacactgaggacctcttcgttctcccagggcctggcacccatgaggtttctaattgctgtttgttgagcaaaggaacaacctgaactcaaaattctccagacttgagactccctgcaccttgaatctgtgccctctgacagtctgagcattgaggagggtggctgggaggggacaggctatgggatacatggccagggaggagagaggagtgaaagagctaaggcagtcaggaaggcacctgcaccagcacagcctgggacagcacgagggcactggagagaaggacaaaggagaggagcccagcaggcgggaggagggctggaggacagcaacgattggcttctccttgcttcaaatgggtgccagcacccaagggtgagcagcgccccagagcccctgagaatcctgggccaggccatgggctaccagtgtctgtccactgggagggaggccaggcagagtgaggtggagacccacacacgccagcagaatacacaagaacgcatgctcagatgcctgtccaggtggatgtaactcatatgtgcacatattcccaaacacagacctccaggtgcaggtgcctgccagctagaccagtatatgtgtacatcatgtgtatggttgataactacatatgtgcatgaacacacacatgtcccagaccagatttgtactgataagcacagtagggtagagtgcaaaggtcatagggtcacaggtcccaacccctccctccactagcaagctctgtgtgtttaggcaaattacttaaccttgaccttcagtattatattttttaatagaggtaaggtcttgctatgttgcccaagctggtgtcaaacgtgcgagctcaagcaatcctcccacttcagcctcccaaagtgctgggattacaggcatgaaccactgcgcctggactactttacctttataagcctcatatttcttaccttataaaaacagtggtgactctaatctcacagagctgttctaagattaaatgagatggctcatgtaaagaatctgtcacagagcttggcacatctgctattgggtctgagtgctagtgagacggccacatccaggggcatgagtgggagcactgttgtcagagaccctgagggtcccaccccagagccccctttccttatctttaaattgggcatggcagtactctatacctctctggcatgctgtggatatcaagaaagaactgcgtgtgggtgtcatgaaagctggagggtgctgtatgaaatgcagttgttacaaccatcactagtcacctctggctcgcagacctgcccccaccccttcccctagcctgagcagaaccttcttgtctggtcagagctcagaaatgccagcaggtggcagccttatggggttggagggacaatctgctgcaaatccactgcactgtagccagacagggtacagcccctcccctgagcagagggcctgagcctctgtgcaccagcaggagactgaccaggtttatggacatgaagaatccagagccctccccacctgaaggaagaagagaaagggccactcatgtaggaaaacacttgttgggtttttaacacaaaaagttctgatctgagagcattatcaatgagtgggggttaagggtgcttccattcccgagcaagagagggaaaggaactacttctgtgttaagggatcatggagtcagagtcaaggtcactgggcaggcccaccaccagggcctatctgtctagaccaacctgctacatcacagttcccagcagggttagcctttctccttccccttttattggttgagtgagtgagtgattgattgaatgattatattatatacttacagaaaagtgttcctatttctggatgcctgccttagctgttgtccagacattctttttttcttcttctttttaaataagagctgagaaaataaagggtgaccacacagtgagagggtcctgccctaaatctaaggctggggtgaatgtctcagtcaagccggcgacttccatcttccccgctggccagcagcctgtgatcaagtccacactgaacaggccctttgcccagagggcctcttgatctttattgatctttggaattcttcaggaaccgggttggcgaatgcagttgccaggtgtcactgatgctacagaacagctctgccagagcccttccacggtgagtgcccccaggagctgcccctccaggccatgcccccatccccaccttcctcctggccccggcagctccagcccagcagccctagattgtttgtgtcctgcagctgaggctgccaaagccagaagggagagcctggaaggggaatgagggagggagagcaggggaaggagggggtgattttttttttttttttttttgcacacacccttataaggctactgaagtcattaccgatgtaataaaccaactaagcaagcgagcgcctctcaccaatgttcccatctataaacacagcctggccggcctcccccatcccctcccgctcccctctaccctcccaccctcagggatttgctctcccctgaagtttctttcttacccagccccttttcctcctgctactttcctttttccctacactggttgcagggggagggagcctgccagctgcgaggacctctgtggtggaggagttggtgctgatggtggtggtagtgaccgctatgggtccctgaggcctggctggccagcaagagggcagggttggctagaggaggaagacggcgaggacgtgcgaggggtgctgaagaggcgcgtggagacgaggcagcacactgaggaggcgatccgccagcaggaggtggagcagctggacttccgagacctcctggggaagaaggtgagtacaaagaccctatcggaagacgacctgaaggagatcccagccgagcagatggatttccgtgccaacctgcagcggcaagtgaagccaaagactgtgtctgaggaagagaggaaggtgcacagcccccagcaggtcgattttcgctctgtcctggccaagaaggggacttccaagacccccgtgcctgagaaggtgccaccgccaaaacctgccaccccggattttcgctcagtgctgggtggcaagaagaaattaccagcagagaatggcagcagcagtgccgagaccctgaatgccaaggcagtggagagttccaagcccctgagcaatgcacagccttcagggcccttgaaacccgtgggcaacgccaagcctgctgagaccctgaagccaatgggcaacgccaagcctgccgagaccctgaagcccatgggcaatgccaagcctgatgagaacctgaaatccgctagcaaagaagaactcaagaaagacgttaagaatgatgtgaactgcaagagaggccatgcagggaccacagataatgaaaagagatcagagagccaggggacagccccagccttcaagcagaagctgcaagatgttcatgtggcagagggcaagaagctgctgctccagtgccaggtgtcttctgaccccccagccaccatcatctggacgctgaacggaaagaccctcaagaccaccaagttcatcatcctctcccaggaaggtaaatgagcatgggggttggggaagaaggggcctctgtaccagggccactcctagctcatggagcgttggtctcgctgacccctgttagcagcccataggtaggctgctaacctggtttagcaggtaggagggcctgctgggtaggagggccgcgtccctgtttcctgctaactcaaggataggtcccggctcaggggccttgggtacatgcaccaaggctggggctaagggctgggatcctggtccttgtggcacatgcccacatctcggcacccatctggcagagccctctcatggcaccgccacctgtggctccccagaggagacctgagcctgagttaattccaagctccggcatggagagggctctgtctacaggcttggaggtgggggacacagaggctggagccagggagaagctctgagtaaagagctgtttagagaagcatcttaggtttggggaacggtgtgcagtgaccagatggcacggagctctgagttggggtcaacaataacttcagtcttgatagcactgtgggtttgaagggatctgtcgggaaacccaaaatcccaaaacagcccctacagcacacactcacgggcagacagagctactcgcttcctaatttggatgagacttttgtttgctggtatttcacattcttggatggtggggagaggaggggggccccaaatccttccatctgtgtggacttttggggtctggagttttcagaggagccagtttatacttggagaagagatgggggtgacacaggagtattttctctggaccctcaatttggtttgaagtgcttttgtaaatcccaagtctgggtgggagctctgaggccggccgacctccacaccccattctggcagccagcggagggataggttgccagcacagaacagagtcctgcctgagctgatgctggtggctccagacagggtagggtacaaagaagctcccaggaagtgacatttcacccttgaggggcagagggcagccacagaagaagccggagtggacaggtcctgtcaaatctgagtcagctgaggtgtcagagtgctcttcctgtgggctgctcccctccctggcccctggcagcaccctccccactccctccctcaccttttatcgtgcctgccttcccctcacaagcagaatggagcatttgaagatcacagaatccctctcagcccccggtaagggtctgtcttccctctacatctgggacagcacacctggagcagctgagtatattgaatctcagcgctgaaagagtgaaggggacactggctggcagagagaaacatgttattttctgctaatgtgttgacgcagtaacttttccatgtggatgtcctcagattggcagggtcctccagaagtcgtctcctccatcccccacctctgctggctcagcccccctcccctgaggcatgggggattattgggctggggtgagacttcagaggagcagacgccacaacctgtcctgccgcccctgtggggctctcccacttggaaagtccttggtaaaactgattggaaaccctgactgggaacatttcccaggtcaccctacggtgatctctccaggcaggatgcagggtggcatccaccatcctcaggacaaggttggggctgtcccctggctctctgatctcttttcattatctgtggtccctgcatggcctctcttgcagttcgcatcattcttaatatctttcttgagttcttctttgctagtggatttcaggttctcatcaggcttggcgctgcccatgggcttcagggtctcagcaggtttggcgttgggaggtctgtggctgctccagcctcagggaaactgaggttaagtcagttgggggcagctgttcttgggcttgcatggggtttaaacccagagccatcaacagccacttacaaacaattcactcaactaagcgatgtaaggcagaccccaggcctggtctcagaaactcttctgagccattagccactgtcttctcgtgccctgagtgcctgcagtatgttttccctgctggtcccttagtggtaaagagcctagagatcctagccactccagcctcccttcccatggaaaccgtcccagagggaacagttcagatccagagcagcagcagaagaaatgatccaaggaaggctgcacacgaaggggagagagagaccaggagaggtggaaagggattccagagagagccccaaatcaaactgtaagacatcttctaaatatttttaaattgtgtttaaagaatagctgacatatgttgaacactatgtgttagacactatcttaggcctcttacacttttcacccatttaatcctcccaacaatgactgtactgtccacctaacagagaagttaagtaccttgccaaatgcaaggtgctgggggtaacagagctgggatttgaactcaggtggctgagttcccgtgcctagaccaccgtgctatatgacctcttagttaattcctattattttatcagggtactggtggcagctgagaatttgtctatcaacagaaaacactaatgactatttactcctcgattttgttaagagttgtccaaaggttgaaacactgatggtgcccctagccttgccaggtttctggtattttccctgcagtggtggaagcagaccttgcaatgggcctgtcttgcttcagtacaggagagtgcgttgtctcaaaaaatcggccccaccttctgtcccttcactcgccaagacttcaagagcccagtgttttgttaaggaaaaaacttatcttaaggcttcatctatcagtcaccatttaagcaggtccctcctcaggcagtagggcattctgagaggtggagggagtcttttctcaatagatgtggaaggagaagacacactcacagtgataaaattgttacagccaagtgctgacaagtgctatgagtgtgtcgggaggagctgctggaagtgggaagagagggagctgagtgctggactttgatctaagccccgaagacaggccagaggggacgggcttccaggcgggggccccgcagcagcagaggcgtcctgctaacagcttgttctgggctggagaggatgacatggccccagtttcatcctatattctgccaaggaattccagtctaaaggcagtagggaatcatgcaagattttgggatgaagaacactgtacatgaagctcagtttaggggttttggtggactctgtgcccaaaagacaaatacagagcctactgaagaggtcgagaggaagatggtgaggcctagactagcgtagtagccacaaccacagtcagggaatgaccagttcaagaagcaaggatagaagtaatggcacctgttgcctggcttggaagggcaggatgggggtgggggtaggtaaagaagatgaaggaatggaagaccactaagtgtgggtgcctgagtggctggggtctcagtggtcgtgtcagtgggaataaggaagccggtggttggaggaggcttctaggggaaggtgagggaatggctccgctggcctcccgtcctgcatccttcacactcagctcagcactggccctgcccccggcttcctgacttggagccctttttgctccactgcactgatccccaccctgtcagctctgctacaaacaagattcacttcctccaggatgccttcctgttgtcacccacctttggccacgagagactcttgcactgtcccctccccatcaacctgtgtatctgcgtgcaccaactgctagtggacgtgctgtttataggtttcaggggacttctctgatgtctgtagcttagatagggctcatagcccacagacccccacccaaacaggattacatcaccccatttagttcaccccctttcgtgctgaggaaagcagaagaggtttgacagccatgggctagagttcaccactagttgatttgtggcaggacacagacacgtggaggtgtccttcctcttcctgtacccctagagctgcagggctgatgggattcagagttaccaccaactgggcctgccctctgcccccaagtcttttcctagcccttccgggacctgcctctgctgaggggtggtgggaggccgatggtcccgtgagctgaggggagctctgtggtggcctgagaagagctttatctttatgctttgtttcctgtctccaggccaggctcctcctcctggcaaaacacttttccgagtctaacaatgaggattcatttttgttgctgttgtgaataggtaattcatttttaattgccttcagggtagaattttgcaaaggctttttaaaaacccatgtaagttcatcctacgaaaaatggatttatgcagcatctactatgagcaaggcattattctaatgccctttgttgtgtgcataatccactcaaagaactctgaattttcttttttcagaaactatatattatctttttcaatagtaagttatatttaactgtttgtgaccttttcttacatagatcctaccagatcacctgctacagaaatatgccttcatccttctcagaatgacaaatatgttttactgtgactgcattccaggcttaggaaaaacagtggtgttagacagggtcactgccctctgagagctggtgtgggagacaggcatgcaggtcagcaatggccttgtgagccgtgctttgacatgggtgagctcagagttgggagcacagaagaggtccgcctaggcctgggggattagggggaacaaggaggacaccatgcctgcaggggtgacctggagatgagtcttactgtctgggcttgccaggtgggctgggtaggctgactgaggcagccctatagcagagcctccaggaagctccctccctccatccacatccccttcctcccctctgcccccaactcagaaaaggagagagctgggggagcttcagacccaggagcgcttactccaccacagccctgaggggctctcccaggcggagctctgcagtgatgctgacctctcccatccccctcatctccctctcagaattccccaccaggctgaggcttctcaaaaaaaaacctctgggaaacagcttttcttctagaggtcaagaatgaactgtcccacaggaaataccagattcttcatctggggtagccaagcctgcaagcctgctaggggggcctccccaagcccatgcacatggccaggggtccaggctctgggcaggttggaaaagctgcctgccccatgccttgccctgggagaggaggcaggggccgggtccacatgcccctctactctctgtgtactgtctttgcagcttgtatcattttgacttaagactcaaggcagctgagggactgaaactgaaagaaaatcaaggatttgaacaggatgtgcgttgggggtgggatatctgttcccaaagccttagccccaccctgacttgagggaaaatttccagatgggattggtctctgctaagcctctgagcccctctagttggggccagaggtcatcttggcatcctcccgcccacccagatgaatggaaagttctctctccaggacatggttatcctcattccccactcctgtgcctcacgattcttactcttatgacagacttcctaaaattccagcctaaatcctctccattacagtttctacaaattctgactcctaactacaaagggaagagaacagagtgaagccttcccgaggtttggggtctgtataagggtataggaagtggggagtggggtgcagatcagccctcttgccccaggtggtttataggatgaaggtttctctgtttaaaacagtaccctggtggcaaggagtaaaggggaatattacacccttccttcctcttccagccttagtgaggttttctgggcagaactgatatccttactctttctaatctccttgtatttgctggtcaaggctgtgcatttgtgtaatggggggcagggacagtagttggtgtccactcagaatgcacccagctcttccctcccaatgccagtggcttgtgggacatgagatgggagctccaggcagcaaagtgcatgtggccctggctctgtcctcctgtgtgacggttgcttccctgacaacaggggcagctttgagcaggatgccctgctatttacttgtttgtgcatctgaaagcaagaataaggaactgctgcccttctgcctggcccagcaggcctctttccacaccctgagggaacctccccaaggggtggcccagaggagaagtaaccagttctgggatgagagagctggcaggggccaggacgagaccctagattcctgtgtgtgcctagctgacacctccttccccaaaccaggccagaagatggtgctgggagtgaaggcaggcccaggggagagtccatggagaagaaaggccatccccacttctctctggggcaaccagaagacccaactccgaagggaggcagccccagagggcccctctgcaggtccagtccccctcattggccgtggttctccagctcagacacctttcctaaaaagtcagctcctgggtgtagtcaccacctcccaacagatcttcccacaggccggtgcccctcctggacaagggctcctagcctcctccacccacttctttgctcaaagcttcaaagctcccttttccagaatgcagtcacagcatcactgctgtaaacaaagtgggacctcctcacctgtcactgttcctaacacaggtctgtaaccctgtgtcggactccttttctctcttggtgacgtccagggggcagggcctgtgtgcatctccttgtattgtattggatggtctccaaaggcagaggctatttctctcccttcttttgcagctttctattatgtccccacaagaggactctttggagtgggggaggaggtatcaggaaggaacgtatttagggatcagttattttggacatgggttataagcagaaagttccctggctttggtgaggagtgggggattggttcccacaaggcctctggcttctgggctcccagaggctgcccgtgcgagtaacactcacctgctgcgctccagatgccagggcaggtactacgaccacacctggttcactccacaattcttcctccccaggctcactctgctccgtctccatcgagaaggcactgcctgaggacagaggcttatacaagtgtgtagccaagaatgacgctggccaggcggagtgctcctgccaagtcaccgtggatggtaggtcgtgcccacccatcgccgccacccatacacaggggtcccatttctcagcccctcccttccttaccataccttgcctgtcagacagaactgcctccaacactgccctccctacccaaaggcattcattttggatgaatgaatatcttttgccaaaagaaaaagagacaggaaggaaagtggcagctctacttgatcacctacatggcttcacccctcccctggctgtcctgtccccctcccagtcctgatccccacacccagaaccttctgagctgggaagctggggcactgggcagtagaaaagacacacccacaggaaaatgactacagagtattttacaaaagccacaacaaacaagtgtccgagctggcaggacgacccagcagggtcagccgtgaggaggagggagcagagcgaggtccgtgtgggagacttcctagaggaggtgagtcggggctgagtctctggacagagaggacagggcagcctctgccaaaacaaaatggtagtagtaataataatactgcagagggaggtgggaggacacatcggggagaaagcaggcctgccaggtcttagcggagtttctgtgttaggaagaggcagtgccaagctgcgaggaactgggctttgtcctaaggaaatgcaggaagtgcattcatgactcttttttctctccttcctggggagtatagaattggaacctgagaagtaggatgaacctcgtgatgatttagatgaacaccctcattttacagataagaaactgagggcatccagagaggaaatgcattttggaggggggctctctggcccatttagggccaagctggggccagaaccccatcccaggactcacaacccaggatcatttctttgtatttggcacttacctggaaatgtctcaaaaggtagttttggggaaatagtttcttgcccttgaaatgtctggttaataaccatcagagacacatcaaaaactagtgtccaaataaggcatcttgaagcccagcttggttgttcttctccctcctgtgtgtgatcagttgagttctgaagtcctagcccgtctcactgccattccacaccatgtagagcccgtgtcctcattctggactttacaattggtttcctgatcacagagctgagctctatggaacatgatgaatgggagagaggtggaaaagaaagtcttttttataaaaacacaatggcagcacgaattaattgttaatagccgaaaggtaagctgaactcatctaatactgtgtacttctccttggagatcgtgcgtatatgtgctataggggctctgagtctaaggaagcggacttgatgtgtccaagtttatgctcaattcagagggggcatgggacacattttgaggttctgcacagtggatgctgtggctgatgactcctgtgtgggagtctctcctcacccaggctgtcacccacccagatcacagtcctgcttctttctatacaggtgctgcactgtaaagtatagcgtttctgaaaacatgatccttgaagcccacgtctaacacccctctgctcgtttgggactcacactggttcccgagctagtgaaggaggttatcggctttcggagcctctttaggtcctgtttacatggctagctgaaggcaggagagcaattcattctccctatctgtaaaatgtcagcaccttttctagatttgttttcaagatgaaatttccttttcccctactgaatacacttggggattttttttttaaggtttggggaattcattctgcaacttaaaaggctttgtttgcccagagtctgctggcagattcccttgtcctctccactaatcttgatgaccatcattatttatccctaattccttcaaatgcagagttaggcctccagctgcaaattgggagctgggtcttggaagaagagctagaaaagtgataggagggagcccagctgagataacaggactgactctcagtccattgggtttggttttgttgacagaaaggataagggtggcctcttccccctgcttttctttccctgttgctatacttacagatatattagcatcctgtttgcccacatttagctttattttttcatcaagagcctctctaggaaagtagtaaaggactgttgtcactttgacagctcccctgtcgcctttctatcgtctggtgctccaccccactggctaggctacatctcctgccctcattctgtcccctcatcccctcagctctccctactccccaaggcatcatacttgacttggggatcccagtgggtttgtgcctcccctgaaattacaggcaaaatgttgcattatgtgggttggagcatctttctgaagagaggggtccatagtttttagtcaaattctcaaaaggagtcatgaatcagaatacgttgaagaactacttgccgtaagcagcaacaatgactgaattttcaagcccagccattgtgtgggctcttccagcctgtctccagctgcaactgcccacccaacctctgcatagaaccaggccttcatccctcttatggggcaatgaggtccatctccactaggcgatgggactacagctggtgctgacttcagactggcttccccagccactcagcagggctggcctggcccctgaaagtcgctatcattcactcatcctgtgccaaacaccatcgagaccatacatctgaggccaacatatctttcaaaatctcataaaaatgaggcaaatggggctaaaatagcattacccacactactgattccctcatatcataaagataagggatgtaacctttataacacagcacagctggctattttaatcatgtgtttgggtctttttcctaagaaaaggggtgtttatgaacttgcttgattatggtcatatcacccttccttctgaactcagcagaagacaagggttaacttgtgccacatagaagggagctaaaacctagagtaaacgtggacttgcccgaaaactcacccaggaggagaacaagctgaccttcaatgcctgtcctggccagagactcttgtgcactttgcattttcagtctatgcaacagttgggcagggtgtctttctcagtgagcaaactgaggctcaccaagggtcagctgccttccaggccccacagacagtaggtgtagatctggtgttggggctccaccctgcacagtgaattacaacatgaaatatcctggcaggactcagtggtctggctctgaaacctgttcctttccacagcctgacacagcctccccgggcagtgaattaccatggtggggcccgctcccagagtgatccagacctccctgagtaacagtcctccctgtggggaggtccttctgcacgtgggactcagtaacccctttcctctcattccaacccagatgagcagtgaggaaactaagtccttcctaggccagaatcccatgagaggactcaaaaaacaccttagcccctcactggctcatccagtcattctcaactcaggcctcctgtccccagccaccctggccagggcatccagcttttggtaccagtgagaccagggctttgtgaccacagagggtcatgcatgattgtgatgggaagggacactccagtgggtactcatgccatcactcagtcattcaactaatatctgagtgcccactctgtgccaggcactgccataggagctggttttaaaacagtaaatgaagtaggaaaagttccagcttttgggacttttctagtgggaaagaggcagtaatgcaggtgaacagctgtgtcatatcctcaggtaatgtcaccagctatgaagaaagcaaagcagggtaatgggggagagaataccatttttggagggggtggtcactgaggcccctctgaggaaggaacatttgaacagagactgaaggaagcagggaaggaagagggacaaggtgacaacaagagcatagccctgagctgaggacactgtgcttaaggcgtttcaggaggcaggaggccagggtggtggagccatgagcaaggggcaggatggtaggaagtgaggttgaggaggaccgtggaccagatccaggcagtgttggctaggacaaaaaaaatgagattttattctaagtgttatgggccaacactggacatttatgaaggatcactcatgtccatgtgatgaccagacccaggatgagtcagagggaaagcagggagcacaatggggggttgccacaatagggacaggaagtgatcagattcataacctctttggctgtagagctgatatgagttgctggtgagctgggtatggagagagagagaagttaaagatgactcagttttcatgggggagtgaagaccaatggtggggctggggggcacgatcaagagtttagtgcatgtgaagtttaagattgctatttgacctctcaagcggtcctgtcacataggcaggtgtttaggtgaacctggagttgagggggaggtcagagttggaggtgggatacagggagccatccacacacagaggccattcactgccctggggttgaatgaggtccctggagagtacagaggtggctataagaagagggagagagagagaggcaggggcaggacaggggcctgcgaagaagactaagaaggaagtactccagtgagatgggaagaaacccaggagatgggggtgtcccagaaaccaaatgctaagaacttcaaaaaggaaggaatgatcaagattagtgtgccaggccaggtgtggtggctcacacctgtaataccaacactttgagaagcaggtgaattgcttgagccaggagttcaatatcagcctgggctacatggtgaaaccctgtctctacaaaaaatacaaaagttgcctggatgctgtggggcatgcctgtagtcccagctactcaggaggatgagccaggaggacagcttgagcatgggaggttgaggctacagtgagccaagattgtaccacggtactccagcctgtgggacagagggagaccctgtcaaaaaaaaagaagaaaggaagaaaaggaagaaagggaaggaaggaaggagggaaggaaggaaaggaaggaaggaatgaaggtaggaaggaaggaaggaaggaagaaaggaaggaaggaagggtcaggtgctgctgccaaataaagatgagcctgagcactggctattgggtttgccaacattgaggtcattggtgaccttgcaagagggcttcaggggagtgatagtaacaatagcctcatctcaggcaaacagagactgagtcacctgctcaaggtcaccctaactagcagagtgggaagttaaacccaagccttggtgcctaaccactgtgatccactgttatcttggcccctgggcacttctgattattgctgagctgattttgatccacccctcctttcttggcctcagccctgccatattactaagtctgctcccacccccacatttatttatttatttattttgagacagagtttcactctttttgcccaggctggagtgcagtggcatgatctcggctcactgcaacctctgtctcctggattcaagccattctgctgcctcagcctcccaagtagctgaggttacaggcacccgccaacacgcccagctaatttttgtatttttagtagagaaggggtttcaccatgttggccagtctggtctcaaactcctgacctcaggtgatccacccgcctcagcctcccaaagtgctgggattacaggcgtgagctaccgcgcctggcccacatttattctttaaatcatcacagacaactaacgggtattatgtgaaactaaataaaattgctgtttttgtaggtcaaaaacacttcaatactggcgaatggtgtagttcaacctgatctgagcatacaaagtacttagcaccgtgcatacatggagtcaatacccagtaaatgtcagccatcaccttacgacttggccacacctccctcactcttctattgaggtgatgttatttcggttttccttgtgaggaagctcagactcagaaaagttcaggaacttgcccagggactcacaactcctaagcagcagagccagaaagcgcaagcatcctgatctctcttccttactacgctagcacactgcttgcactcagtcagagagagaggccagcaaggagggatgagccaacccagggagaggctggagcccagcccctctgccctgccccactgggggcccctagaagctggacccctcccagaagcttcccaagacctcatgccccctgcgtggggtcagagttcagggaaccagcctcttgggggagattaaaaaaaaaaaaacgctgcccagagagcttgagtccagagcccaggagtgggaggggtgaggcattgtctatataaggacacattttcctctcaatgtagaggccccccacttcctcacacctccatcttcctcccccacacttctttggggacacaagcaaaggacttcagccttgggggcctagatctagaaatggagtttaatttcatcacaaaatgattaaaatagaaaatacaagctgctcttaaacttatattactattatttttatcccctgggcagccatgtgagcacaaagctggttttgattaggcacatggcccttcgagcccactccttgctgcagttcgcatggaggtctgctggctccgcatccctggcagggccccgtggtgcatgcacagccccaccgtgctgacacttcaagtggagcgcggccaccccctggggctccgagtctggggtgtgcctagtttgaaagggggacttcagcccctttcctcatggccagatggaaagataaagtgctgcagaaacttctaaaaataagactcaaagcacattacagggtagtgtactgacacgtccagtgaaaacccagcaccctagggccgaggacggaggcagaggcagatggggcagggcagggagtgttttctgaaggtggaaaattttaaagctgattcagaaggaggtaagggaatgtggctatcaagaggaattaattcataagtgatcattttcattttctttttttttttttttttttcattttttggagacagggtctcactctgtcatccatgctggagttaagtggcatgatcactgcagcggcacgatcattgcagcctcaagctctgtgggctcaggtgatcctcccacctcagcctccaaagcagctgggactacaagcacatgccacagtgcctggctaatttttgtaaattttgtagagacggggtttcaccatgttgcccacgctggtcttgaacttctgggtccaagtgatccaactgccttggcctcccaaagtcctgggattacaggcgtgagccaccacgctgggctgataaatgatcatttcctgctttccaaaacaccgttgcatgtgttctctcctttgggcgtcaaaacaccatgaggtagagaaaataagtgattcccttgtacagatgtggaaacagagatgggacagtttaaattatttgcccaagttcccaaggttgctgatgacaaagccaaagctagagctgtactctcttggcctctactgtggtgatgcttggaagtaaagcccaacacaaccccatgaggacgaaaggagtctcagtacctgctgcccttctttcaggagcccaggaaaactgggcctctcatactttgctttcttgtgcctcagcttactcatcagttaaaaaagcaaacctgatccttcttcttctccctcctctatgctccaagactcaccaggagaatgagtgctgaagccaaggagtgcagaactgcatacatagtctgccctgtactcctcttccttaagaagggccgggtgccgtggctcacgccagtaatcccagtactttgggaggctgacgcaggcagatcacctgaggccaggaattcaagaccagcctggccaacatggcgaaaccccatctctactgaaaatacgaaaaattagtcaggcgtgtactcaggaggctactcaggaggctgaggcatgagaatcacttgaacctgggaggcagaggttgcagtgagccgagatcatgtcactgcagtccagcctgggtgacagagtgagattccatttcaaaaaaaaaaaggggccaaacaaaacaattactgggtacacctttctttacattgtcattggtgactgttagaaatgctggtcttcaaggaagggaagaagggagaggcccggacaagggaagcttagactgactccatgcccctggtttatggcaccctcatccccagatatcaaggggaggctctgctaggtttttctgcctcttggaatagtcctggagccactccctgcgcactccctgtgcttgaggagagacgaggagttttctgttggccaaatatcagtcatccatggagcttctggatcatatcgtgcccagaccccaacccagaccaatgaaaccaggacctgtggggtgtgataccctggcacacgtgcttctaacatacagctgaggctgagatccaccgaggctgacaaataactatgtccagaggatttttctgtagctgagaatgaccacgatccttggggaaaatgtccagtgtaagaaaatgaaatcatccctgccccatggctttctgcttctctgtgtcctcatggaactggcatgctgggttacaggcagcctcctgaggagcttaagagtgtccactccagatagcagggacccctgatgtgccatctggggctcctttgcccgtatgggaggtggcaggagttcagcttgcagtggggagtggaggcaagggagcgttttggtgtcaagtgctacttgaaagggttgctttggctgtctgctccccccaacaccccgtcacatactgctaagtagtcctacttaaggcccacaatggtgcatgcagggctttcggctgtctttggtgggggattgcccccacagcccccggaggcctgtctgcttctgagctgccatgagcctgcaacacccgcacagggcctcctccctggattacccatagcagagaggaggcaggcactaggttgggaagaaagcctatcggggtgatgatgagcagagggactcatgcaggcagatccatgttctggagaaggcgaggggcctaaatgcctcccagaaggagaaatgcatccagaggcagctcagagtccacttgctgggagaagtatgttcccagcccccagttctgctccctgcgcccacccctcagagccccaggagcccagtctaggcaagatcagccctgactgccagtcctggaggcggaccatgagagggcacttcctccccagccaagcctcaggaatgtggcggagcctctgctggaaagtccccccacccacccccacccccacttagcttcctctcctcaggagcaggaaaaggatgcccagggagggggcttcaagggggagactctctcagcgccgtccccaaagagtgctccttgtggggaaaggaaggccagtgaaagtgctggggcccagtgatagccactcaaccagctcctccttatcccagttcctggatggtttccccatagtgtcctgggggccagtgagggcctttccacccagcccagcccagcccagccaagtgatgtcgccctgcttgccctccatgaggaagggtttcctctggcagagggagtgtggaacagagcctgagggcaggcaccgcccagcatctttaggtccgcccagcaggcagctgtgcccagcttcactgggcctgttgggggaggtctagcagaagccccacagtggggcctagaccccgtctcagaggtgggaggcatgctggctgtgtgctcagaggcctccgtttggtttgtcactgcaaagtttggtctgcagaagaaagtcagagaaatcagaagctgtgcgccacctctagtccatgatcccaagggcggggaccctgtcccctcccgcccctgttggagaggagacccaagatttctagcatgagggagacaaggcctgatggaggagaaagccagggaaggtgagcaaggggtgactctgccagcaatggcattccgggggagcatcccaagctccctgggcagcctgtgcgctcatcttgccaaggtgacggtgctgtccccactggattaatcaggcccagggtagtggacggtccttctttgatgctctcatggagagtgaaataggttgcctggacacaggcgctgttctgcccagcgggcacaaagggccctcagagttggggaggagtttggctgaggtgggattttgactgagagaccccctttgctcatttcctcagcagctgctaacatttattgttacctgtttcattccagatgctccagccagtgagaacaccaaggccccagagatgaaatcccggaggcccaagagctctcttcctcccgtgctaggaactgagagtgagtactcgcccagcttcaccaggcagaggcagaggcaggggcaggcaccccggggactgagggcagcctcagagcccccactttctggtcactcactcttgcctgaatccctggaagtctgatgtctgcccacaccctgaagtgcccagtgaactcccaataacagagccagtggccttttctcaccccatcccagtgctctctccagcctgtctccagcctgggtggtgttgcacatctcatctgagctcctatctacctcccctgcccaacctccttcatgccctttcacttcccaccaagactctaggagagctcctcctaatttctccccagttgatcctgccctcccaggggctctttctggattgtaactctgatctcatcactcctggttgaaatatgcagtggcccccagagcctgcaaaacccacaagcaaagctccacatgttagtgccgaggacatacctagctcgcatgtgcacacgtggtcccacatgtggcctgccccccgcctgtctttcccggtgctgcccccagctcctttacttctattttatactcaggccaaactgagctcttcactgcacactacacagcccccaagttccttccttcatgccttctctggcacctctctccatgggacacctttctgccaaactcctctgaaaagtctctcatccctgagttcttcctcacctcagctcccacagtgtcagcacctggctcctccactacctccttcccaatgtcacggagatgtgtctgggtctcatcctccctcctccattgtacagggtctgttcaagcaattacctttcagaatgacacatgctgcgccttgctcgtggaaggcccttcccagtttctcttagagtcaaatcgcagtgtggtataaaaagccaagagagaaaggagcctctccgtgaccataggcagctacctccctctttttggatctcagcttccccgtagcccacacatccattaggcaccatgcgtagggtccacagtgcttttacaggcctgccaaatgctgtaatatcttataaaattagaagaaaaaagggaactcttaagtcaaagaaaaggttttaattcatgacatgaatatattcatctttatacccatgcagttaaaagtgtagtttacataattcaaatataatacttgatatgtaattaaatctatttacttttttttggtggaggagggggctataaaggcagaagtgcctcagaagtcacaatgtcaccctggcttcccttataatttttaatctaactttgacagcagaactaccctttgaaaactacaatttcaacagagggtgcagagttgcttgaacatccccagcacatgctgtgttttaaaacaaacaaacaaaaaacaagatgagctcctaattgcccgtactgataggggaaaataattgagccgggttaactcagactacaatctttttccattacaatgcagtgttttgtgactttattttattcttaccttcctaatgatgaacttgggttcctcaaacataccccagccaggctgttgggggaactcagccttcagtatgttggggcagagaaattggaattaatttctcattgatacttaaccaaggtagatagcctgagaatatcaagaatggacatttaataagttgttggaaatgcatacataataccaagaaaaatctggtgagaatgggttaataattttatcttccaaaaatattccttggacctgtgctatacttggtatggaaaaccgtgagcagaagagatagagaatgtaggaagggcaccaggggctgtgaattggggctatggcatggctgtccccgactcctgggtgcagaagctacagggcaggtattgatctggtgggcagcctccagccctcagctccagcacacccactccagtgagcccctgaggaggtgagatggggtcagagccgagctgtggaggaggaaaacaagcttgagatgatgagcagagcaggagctgggctctctgccctgagaacagaaggctgtggaaaccccatgcaagctgtcactgtccgagtctggagcagcagctcgcacccctggctgtgtgttatattcacctggggagcatttaaaccactgccgcacaggcttcccctgcccccagaccaattacatcagaatctcaggggtgggtgccaggcctcagtatttgttcaagctccaggtcacgtcatgtgcagtcaagctggaaaccagctgttccagggagaaacctggtgcccacactgtgggtcttgagaagcagaagggggtctcccctgctgcctctgttaagtgtggaactgcctcggggaccctcacatcaacatccttagggtatcatgttgcccagagagccgaacaaggcaccttgtggtggagaagctggaagcagggaatgaagctcagtctgagttagtgggggagcagcaggctagtagcaagtgcttcatctttacagaaaacacacattcatgactggattaactccagtagaccccacttggatttcactctgtgtgcagagcccccatgttggaatttcagacatcttgctcctgaaagaatgggagtgtgtgtctctacacactccaaagtcatggccactttgtacccttttgctggcccaccctccaatctctgttactccaaacctgctaccccaacactgagagcggtgccaggctggctctagctgccctccacctgcttgcacccctgcactcttgtccttcagaagcctgtaccctgggggcctgagagataccctgggatttgtttctggagcctcctgagaagctcctgagaaggcagctgcccagagatgggaagtgaaggagatgtcttgttttgtttttttttttttttttgagacagagtctcgctctgtcaccaggctggagtgcagtggcgcgatctccgctcactacaacctccgcctcctggtttcaagcgattctcctgcctcagcctgcctagtagctgggactacagctgcgcaccaccacgcccaactaatttttgtatttttagtagagatggggtttcgccatgtgggccaggatggtctcgatctcttgacctcgtgatccgcccgcctcagcctcccaaagtgctgggattacaggcgtgagccaccgcgcccggccgaagatgtcttttagatttgcacccattcttttctccctttggaggataattgttagtttattgattatatacattatatatgcacacattcttatttaaccattttaaacaatatagaaatatactatgtacaacatgaaagtcctctttcatctcaccccaattctactcacgccccaaaaatactcagtgacttttttctatgcatttttatatacaggcacaagtacatcaattggatttttgtcccacagagatggaattgcacagtctgtatacctctgcaacttgcctttttttcttagctttgccatccccagtcccagacacctctgattccatgagtgatctggctgtgtgtgtgtgtgtgtttgtgtgtgtgttcctctgtgtcaagggctgagaagtacctagtctaagagggaaatccatctttcctgaggtgagcctgagtgattttttcatcaaatagatcatgaccagttccctcttctgcacacccccctccctgctgagcactgacaagcatgagggaaaagccaagggcatccaccccaacccaagcaaggacggggtgagagaaagcggacagaagtacaagttaaccggccagacactgactcacaagtgcaggagggaggtgggagcagcttgggaagatttcgggatgaggaaaacggggtcaggttatggaggaggagaggaatgtggtttatgtggtttggctggagagaaaatgataacatcagttggggagaaggcagacagggaggagccacacagatgctggagtgaagattgtgagggcacctgtctcaggacagctgcaggctgaacaaaatcagagtctaccgagtgcctgtgcactgggagcaccttaggagctcgatctatgtcacttcagccgagtctcactcaactgcgctataaatagctgttcccattttagggatgaacaaaacagagcctcagagaactaaactgccctgtccagggtctcacagctagtaagatgtggaactgtggtgccaaccctgacctgcattctggccactacaccctggcctggctgcagtctcaggatgtactctgtgtgtgtgtgtgtgtatatatatatatatatatatatatatatatatattcatttatttattcatttagatagagataggtacctaccattttaggccaaattggagatatcatgcccttgaattctaactatgctgttgtcctaagaacataactacaatgcaattattgaaatcaaaatcaaagagtaaatttgacattgaaccaatactgttgtctaattgattcatagtctacatttattgtcaattgttctaataatgttctttgtggctatctttttctcctgttgatgaatatttaataataacactcctaaaacacttcgtgcactcctccagcccagagtgggtcctctcctccctttggagatggaacaggaaagaagttcacaggcccaggggagaaacaccccacactcttccacctaagctgagtagggcatggggagacagaaatactcctgtcggactccaggtgccaacttactatgatcagttctggggcagcactcaggcacaagacacagcaagaaagccaatgagcaggagacgaaggtcttggttctcccagtagttaaatatgtggccttggtcaaagcccttcattcctctggacttgggcttccttgccagtcagatggggagtttctccagctgacctcaggcctttcccaactctgacatcagcatcagcccgttggatggaaagcttttgagtgacacagttcagttgagattaataactctccttcatatcatctgaagtgtgaaggagtccaaagctacagcaagtatagtttaggtcacacagcagcaaaagtgtcctgagggaaagaggccttaagcatacaggtttaggggagtcccagctggagggggcccaaatggccaggggagttcttgggaattttgcgtgaggggagacaagcatgctggctgtgtaaaggaggcattgatggggcttaagaagtggccttaggaaatgcacatgaggtgatgccagtttgataccagactctgggagttcctcctagcagtctatataagctgatggtctttcagaagagatataaacggacatccatgtggggcttttacaccttgaagacagaaaccaggtcctgtccatctccaaaacttcattagctggtctctcagtaggtttataataaatatttgatttttcaaaccagttcataagttcccatgctccaagggtccctgcctccactgtggttctgccactggggatgatgccaatggaacatccctttgcagtccatgcctggccttggcctgagcttcacctctgacatcagtcactttggaacatcccagattatgagactctcagatatctttgcctagacctcccatatgtgtctgcctctaaaatggaaagttgtgtcaatttgaaagcatctctggatattaaaaactgtcccttttccatgcaagatttccccaggatcaaatcttttttttaaacattcctcctcaggtcatgaggaatgttcaatcctgatgggattcaaaaggctggaagagaggttgggatttggcatcaagacttgcctgacagtgaaagatgtggggccctgggagagaggctgggctatttccatgaatgtttctgaaagctggcaccaactcccagttactcccaaccaaaatgtgggtctgggaggaggaatagtgcctacctggcacactcccacccacaggcatgtgaccctatgacttccacccactactcctcccaactcacccagtgtctcccataagccagtgaactggccagaggggagacctggaaggtacccaccaagcaatgctggcacccctggcccagcacacctctttcacaaccatcctgatgctctgtgtcctgggggtttgggaatggatgtaatcagaggagcagtgtttctttgcaatctccttatgtgacagcccttgctttgaggaaggtgagcaagaaatttgcccagagatgttaattctgggaaaatgaccaatattcctccacgtatctgtaagcatgtactggatgagaccagcgtatacagtaggggagtgggtcaggtcacccagggccagtgtggtaggactcagccttccatcctcaggtacccccacctccttcctgctccgatacagcctcatggggtgggtgctcactccatgctcaacccagctggagtccttttcaggagcctttggcagaaagttcatgctgattttgggaattttgaaggatttgatgtctatttttaactacctacctaaaaagggaaatgtccccagagaggcagacatccagggacctccctgtacccaaggctggtaaggctagttccctaattctcctttgctttccattatctcagaccttttgactccgtgagacccaccttcaggctctgcacctatcttgcaaatgtttactctggtctctctgccctgctgattttccatgtttcagagcgaggcattcaggtgccttcagactgagcatctggaaacttctgtgggttactgacctccttttttttccccaggactaggttagggcttgggtcagctggaacagattacctgaacaattaggaggctggcctccccacccctgccccaggtttcccaggaggcttccagatccaatgctttgattcatgtttttattgggctatttcacttcctctaatatcaatctcctatctagagtggaaggctcagcacctggcagctttgatcccagaggggacagcagagactgatccttttcatagaaagttatataaaaattcaagccccagggctatatttctcagcatcagtgcccagggctgggggagaatgttccttgggaattcccgggttaacagaaatccttgagggtttcactcattcctttaatggccatttatcaggcatgtgccaggtactatgctaggcactgcagatacagaaggtagaccctatccttgtccccagaagcttgccgtggtgtgtccatgttggggacaggtttctgaaatagcggtgcctgatgaatgctgtgatggagctacctcagagggccatgaaccccgtggggcattagtggtgcatgagctggggcgacctgcccaaagaatatgcaagagccatccaagagaagagggcccagcatgtgcaaaggagcgaaggcaagagcctggtgttgcagaaactgaaagacattccatgtagattacagagcagtacttcccaaaggaaggtgcagggaccagcagcagtagcagcaccagcacctggaagccaagaatctatgtttttattaagtcttccaggcaatcataatgtaggctaaattttgagaaccactgatattgagtattgaggttgtgatgaaagttgttccctcttgggaaagcaagcaagaaagttggggatgaaagccagggacagagctcaaagacctcgtaagatgagttgaatttgatcctgagtggcaatgggcagccactgaacaggttcaggcagtgaagtgacatcatatttgcatttgagaaagatcactttggccacagagtgacaaatgtgacgggggacaggggaccagaagcctaggaggtgatgcagttgggactacaatgctgatggtgggaaggtagaaattggcagactgaggaggtacttagttggtgtagacaacaggcatttgtcagtggatatgggcagggagggggccttgggagaaatggggacagggagcaggtttggggaaaaggtcttggatttggttttgcacgtttggctggcagtacgtgtttggcatctccctgggagatgatggtcaggtagttggatgtattggtatgggctcaggagagaggtctggcttcaggggaaatggaggaaagagaataggggatagaaagaggagctcaaagggcagcgatgagcacagtaccccggggcagtgctctaccaggaaggatgtgctgcctgggctgactgcctaaaggaggtggctgagcccctcttcagaggagcagcctgagtagggcgtgctctgccctccctgcctgtcccatggccagcagccatcatggagtttgcaaaggtggatgggttttattttccttctaggatgttcctctctgactggctggtacacaaagtttagggtgtcagagaagaggatgagagacacagggctgacaggaataataagataataagagtgactccagaggagaggaaactagttagtgagccagggagtactgtgagtttgtttgggcatctggacctgcagaatgtcccctcttctgaggacctggactggggagaagaagcacaggtgccacatgagagctctcaggttagtgtaaggctgaactgaccaacagggtaccacatagatgaaagggccaaacttgtcccaaaggacagagaagtcctctggggatctgtttgtttcagagagcgggggagtggggggaggggctgatgttagaacatgcactgaggctgagcatggtggctcacgtctgtaatcccagcactttgggaggccaaagtgggagctcacttgagctcaggagtttgagaccagcctgcgcaacatagtgagtctctacaaaaaattagctgagtgggtgctgagatgaggatcactttagcccagcaggtcgaggctacagtgagctgtgatcatgccactgtactcatcttggatgacacagcaaggccttgtgtcaaaaaaaaaaaaaaaaaaaagaaaagaaaaaaagaacatgctgcactatatgctatacttcccttacaatgtagcttaactctttacaacaaattttatttattccataccctgggtggcaggaggctcagatcccatttccagctccagaacatcaggttttatgaacctagcaagtcaccagacttttatgagatgccatctcctttttcataaaatggaaacattatgatactccctgctgtgtttgattgggatgagaaccaagtgaaatgctccctctgagaaaccgggttttagaaccaggtgctttcccctataagcccagcacacaattagtggatttcagcagatggtcatataaaatatgtatagaataggatataaaacattgttaacgcttaaattgtttttactgataggaaccaagccagtttcaaatgctaaccaattcaaacaatggtagctccaaatttacagaacaaacataaaaatttgaccttcaatcctatttaaccatgacactgaaagattagttagggcttctcttccagtcaaatgggtttacccagagccaccaagtatggggcaggactttggagtcccctgatttcatgctgtgctcctagctcatcaccccagggattgtcagcctccttctcacacctggtgcccaccccactggtgcccaccccactaatgatgcccatccacagctatattagtcttctagggctgacttaacaaagtacggcagactgggtagcttaaccacagaaattgattctcacagctctggaggctagaagtccaagatcgaggtttctgcttgaaaatggcagtctttcccctgtgtcctcacatgttcttttctctgtgtgtgcatttgtctggtctctctcgctctcctccctccttctcccttcctccctctttctctctcgctcctttctctctctctctctctctctctcctccccctgcccctgtctctcttcttcctaatctcttcttataaggacaccaaattggactatggcccaccctaatggcctcgttttaatttaattacctctttgaaggccctatttctaaatacggtcacattctgaggtaccaagggttagagcttcaacatgtgaatttggggagacacagttcagcccatgacaacagccctccacgtagctcctctgaacagatggcctcctctctccagagatcatatctgggctccggtagaagccctctcttcttccctggagagcttctctcttcccaacagtcctggacaaagaggggcagggcctttgtggctcagccagtcacaggcgtcccatatcccatctggtctcccccaccaaaggatttggctccccgtgctcttccctctagtgtctttgggctctctctctccactgtgccctagccattgccttccaccttgtcatcttctctcttctctcacctcagaagaaacctgagcttcatattccctcttgtttccttgcttctctttgtcctttcacctccaggatccttgactattttactccccactgtttgctcaagaatctcctctggggtgactttggaccatgctgtcccatggaacctggcctctccagcatcaccgtctctcactccatgctgggcacacctggtgctcttcccagcatctgtcctctacccttgcttgtggcgacactcctcctgctctcagggtccttccacagccctctcctgtgtctcggcttctttactgtggacacacctgggatcaaaccctggcctccgcccctctttcattgcattctctttccccaaagaattgacccatcttcaaggtttccattctaatggcttctttaattctggaatctttcacttccagtctccacaaacttccctctggaattctgatcctgggcttctaacctacaaacagattcaagctgaaatattaatcttgtactcctaattctatattccttcaatatgactttccacgtgtatctatgcaagaaatctcaaagtaatctgtgtacctccttcttgtttagccccttaaattattttaactttcctctgcctctcatttgcatcttcttttctgcatggatcttgatcagtgccttccaaggtatggcaatagcctcctaattggatctgtcccgcaagagctggaaagacctatcagggacctctagcccagcctgactgctgtttgagtgaggacatgctgttcaatcaggacaaagccttagctcgtgagcttagcatttgaggccagcactgtctaacagaaccctctgtgatgaaagaaatgtcctacgtcaacacaatgtgatagctactaaccacctatggctattgagaacctgaaatgtgactagtgcaaccaaggaatcaaatttttaattttctttcttttttttctgagataaggtctctctctgtcacccaggctggagtgtagtggcaaaatcatagctactgtaacctcgaactcctgggctcaagcaatccctcccaagtaactgagactacagacaggcaccaccatacctggctgtttttattattttttacagagacagggtcttgccgtgttgcccaggttagtctcgaactcctggcctcaagtgatcttgccacctctgcctcccaaagcgctgggattacaggctgagccactatgcctcaccttaattttatttaatttagagtgcccactatcctcataccactgctgtccaatatcagccctgtgctctgccagcctccaccaaacatcaccctgattctcacctctgagccactgtctattcctgacctgtgggttctcctctttctccagttcagaccttccctagccttcaggtccatcttacatcctgtcttttagccttctaactaaccatctcctccaccaacagtgttccttttccattcaaacagccacatcacgttgactgaataacatctttttttataactttctatttaacttttatcttgaaataatttgagactcacagaaaaaattgtaaaaatagcatgaaaaattattgtatatacccttcatctagattcctcaaaggttaacattttactatgtttgcttttttttttttttttttttttgagatggagtctcgctctgtcacccaggctggagtgcggtggcacgatctcagctcattgcagcctctacctcctgggttcatgcaattcttctgcctcagccgcctgagtagctgggattacaggcgcacaccaccacacctggctaatttttctatttttcgtagagatggggttttgccatgttggtcaggctggtctcaaacttccgacttctggtgatccacccgcctcagcctcccaaagtgctgggattacaggtgtgagccaatgcacctggccttgctttttcatatattctttctctccctctctttttccatttctctgttccttctacttctccacacatatatacatgtatatatacacacacatatatatgtatataccatgaacagtttgaaagttgcacacaggataccctctacacctaaatacttcagtgtgtatttcctaaaaacaagaacaatctcttataaagccacagtttgatgatcaaaacatgaaattaacactaatccaatactatcctctaatttattgaccttattcagatgttgccagttatcctataaatgtcctttatggcaaaagaaaaaaaaaaaaaagcctttcctctttcctgtggaccacgtcttgatatttaagaccttgaggcctgatttcttacattgtttggtttcctcctcagtacccaggttagtcgtgtgtactgactagcatttgcctggcacacagtaggccctgagtaactttttggagatggacggatggatcaatgatgacaatgagccagagggaacctggtggaagccctcatcctgggcttaaccacacagccggcagccatcagctcggtgatctcagtgtgcccctgccagggatcactgcctcacgcagtcctcctggggcattcactgggcagcagcacgtgtcctgtcgtggaaatgcacaagttccacaagttactaatttgcctgtggtcacagggcaacccatatccaagccaatgacaccgcttccccttcatctgcagaggtgaagttatctggatgaataattgttaatattagcccactcattcattcaacaaatcgttattgtgtgccaggcccattgatatacagcagtgaaccaaaaaagtccctggcctcaaaaagctcacagtttaggaggaggagaagggcagacagtaaataaataagtgaagatatagtttttcacatggtgataagtgctatggggtgggaggaccataaagcgagatgagaaggatgaggggtgctgggggcagggctgctgtttgtatggggtggttagggaagatctcactggtgaagtggcttttcctcattttttatgttaaggtataatttccctgcagtgaacttcaccctctttggtgcacagttccgtgagtcttgataaattaatgtcatcatggactcccagcatggtcaagatctggttctgtcaccacagaacatttccctgtgcccctttgcagcccacccctcccccaccctacctctggcaaccattcattaatctgttctccattcctatagttctgccttttctagaatgtcgtataaatggaatcatacagtatgtgaccttttgaatttggcttctctgagcagaagaaaaagagaaatcattgagattcatccatgttctgtgtatcagtagtttcttcctttttattggtggcatcaaagtgccacagttcatccatttggataccttctagtttttggcaattatgaataaggccactgcaaatattcgcatacagatatttgtgtgcctgtaggttttcattttatttggatagataggttagatggcttttgagcaaagacctggaagggatttgaaacaagccgtgaagacagctcaagatgttttcgcacgtgcactatattgtgatttagccaagtgaataggtttgtgctgcatgactgttctgtttgagtcatttttctcatttgagttatttggaggaagtaagagtaagaagggaggagaccatttattcattcatccattcatccatccaacaaactttaaaaaaatgaaagccaccagtcaacagtctgtgacccaaaggaagcttgcgacccttggatccacaccaaaggctaattttagttggtttatctgacatgacataatttcctttctgagtttcctgaaagttagggtgagagagtggttaatgagtgtggcattatcgtcttcgaaaagggctatgggagcacgagcattttagagagtttttaatctcattggaggcttcagagaccctttcataggtccctgagaactgatattcttttttgtctgtgaggttgtctgtgtgaaagggcaaagtgatctctcaaaagacatattcatttactttcttttttctttttttttttttgagacagagtctcactctgtcacccaggctggagtgcagtggtgcaatctctgctcactgcagcctccacctcccaggttaaagcgattctcctgcctcagcttcctgggtagctgggattacaggtgcacaccaccatgcccagctaatttttttgtatttttagtagagatggggtttcaccacgctggccaggctggtctcaaactcctgacctctagtggtccacctgcctcggcctcccaaagtgctgagattacaggtgtgagccaccgtgctcagcctgaaaagacatgttcaaataagagtcctccctggatgaggggccagtggacaagactgcatcttcctaggatcaggagctttgtgaaaaaaacagaactacaggaaataacttgtgaacttctttgtttcaggtgatgcgactgtgaaaaagaaacctgcccccaagacacctccgaaggcaggtaattggccacggcactatctggggtcaaagaagtcatctaccatgggggttttgcctttaccttgctagactgacacctgggtatgtgatcccaggagacaccccactgcaaccccacccccaccctcagttccagctctgcatttttcaggctgagtttgctcatggagagcctctgcacagcctggctcctggtccccttccacagctttgtctttccatctgcctcccatgttgacagcatcatacaggactagcagctctcctgcctgccccttctacgaattctgccctgctgtccatcctctgccctacccttgtgtacatgaccctcttggggctatttttgtgcccagctctgtgtgtccttgttatatggaacccttgtctgttttccattggatgacacttgaggacttgaatcaagcctgccagccagggtgacctggagtttagaaggcaaggtgatgcttaattcataagtgagttaggacctcaattcaaaaaattagggtaagtcacaaattccagtacaacccataaatggagaatcatgccatgtaagtagtgtgggtcacttctgagggaatcagaaagaagaggtgaacaaacctagcaggtccatgaacttggatgtcctgcagcaggatcactgcccctcagtcttaccctgaaggttccggaagccaagagagaagccaacagaccactgtggacaatggcgtcgaatgtgatcagaatgcctgagacccttctgcctcgctcactttctccctgtcctccctcagcaatgccccctcagatcatccagttccctgaggaccagaaggtacgcgcaggagagtcagtggagctgtttggcaaagtgacaggcactcagcccatcacctgtacctggatgaagttccgaaagcaggtcagtgacggtatggggtgggcactgggggtgctgggaataatccgtacagcctttggaccgaaagggatgagaaatgccgtgctggagatggcctcactcttcgtagctttagaaatgggagaggccactcccctacccatcgctcacctgccaaacctgagttcttgttaacctttgcttctgaatctaccaataatccccgcctttgtagacaatttgtgtaatagaagtgtgaggggaaaagtagaaaccatccatgtccctcatctggtttgatagcacagtctagaatcctattcagagtcaggaaagtcgagcctgtgacccaagatgacccttagactccatgagcttgctgtgattctgtgccagcccactgattcctgtctgttataaccacttaaacttgccacatgctgaagggacaaaagcaaatgtgagtatttggatagaagaattgtatgataaatagaattgtgtctgactgacccagaaatctagctacaatttatcataatggttcctatggaacaatgtttgaatttctagacaaccagcattgaaaggacttggggagcccagcagctccaccaatccacggtggtagtgtgtgcctgtatgcatgatcagcagagaccctggaatgatgggttggcacaggagtgggaagttgtgaagatttattctgagccctctgttactctgttttaaaatcactcaaattctcctagccccagagatgaacacttagtactaacagggaggaaagtagggttggtctcaaaagatggaaatgagaagtttgcctttagcatcccagagcatgtttgccctgagcgacatctggactactgttgtctgaaataagatggaatctcatcacttttcagagacatttagccaagtcccagctctgtccttcagaactttctgccctgatgaaagtgttatctctgtgctatccaatatggcagccaccagccatatacatggggctattgagcacttgaaatgtggctagtgcaactgaggaactgaatatttaattttaattaattaaaaattgttatagcagctttgttaagatataattcatatgccataaaattcaccctcttgaagtgtacacttcagtggttttcagtagattcacaaggttgtgcaagcatcaccattatctaattctagaatactttcatcatcccagtaagaaaccccagacccattagcagacattcctctccttcccccaggccctgacaaccactcatctactctcagtatttatggatttgcatattctggacatttcatatcaatggaatcatacagtatgtcattctctctgtgtagctttctctttttttgacttagcatactcttttcagggctcattcttattgtaacatgaatcagtacttcattcctttcaatgaattaataataaatattccattgtcaggatagaccatattttgtttatttgttcatcagttgatggacatctgggttgtttccacttaactaattaaaatttaaatagccacatgtgactagtggctacagcattggacagcacagaagaggctagaacccactggagtggatcttgtgaatgactttgctgagatgtgttctcctatcatcccattccagagaggtagagggagaccaggatatttctgggagcagtgagtgctcagctagttcatccatccatcctgcccctgctccacaccctccctgcccaccccagacctggcaccctcagggaagctggactctggatgtaggagagaaggggcctcagggagaagggcagagtccagaccagactgagcccccccacagcttgtccagctgcatccttcaggaagtagggaatggggaggagcccccttcctttcctagcccaggggcccaaggctccagcacctgctccatcctccgcccctagatccaggaaagcgagcacatgaaggtggagaacagcgagaatggcagcaagctcaccatcctggccgcgcgccaggagcactgcggctgctacacactgctggtggagaacaagctgggcagcaggcaggcccaggtcaacctcactgtcgtgggtgagtctggtggctgggtggcatggagcttggggcaaggggaaggcagggagcccccaggcaagatacgtgggcctcaggacttcatcacccattatctctcaccactcctgtgcctgatttataaggcaccacagaaagaagatcacggcaacccacagactccctgctagaccctgctgacctccaggctcagcagaggggccaaggctgggcagaaatccttttccctgtctctatcaacacctctctgtgatagctgttcctggagttccccgccctcaggccttggcatctagcttatttgagaaataagagacatgaggcataaacttggtcaacttcttggcccctacgccacaggtgtctgtatctgtccccatcctgactccaccctccaggctctggggatggcccaccttggtcccaccaaaggctgctcccttctcctgtgctctggaccccaggtccttgggggctccaccatccctacttctctcttcaacctcttcctctctcctggctcctcccagcagcccgtaagtgtcgccatcttagccagatgcacaggcattaataactcctgcaatgttctctctcactctagccaccctaccttctctctctgacaggggtgagtctctactgcacttccgcttcttcaccccccagcaccctccagctgcctatggcctcacccccacgccccattagtctgcagggactgttcttctgaggtcaccatgacctcccaatcctgactccactcgattttccttaccttcataccaggatttccttcatcccaggattgagtggggtctgtctccagactgattctcaagttcacttttcctctcctcccttaacactgtcttcgtgccctggtcagctctctcctggagcatcaagagagttttctaaccagtctcccgctgttgtcatgttctgctccagttgttccccgtgtggcaggtgcttgggacagcagaagaatgagcaggcagaggagcagacagagagagagagtagactctatgcctcatgcatttgtgggccttcatatgttgtgcatgtgaaagcctttgacctggcatttattgatatgtgcacgagacccgagcgggttttccatttgtccttggctttcaagcttatagggtacatttgtgaaaattagaaaaaggggccttgctgggcagagtgaaaagggtacagcacccccagcctcaccccagaactcatgacctggccttggggaggacaggttggcccagatgcccccactagaccccttttatgcagtgcacaaaactctcagctgtgtgtgctgatcccaaccttaacttcctgcaaactagcctttcctgtgtgttcctggtgcacacacacgtgggcacacagaacaaaaggatctgttggtaacagggcttgtgtggctaccgtggttagaagtcttccactggaatctctcttatggaagtatctagatatgaagttagaagttgtagacattgactcttaaggtctcttgtagctctgacattctatgattccccaactctattctctgacattctgattcctcgactctattctctgacattctatggttcctcacctctgttctctggtggtctgtgattccttgactttgttctctgacattctgtgattccctgacttagttctcaagcagtttttctcccctatcttcatctcgtatcatcaccttaggactaggatggacaggactgatgtttccagccttatgcaggagaaactgaggcctaatctgaacaaagtaacatagtgcatcagaggctaagtgggaactagctctaaactttcaaacacttgtcctccagtgccactcatgggagtgtgaagtaggtacagaatgtcccaaaaggtaaaggaacactctggctgcaaaactcatcttgaggggagacatgcaagccttttggggagctgtccacatgccagagagttgttgatgtctgtgcctccatttttctcatgctgagccttaggaagccctgtagcacttcccttcagcccctaagcagctggggaagaagaagtccttgtccaaccaggtgaataaggaagacacgaggataaaggtcaaagtaatacagagctgggaagacaaatgaggtggccagtgagctatgcccatgccagctaccagaacagaccacaggttccacaccctggcccgactccccagagaggaagtactgcaaagccccctggaagattgtccctggacacaggggacccgggagagggaattcacagaggactgagctccagcatccactccccacccccagttgtccatatttctgtttaccttctctcttgctctgttcctctccctggccttgtttctttaccctgtgttctgtttcagccatttctcagtgtccgtcaccctgtcccatgtcccctcttttccctttgtcttccttcctctgaccctgttcttttgtttcttttggttagaagtttcagatcggggaagactggtgtacaaaggggtcagggaatgggtttttcatttctaaaggagaagaacaacccttttctcactctgtctctttttggtgactccaggtgtttatttgaataatttcctcccaaggagtcaggaacctgtggaggcttggtgctagtgatccactttactggtacatttagatctgttctgaagcactgatttggccctgtactcccgtcctatcagcaagcatcagtttaaacttttctttgatgttctctctcatctgctcctccttaagcaactttggggtcagcttctttgaactgcttttctacagaaaagctctccctccccccagcccccacgatgcccagctcctgcgcagtgccacgcactcccctcctccgatcaccactacgcgggctgcagttctggccttttatggtttagtttcttattctctgcagccagtgctgacagggccattggcgtggctgtctgccagctggcaggagcagcatgttaaatgccgtcctgggaggggaatggaatggaggagaaccgaggctttctgtctgcctccccctcaaagaactaagaatagaattgctcaataaaataggactcacattgatggatacagcaaagccacattcattcagagcctgtacacttagaattagttcaaagtaaacctggatgaagctcagatttacctgtgcatcttcagggacatctctgtattccctgatcagggtttattaagcagatgtaaaatgtacatgaggtaaaacaggaatcacttggtctgctccggacagttttcatgcatttacagaccagctaaataaggccagtttaatacaactcctccttgttagcagcaaacttctcttattgtatattctttaaagggccactttcttttcagatcctctctggctcctatttttcaaacaataataaaaactagcctttccctctgttagcttaaatgagtgatatttagctattttggagacttattattattatattttaaaaggcagcccaggaatttgcaatgctcagagcctcttcctgcacatgcgcccctggtcttggcctgtggggaataagggaggggacagtgagcagcatacccagatggattccttaaggtcactcacccagcacgagaaaagcaggtctcttttcatatctttaaaggagaaaaacaaagtagagagaaccccaaatacccaataatccccaaatactaactgagtttggagcttgcatgatttcccatcttaatgctcagctcaggcttaagcaagatgccttcttgagctcattctgcctgatagcctggaaagtcttgagccctggagcgagggtccagaggctttttggaatctccttttggctctgccactgactactgggttttcttgataagcaaaatgccttagctgctgaggacccatttcccaagggctaggattatccaggtagatgacatgtgggggcccttccagcagctgctgaagtcccagggaagggacatccaggtggggctaggcatagccactggtcatcttcaaataagcgaggaccaagagacctcaagagcagttactctagtgggaagctgtaggacaggatcctccattttcctggaaattagaacatttgctgaggagaaaatcctggagctggtgccactggagactcttgtcttagactgagctgagtttcctattctgttagtcaagcctccagggagccctgggagaattcagaggaaatgtggagtctcctttgcccagagatgcccagggtctccctcccagtctgagtgtgtcgccgtggaggacaagctcacaggagctccctgttctaaggacatctgttcttttctgagagttttcatccctttactagttcagccactgcatggggctcatagcttagaaagaacagaaagcattaggtgcagcccacagctctaaaggcaggtggaggagtgggaggcctccaatctcctaggacttctgacttgggtcttttctgaactccttaatttggtagcaaattccttaaaaatgttggagttttacttggaattaaagtccctcgccccaaattttgcatcttctcttgtgtgacaagtcttacgtatcacatatgtcatgtataggttctcattttcagccaagagacatgtgtaacagggtagggtacaaatggcacctcttctgcaacacccatttctcagttttcttttcttgaccaaagcagaaggaagatcagttggcagagtgcattcgtttataagcccacacaactccaactgtggccaatcacatggtctccaggcagtcttctctgggaggaatagtgggtctgtcttccatccctcttcaggtttttttacttccttagctgggtcttgagaggacttgaaccacttgtctttaagagagtttagagtaataaacatcttagccaaaaccagaaatgtttcaaaaaaggccaatatatctctcagaacaaacagtttttctaagagaacatattaaacagccagtgaaagtgcttccatcacaggaggcctctggcatgactgccagcactgggaagtggctctgtcacaatcccagaatcattcccagggctttggttattggggtagacagtttctgggcagtgcattctgggctggaatgtggatcggcagggctgggagaggggacaagaatgaatatgagtatgagtatatatactcatatacacatgtatatacatgcagatttttcttctccatatacacagggtcatttgcagccattgcctttggccttcctgccttgctggaggtgggagagtagcggtcaagtactttatctatgtttgcttacttgatgcttgcaaaaaccctaagaggtaggaacatattagcaccattctctgaatgagaaagccaggcaaacaaaccagtttcaaatttgctggggttgacatagcttaaaagcatggtttcaattgctagtttgtgaggcttcatgaaatcaaacagcattgggggagatgaagggttaatgaacacaacacagatatctgtaactaaccaaccatctgcaaaaactaaatctgaaaaataggagagttttgctcagataagcaactaataaaatcagcaaaactcaagagcctcattaaagtattggctaccatgatttgacttgaagttggcagtactgctagttctgaggccaggtcatctgaatgagaaggcagccagccaaaagggccacttcttatttgtgtcctcagctcattttctgtccattagtcagggatggctgtgatttgctattgtggtttgcttttgaaattatttatatctcaacagccctctgagaataaaagaggtagggtaggagtaatttttaagtatataaagttagaaataaactcctacaataatcttgatagtaatgactagtcaagccagccactcttctaagaatttcttacaaccacctgtgatacaagtgctgttgttattcacattttacagatgaggaaactgaggctcagggcaattaacagctactgtgtggggacagatctgtgttcaaacttgaatctgtctgacttcagagcacaaacactgtgctataccaccccttggtggggcaggcatttctcaagacccagagaaagtggaggcagacccctagttatgtcacaggtcattggccaagggcctgaaggacagacacacacactcatgctgaactctctctctcaaaacatgttttcgataggaaatagtccacgccttctgggcagcttcctagatctgtttactctgacaaatatgtttatgacttgggcaaagtacaggaaatcgtgacttgcatgtagactggaaaactagcaaaaaaaagcgagggggccttttttggagcaaataattatacatggggctttccgtacaggtgggtttgtacatagctctaactgtgatgtgcggatgagggaaagagacgcaggaccagggactttggattgggttctctaggctgccttccccccatgacacaggtaattcaaaaacttcctttgcctgcaattctggaaagtgtgggtgatgttgtgcttctttatccccagataagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaaggtaggctgccatcacttcatcagtggcttgaaacaaatgtgcgtgactgaccttgtgtatgtaaagactgtactgaaaggggtgaaaaggaactgaggaaacattaatgatgactggcagggtcttttggggtcttggtttccaagacagtgatgttgagccattcttcaaaaaaagtattaatacttaggacatttcaaaaaacattgaaccagcaattttggcatgctgccaccagggggtgatggtatgttactcaggagcataggagttcaagcggcctcatgttcctcttccaccctccaccccttctcttctcctcttgtatccatatttgagtgtctacttggtgtcagattcttggaacacaaagataagacatggagcttaaaatctagaggaagagaggtgtgtatggctaactataatgagaagggatgcatcctattatagctgggtaaaaaaagaaccaaggggacataacaaaatgcatggagcatttttccatggagaccaaggaaggctttctggagaaggtgacacttagtctgagtcttggaaaaagggataggattctaaaaggcagggaagataaggaaaggcactctacaagaggaaacagcatgagcaaaggttacaaagccatggcagtgtgtgacattttcagatgctcgtgtgtggccaaggcatatgttgtgtgagacagaacaggaggaagtaagactaaaagggcattttaggtaaagttgtgaagttcatcaaagattctcaggcaggggatcgagacgattagagctggttttcagagaactagggaaaaagcagggatttgctattcacagtgcagttgtggaccagcagccttggcatcctgggagcttcttagcaagcagactcccccaggcccttctgggccttgactgaaaatgatccactccttggggattcagatgcacacgaacatttgagaagcactggagtggtgggtgggtcagaggagatgagactgcagtcagccatatcagatgggcctctgggatgacagtccaggggagggatggaaagggcacgaacttcaagcctcaggaggtagaagtgaccatacttgatgactttttgcatagtgagttgaggaagagaactggaagattctaagatgacttacagttcctggctggggtaactgaacacaaattcaagagccagctagaggtttattgttataattcaccatggctaacatgtattgagcacttactctaagcttacgatgtgttaatcactttatatgcatcatttcatccaatcccaatagcccaatgaagcagatactgttattaccctcattttacagataggagaaatgagatttagaggggagaagctacttgcccaaagtcacagagcttgtaattggtgaactgatgcttgaactcagagctgtctggcctgaagcttgtgctcctttggttagactgagggaagaggtcaggctgtcttccaggttcctgacttgagtaacttggaggttacataacagtctgggaggagaggggagctgcggtttcagccctgctgagttgaggcatctaagggctagccgagggaaggtatcctaagactgttgggtctagagcccaggagaaaggtttaagctagtgtggcaggcttggaagtcttcactatttaattaataattgcaaccatgggcattgataaggttacagagagtgtggtagagaaagtcaataccaacaccataaagaaggaacttgcagtaccaggagaaaggactgagaggggagagaaccaagaggaggctggagtctcaaagaaacaggggagggagaaggtgcaaagagggcttcataaactgcatccaatgctaaataaaaatgaaggagatgaggactcagagggtctttggatttagtcctttggttggtagtgatctttgtgatccaagtctgtagagtttccactgagtgaaaagatggttgccctggttaaggaataaatggaagaaagagaggccagaagcatggaatattatttcaagaagttttatgtgaagaacaggaaaaggacattgtaaatttaggataagaggccgggcgtggtggctcacacctgtaatcccagcaatttgggaggctgaagcgggtggatcgcctgagctcaggagttcaagagtagcctgggcaacatggcaaaaccccatctctactaaaagtacaaaaaattagctgggcatggtggcatgcgcctgtggtcccagctactcaggaggttgaggcaggaggatcgcttgaacccaggaggcagaggttgtagtgagccaagattgcaccactgaactccagcctgggtgacacagtgagactccgtctcaaaaaaaaaaaaaaaaaaaaagaattaaagaatataggataagaaaaagttgggggttaggagaaggtggagggacatcaagggaagagagctcttggagacaggagaatgtagagttgtgaggcagatggtagaagactcaagtatcaaaggagactgagctccacatgcagaatgtcacttgaaaaccaaaactgatcagtaggtgagaatgtatttgacttcttctaattacaaggaattagaaatcaagtgaggcaaatagtgaacctgagcaaagctcagaaagcgagaaagcgagcaggcctggcatcaccagggagctagagccatcgtgagtatggaaactgtcatctgattcaatgaccctgtttagttttgaaaaaaaaattgaaaattaggtacaaaataggtattaaaattttactttcaattaaacaagggctccagaaagaaagaaagttagggtaccaatgggaaacataccaactttacaattttatgctagcagctgtgtgtcaggcggcctttacccgttgagccatgtcaatatgcatagagcaggtctccttgagagctatggtgcaagtcacggagacgtgatgcctgctcctgggacagctttcgcagggatcccaaccactagccactcccaaatgtctgtcaggggacactgagtaacaaaactgccatcactgtcttcttacacacacacacacacacacacacacacacacacacacacacaacatccctctgaaatgagcagagtgggggctgcatagagtgtgggtcccaggggggcaatcaagttccagtctgtggtgttaggatgttacttggaaaagtgacaggaaaaggagtaagattgcagtgtgaagatgttcattggctggaaaggaaatcatccaggtctgtgctatggtgtaaagagggagagactggagaatccccgactaaccccaggcagcaggaccagaggccacgggagctacaaggtgtggcccccaggggtctaggacagctgctcccagggctgtgtggagactctgccaggaggaagagctgtgactgcctgtctggggcaagtggcctctcccttgttccctgccatcagcccgctgaaccctctctgggccttcagactcccctcccctgctgccacccctcccagctgggaatagacaaagggcaatgttgaaatcacttgaaatccagaggaggagtccagtccacccagggcttccagacaggaagctactccccagctgaggctggctggattaccaagggggaggaggaagagggcagaacagttggcaagtgttaggcctcagggcagaggactctggttgaggggattccaggcaaaagtcctccacggtctgctcagatgcttgttagttataaagcttcataggccatccctctgctgaagagggaaatggctctcagggaagtggcgtgtgtgttcacgcacgtgtgtgtgtgtgtgttggcagagaggtgggatcaagtgacaggtcattgtaggtcatttctgtggagcagatggggtgggatcatattaaaaaggcagtgctgattaacccacactccatgaagcccggctaatgttggctctgaccttcaccactaccaccacagccactgccactcctgcctctcgctcttctacttcattctcatgcctcatttgcatccctgttggtaccctagccctcatcccacatccactcaccatgtgttctgtgcccctcctgtgttctaggcactgccatgggcactggggatacactgggggacaaagcatgggttccccgtggagctccagtggcttctctatgccagagccactcctaagactagggtccctgaactgacaatgtactcccaaacccaagtgcacagagccagaaccttaccacagccccgctccctcccagcccagccaggtcttgaactgtactcctcctcaaatcctgctgtcactcaaatccactccatccctgctccttaccctaatttgttctagtctgtataattgttagcaaaacagctactgtgactgaggcttcttgcagaactggagcctccttgcaacccccaggacagttcgagatataaagcctgtaccgctcccatcccaggctgcagctacgccctggcctcagaggccgtctccggggcgggggtgccctctagtgttctctgggtgtgcaacagtccttggctgcaggaagggacaattctctgtccaggggactgactggacttgtgccatgtgagggtcctgagcactcagctgatcctctcccaaacactccagggtaacgagactctcatctgtttgcagaaatatctcagaaccatcttccaaatagccttccacttagctcatggatctcatagctcattctgaacagattttttttttttttaagttcagtggaagacccttccctagtggaaagatggaaaccagttcacctttctcaacaaccctttatgcaccaagagctctgctaattgaactgtggtctttcctctacttctctctcactcctccccttgtggtcaaatagaagagaggcaggacaagaagggaaaagcagaaggggatgtagcagcctggaatctttctcttttttaaagagatcgggtctcactctgttgcacaggctggatttgaactcctagacgcaagcattcctcccgcctcagcctcccgaatagctgggactacaggcacttgccactgctccctgcttagtccggactcttgatccgagtttcctgcagcataaaggaacacagtgcactagaaagaggggctggaattccttgagaatgatctaggtccttcccccagagcattagcatgagaatcagatctgccacagacctctggggtgagaggcgaaggtgaggcatggatgtgggctcatgagtgaggccagaggctggccctgtggctgtctacctggactcacagtgacaggcaggggccagctctaggactggatgcccccttcaaggcacgcagggaaagcctcctgctgccgggccattggcaagactgcttctcctgacaccaggccaggaaagctgccctctcctttccctctcactctgctgcttggaatacactggtctccatgccacgccgggaaaatgtggcacaggaacaagaaataaaggatgactcaactggtgaaccactatatcaggcagcagcaccacaggtcaagacaggggcctccctgacagtaaataggatgattctgtgtcgaagacctagtccagtgactggtccacctggtgtcccatcactcattgactccaatattgttgcttctcttaaaaccctgtttataatatcatcactgaactaacctaaatgtctattgaacatacttattattctagtggtacttctcatgtgtgagttccatatccctccagccttcctcctacgtgaggtagaacactaaatggttcccccaagatgcagtagtcatgagttgatgaaaagtctgaaactctcatctcatccttggcgattgtgtgattctctttaaagtcatgtccattttagacttctttcccaacctcagaggcctcaccttttctgattaagacatagcccttcccttcagtggtcttgcttgccacctccagctccattgtggcttttggactgccgacagccagagctccagggcaggcacccagggcgctctcaacagctacccagtactcacccctgtttggggcccatgcacactttgccctgtgacagcatctgacagcccaagcagtagattgaggagctgctgtttctgtcttgggtattaactatggactttagggttcaccaccctaaaaggtagaatgatcagattctcctgaacactaactccattcctggcttctagttgcattgctctcaggtcatcctttccacctgtgaattggacaatgccactcttaactctccaacatgtggatttaggaatattgaccagttaggcccacatcccgacagtaaccgtgaaacccacctctgatacttcagctagactatctgggtgtccctgtctatctcatccttttttatttttccatggcagcttcctttctgtgataaaatatactttccaatcccattcatgtttagttttagtctttttttaaaaaaactaagctttgtcagcagcattttaagaactctaaacacactcacactcacactcacaccggtacacccgcactcacactcatatgcccactctctctcacacacacacacatacacacacactcacactttaaaaatccttttcctccctctatgctttctctcctgtctttgttttgcttccttgggaaacctcccattcattgtccagctgtcagccaggacgcagcccagacgatggctgaggaacacacagcacatgacgaagcgtggcatccagagctagccagggccagagacatcaggtgcaacccttcctcttacagatggggaaaccaaggcccaggaagggaaaggcaatcagccaaggtcaggaagccagagtggctcgattgtcaacaaacaaacctgtatcgaggcaaaggaaggcctggagctctgaagtgggcgtgctgtgctggatgcccccctgttccggggaacccctcctgttccccggaccctgttcactcctgacacggccatgggagcagctggcatgactgtgtccctccctgccctgcctcacaaatacctattggtttcatttgtgtgacatcactcacgccttcattgtattccatcatttcctgtaagacgcaactcaaaggctatttcttctaagaataattgctctcacttacaattgcaccattttgtgtcaccctcctctgttgtgtattcactttgaaccatggtgatatgtgcgtgattatggtacactttgtaaattgttacttcaagtatatatgtttttgcctcttgaactaaattataagctataagaaaggagagaccatgccttctgtgtaatatgttttgaatgcccacaataactggcattcaagatgcttggtccagtgctgggatgccgtcaacaatgttcaatgaatggctacatggatttgacactagaagcagttataagttgctgacttttgagccagggcagaaagagactgtcacagttgtgtgtaggttctgaaagtcagaaagggttggatgagatgtggagaagggtatatctggggaccatgaggctagagaggatgggacagaggggagacctggtggagaagtggagctgagtggagggaggaggctggcacctgccagtctgcactgggccctatttgctatatggactgaccagccccaggggatgcccagagctctggacctggtagtcgtctgcctggggaggctgaggcctggcagggcccccagcacatcttgctctcagtgggccttcagtactaatcacctgtgtcctctctgtccttccttgtgccccccccagagccgaaggatgaagtggaggtgtcagatgatggtgagtgcagcccctgtcttcgggtcaggctcttggggtggagggggctgagtgggggcatctgagactcacaccaaccctgacctgtgccccacagatgagaaggagcccgaggttgattaccggacagtgacaatcaatactgaacaaaaagtatctgacttctacgacattgaggagagattaggatcgtaagtggagtgggaagttgcctctgggctcccagggtgagggtggtgcgggtctcacagttagattcagtgcctcagcttcctgttgctccctggggcctgcctcctccccagactgagagtcctgcaggatccaaaggactgacccacgaaagcatcactcactcacccaggactctctgcagagttgcccatgcggtcctacactgccccaactctgcaaaggctgtgggcaagtccttccttttctgtgcctctgttcagagcccaggaccaaaatgagacacagggaggggaataacactcactggggcctgtcaggggagagcagggggtgcggggagcagaacattagggagaagagctaatgcatgctgagcttaatacctagatggtggggtgttaggtgcagcaaaccaccatggcacacgtttacctacgtaacgtacacatcctgcacatgtaccctggaacttaaaaacaataaaataaaataatttttaaaataaaataaaatgagaggactggatcagattatctttggcaccccttccatttgatccacagaagtcagtgtagcctgatcagtgctcactgtaaagcaatgcctgcgttagtgctccattaaacgcgcagcagtcatcaagctccctcatgaacttggctcgcactgcttactctggcttctccctagggcatggaggatagagtgggctcagaccccaaccctgagccaagctgttcatctgcccttacgctgtccctggaggaatagaagaggtgggagagaaaggagtgggactccacttgtatttccagtggtttctgggaaatgaaggagtgatgcaaactgggtaacagtgtcagaaagaagtcagtgccatcacagaggagccccactctcccctctctcagcagtaggaagcaggaccctgcctgggccatcaccagggggtcagtggtagggagtggaaggaaggaaggcaactgctcagtaatactctgcatttgggaagggctgtctccacccatcttcatgggttccactgcagggaggggaagagatgccatcagccaaagttgacagtaggcttgtcaacattagaaatgtgcttcaaaggccaggtgtggtggctcacgcttgtaatctcagcactttgggaggccgaggtgggaggattgcttgaggccaggagttcaagaccagcctgggcaacatagcgagaccccatctctaaaaaaaaaaaaatgtttaaagataagaaaaaacaaatgtgcctcattgctctagagcaggagtctgggcctttcataaaggctgatatcttagattttatgggcgatatgcctttagctctgccactgtagcacaaaagctgccatagacaacatgcaaacagccaggcagggctgtgctccagtaacaccttacttataaaaggaggtgggccagatctgtcccatgggccataatttgccaaccccaagttagcggaaagcttggctaaatgtggcttttctctcctccccctttcatttgcagtgggaaatttggacaggtctttcgacttgtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatgtgagtggcccactgccagcagcgtgggcaccacagggagcccccaaacgtgtctcccctactgccctaccccagccacctctgccccaagatggaaagcactgcagacaggagtgtgatatgtaagatgctcaccagccatacagccaggcctgaccaaacagaaccgaaggtctgtgcacagtgctggccctgagcctctgagcaccagcccagctgcagccttgtgcttatttccaaaacaaaccagtagatctttgaggaccctggtgtctttctcgccctcatctccccatgaaagggccaaagctatccctaggctccttggtttcatttggggcattcacacctgaaggtggtttaggggagggacagggcagcttcctgacttccctgtgaaagataagggggcccctggctgggggcttgaaatccaggatggaagcctctctctggtcctcagtcccatcctgtgtctccacatgcccctggtctactcttgtttgtactctttggacttctcactcactaaagagtggtgctttccctatggggttgtacaaaggcagggggattatcagatgacctccagccaagcctttcgcagaattcattgtttcttctgcacctgaatcctccacctcccttacctctgagctgttggtgcatgcgtgtacacacgcacacacacacatgcacacacacacacatacagtcaagcatgcacactggcatcagcaagccaggcatcccccacagcatctgcattcttaacagtttccttttttatctgaatttttagaatatatgctacaatcacctcaaaaaatattaggaaatacacagtgaaaagtctaatttccaccattattcctgtctatcctttcctaaacactacaaccatcaccaacacaaacaattttattggcttttatctgtatccttccaaagtttctttatgaaaatataagtgtatacagacacacacacacatatatatattcttattttcttgccttttaacacaaaaagtaacttcttatactcactgtcatatactttgcttttttagtttggtttgtttgttgttgttgttgtttgagacagagtctcactctgtcgccgaggctggagggcagtggtgccatctcggcttattgcaacctccgcctcccaggttcaagcgatcctcccacctcaccacaggctcacgccacctcacccagctaatttttgtatttttgtacagataggatttcaccatgttgcccaggctggtctcgaactcctgggctcaagcgatccatctgcctcagcctcccaaagtgctgggattacaggcgtgagccaccgcacccaacctactttgctttttcagcaaattgctatgggagttagtcccatctcactacctagtgagcttcctcattctcacagctctgtggggttttgttgtatagaaaatcacaattcatttaagcagccttcttttgatagagattgagtggtttccagccttttgcttttacaaacaagcatcgtttgtaaccttgtacacacatcttttcactcatgcctgtgaatatctataggataaactcccagaagtgaaggagagctgggttaaagggtatgcacatttgaaatctttagagatattgtgaaattgctttcaacatccttgaaatgctcatcctgaacttggggggtctctgtcctttggtgagggctctgttagcatcttggaattctctcccaggaaagttgagtccagtaagacatccccaagctgtagatatgagtggaatattagtcttttctctcccctcatgccattaacattctggcacacaagtatttcctttccgtatgtgttccttaggaaaggcaatagtagttccgagtgtaggcttgagtcagatgaaccttacttcaaatcccagctctgcttctaacttgttatttgaccttgagtaagttattctattgtaccaatccctagttttattatccataaatgtagatacgacacccacctcatgaacgctgtgggattcaatgcaataatgcatatagggcacagtgctctataatggggagttattgttagtagtatgatacattgactttttttgtatcctggtttttttccacttaaaaatactttttgagcatttaacttccaacaaggtgttgtggaacaaatcctccctagtattcaggaagcctggcttcagtttctgctactattgagtcatgattttgcaattgtcaaatcctatcagcacgaagaagtacttggattagaacagtcaatctcaagatgccccttttggttataaaattctactatttcatggaaccataaaagacgcggtgaagaatttccattcgtatcttacaatctacattcagccccaaattcaaatgttcctccccattttcaggaaatacgtagcccacatctgtgacctcattctttacaccctcacaatagccccgtgggctgcatcttttcacatttattctagaacaggttgcttagtccaggcggtgtgggcatgtgaggacatgtggagaaatgtcttatctttagaagttaaaccttgagcaagttgagagggtgcagggagggcaggagtcacagggcctggggaaggctaggcagcagcaccagtgggcagaataccatacttagcttggaattgggagttggcaagctggatggaaaaagcaaagagaaaatgtaagaaagcttcagctagtctggctttcatccctccaccccatgcctcccctgtggacagcagcaggtcttccatgcccagataccagaaaatttgcctgcacttgggaccttggccaggtcgccaagagtaggaacttggtaagaactcagtcaaccaaagaagaagggaacaggttcatactccatctatacatcccttccagcttaaacactctaagacttgaccactgagaagggaaagaatgattttcaccagtgcaatgtgctaaccttgttggatggagaaactgagattaaaagaaggatgatgcctggggatagaataatggaaatgtattccagggtccctgccttaagtccagttgcttcagatctagtgggaaatagtaatgaatgtgtcttcatcctttctgacttctgattactggatgagcccccaccatatagtagttggtctgacacagcagttccttcaggcccctggcctacttgggcttgtccttttggaagtgcttgggacattccaggtggttgtgggaccctgagcattgaagacaatgtgaagtttaagctgtgtcatccatggctcatctcatgtttgtgctactattagcaaaatttatcaaagaacgttccagctggctgccatagggcaaggagcggagggtctcgagtccagtgatagcaccattccttcttgcttcctatgagagctagccaaggtctagggtttgggggatgaatctgattccttaggatagggatcacttatttatttagtcattcactcactcaccattaatttaagcctaatcttggcccttggcattatcccattactgtgggtggcagtttctgtctatcaaaccaatattttccacccatagcattaagtattttgaagataaacccacagaaccattaatcctgcctctttaaccccttccatcttagaaagttgaaccataggaacagttttcaaaatataataagtatatctgaataggattgaacctatttgaatttatattgaataggtttcctccagaaatgcagcaggaattatctccatggctcagattcccaccactcactgcctcagacattcccaagggcattgaaaacaatggttgcttgctttttcagaatatttaaaatttaaatgtaaacattttggagcaccttgtctgtgccaaatatagtcggaggcaaataagggtctagagatgagcctgccacctgtgatgtgttcagaacttcaaggcaaagccaacttgatacacaaagtgcggagacgaggccatggacataaggccatggaaagtgcagagacaaggctatggacataaggccatggatgcccagtgagggaaagatcattccatgtgaagaaatggggagtgactttttcagagggcgtgaatttcagctggcctcccaggagtggtagttgagtaagccagtatttctcaaacttgtctgatcataaggatgacctggagtaattattacaaatatagatcctcagatctctcccaagactttctaaatcaaaatctccagaggaggagcttgggaatttgtatttttaataagagccccaagtgattctttacatagaaaattgatcattaatattgagcattgactgtgtgccagacacttccaagcactttacctgtgttgactcatttagtctttgaagccaccctgtgaggtgaggctgtttttaatctgcatcttacagatgaggaaaatgaagcacagagatgttaataactggctgagacctaagaatacttgtagatgagagtttgtcttggagccttggcagagagcaatagaaatggagggcataaggacaagagcgccacctgcaggccatttggggaccttcttctcagatgggttttaaagtatgagttctagctccctccagctgtcactggcacagactgaccttctccagttcagcccttccagaagtgagtgtgtgtgtcacgtggcagaggctgtggtatgctgggccccacagtgcatccctgtctctctcctgcaggggtcagtgacaagatccacctagcccaccacagcttatcaaacgataagtaataagtgttgagcaccttctgtgtgttaggcatgatactttacaaagcctcctacattcctaaaaactctatgaggcagggatagataaggaaactgggactcagaaaggttaagcaacttgcccaatgtcacacagctcataaaaggcagaagcaggattcaaactcagctcctttcctcttcgtgaggactctctgtaggagaggaaatacccttgcaagaggacaggcccagaacccacccggccttgttcaactggtggacctacaggccactgcagaaacatgagcttatgactgggtgacagagagagaccctgtctctacaaaacattaaaaaaattagccaggtgcggtggcacatacctgtagtcctagctacttgggaggctgaggcaagaggatcgcttgagcccaggagttcaaagttatgttgaactatgatcacagaactgcattcaagcctggaagacagagcaagaccctgtctcaaaagcgaaagaaaggaaaggaaggaggaggggaggggaggggagaaggaggaaaggagggaggcaagggagggaagggaggaagggagggagggaagagagggagggagggaagagagggacggagggaggaaggcaggcaggacagaaggaaggacggaaggaaggaaggaaggaagataggtaggttggttggttataggccaggcatgatggcttatgcctgtaatcccagcactttgggaggctgaggtgggataatcgctggagaccaggagttccagaccagcttgggctcccctcccctcctccttcctttcctttctttcacttttgagacagggtcttgctctgtcacccaggcttgagtgcagttgtgtgatcatagctcaacataactttgaactccttgtctctaccaaaaaaaaaaaattgaagaagaaaaaaagaaaagcaagcttactgatatctgggtgctgcataagttaccagagagatgctttaaacttgctaagcagagaccaagaaaggtgggtcagagggctaggacaggggaacagagaggactcatgcaactcaggcggtggggccatgcatttgcactgaagggcaatatgctgatggctgagaccccggggcagtccctagcagaggatgcatgcctgtggctgcagaagcaaagttcactagaaatagccaggatccaaagcctatccagttagaaaggattacacagctggggtaaggaaggggtccaagggagaccagttaattatgactgcagggagtaaaccaatactataggcctggccagagtaagcaaatctgtcacagctgtaggtataatgagttacagccaactaattttagaaaatttgctgaggctcattattgatgattgaagatatttttccgttcctggctatgcagaacaaatgcttgtgggaactgtgagtattttgaacttgagttccctgtgactaaaagacacggctagagtacaagaatgttcccttaggcatgtgtggtcatttgagggaaagagactgtttagaggtcactctttttgctaagaagatcatgtctggatctctgtgttcacacccacctctgaaactgcctagtgtagatgcttccctgagtccccagcagcttagaaggtgcagggcagggttccctgatgggaaaccaggaggccctgacccttctcccatgtcggagggtggggattcaggaattgcccatcacccccattccctgggctttcctgccaatttctcctacccccagcctaccctggccagactccctgccagcctggcctccatgagcctgtggcctgaccaccccgtgcacgtgttcccgcagcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctgggtaaggctcatctgcctctcccatggacaccagtgtgtattgcactggccgtttcctctcacactgagtgtgagaggaaacatacagtattggggttaaatccgagaccatgaagacttcccaggtttgaatcctgcccctaccacatactagacgtgacagtaagcctcaaattccccatcagaaaagtgggatcatagtaggacctaactcacagatttgttaggaggatcaaatgtgttaatataggtaaagggatgggaagagtgctttgcacatagtaagactgcttaggtgttagctgtatatatgatgatgattatccccttttgtttttcactctggtgccattagcagcaaaagtcattttggtgatggtggctctgcacatctgcatcatactgtacagtttctagagcactttcacataaaaaataaaccctatgattctcaccatgaggtgagcagggtagattttatgagccccaacttgtagactaggaaacaaaggttcacaatagctttgcccaggaggtcccactgtgagccaggggatgtgctgggattggaacaaggaccccagaccttgctcagggtgctctgcagcacctctgattcttatgctagccaggagagaggtcacaggggtaggcggtcagggtctcaaggccgccctgaaagcactttggtagatgcctgcctggctcacattctgcctgcatccagcctgcctctgcagccctttgatgtcccggtgattgaggaaacagcttcatcctcccttcttagccactgccctgctagcaaggagcccgagggctggggtgagctggctttatttcaccaccctgcaggtagtagaaaggaggggccaaatgaatgccacccaataaatgtctcccacgatgttcagtgctggctgaggctgtgttggtcataaagaggaaaggggtaagcaggggcgaggttccgatagactatgaccggtctggtggtcagcgcagtcaggtgagaaacatgcctcggcgctgggcgcatgtgcctgctctgctctgctcactcctgctaagaggacagggtaggggcagtggctggcatacagggcctgcctttgaacagtgaccaccaataaattaaacaaataggccactgtcctcaggagtcggcagtgtcagagcccagggaacacaatgtccagcttccactggtgagggatactgtgggaacaaccgtgtccaccaaggaccagataactgagaagtggctaaaatgtagcagaaagggctgagaggcaggaattggagcagagctttcacatctgagggctgttaaatgctttgttttagaacatttgctgtgagctctgcgaagttaagcaagaccaggcatagcccacaggtacctgccttttgcacatattaacagacatctctggtcctttatggccaagaggtaccaccctggggttgaagcctctcccgactaccctaccagtagctcctgaaggacagccatgaagctgtgtgaggagtaggagaggcaggagggaggaacggtggtaagcatggctcaggagttggactacctgggcttgagtcccgaccaccacttgttaaccgggtggggaaatcactgcacttccctgggcctcactcatgttctcagtagcacgggcattatacctaccccttggggtgggtgagaacccttgtaaagctgccggtggggtacataggacatagtgaatgctagagattattattaagcataagtcacagtccctgcctaggggaactaactcatgagacagactcacaaaaagaccattcaggggcgggtgatttagcggcctcttctccccctgcccaccctgcacaggacatttgaggtgagtgtgaggtttgttggtttcactggtgtgttgacgcacctgtttaacaaggaggtcagatgtctctgtgcctgttctctgtgccaaagcctgtgtctggcccctcccaggttggggtcaacacacagattcgggcagctgctggtctcaagctggctccgtgatgtgctggcaatttatccctctccatcctggtttcagagaatgcggggtctctgaaggtcctctttggcaccccagaatttgtggctcctgaagtgatcaactatgagcccatcggctacgccacagacatgtggagcatcggggtcatctgctacatcctgtgagtcctggggcacttggtggactggtggaccacttggtggaccagtgggtgggggctgagggttccacaggagggtccccaggctgccctgccattgtcatgatggggagccccccccagagtcaggagggtggcaggctcccctcctatccctggcagcccaccctgctcctgggctcccagggagtcagtagcatgcatattctatagcatcatgtagctacacatgctaagatccccattctgggtgctcactgtccccaaggctggccagcctggggcctttggtcaggagggtgggaaatgtggctggcaccaagtaataaaacctcacttgtgtgggtccacaaagaaggagggcaggaggccaggggcgaatctctgggcatcctcattgtcttcagggcatagcactccatccccaaggcacggggaccccaactactagcctcatctttgagtctagtatatggatgaattaataaacactattgatgatcgagccttcaatgggactaacagataaaagaaagtaacacagtaattagaactgaaaaatcaggtgggaaatccaaagccatttcaatgaacaataatgcaggagaggggaggccagccatctaggccggcacttcacaaacattagcatgcctgactcacctaggcggctccttacattgcagggtttttgttcaggtctgggtgacctggaatgccacatttctaacaggctctaggtttgtgaatgtgctggttcaacgactgcgctctgagtaacaaggcttgagaacactctgtcggtggggtctggctgctttagtccctgaagccccagggtgcggacggtcattagcccctgaacctgtgtggccacatgcagttatgggatggtgtccccaaagatgcagatgtgtatgctttcattcaataatgtttttactgtcagaacaaaaggaaaaatttaacattttcatagaaaatgaggaagacctctatgaatactttcttagacccctggggccttcagactccagtgtgagagaaggttctgggcgattctgatgcatagccaggtttagaaaccagtgttataaaagctttagcagaagtggtgtgaattttgtgcaatgtgactttttcacatgctcaggaactttactcactatagcctgttaggacagtcccctcagtggaacctgcaccacaggcattgtagtccagacagttatcctctttcctgcctgggattagccccaccaccacagccttccccagatcagcagaaaaaccccgggccaggtgtgcatttccctgcctgtttccctgccccgccccctcttggagaaggggcgctgacaagtgaagacagcagctggactggagcttgactccctggctccctagataagtaaggaacagcagggtagggggcggggccagcctgcccctttcagggcggccccaggcctgggcagtgctaacctctggccctgggaaaaacaccagacccttgagaagcagtccttggtcagctctcactgttcagccccagctgcgctgtggtctcgcttggtcccagggtccccctccagccgtcatggagacttgccttactgtttattcttcagtgggttttcccactgccgtggcatcaggatcttctgcagctacagattttcacataggaccttgtttgatgctcacaacaaacccaagagtggatcatggcagggattccatcttcatgtggcgttgaggtgacaggggccaaggaagcccacgtggctgcccacttcccacagtcgggccaggggaccagtcgtcccagtctgccaggatacaggacttttggtgctaacatgggaacagtcccaggcaaaccaggacaattggtctctctactggtcagtgacagagcagtgactagactgctcactaagttttcacctgtgtaacctctacccggatcaagaaaccaagcactgccaggcccccacagccctctggcacccctccctgttaccaacccccagaggtcaccattaccctcaaggctaatgtcaatgaaatcatacagaaagaagtgtctggctttttttgcttgacatcgtttgtgagactcattcatagtactatgtgtcattgtagactgtttattctcagtgttatgtagtatcccattgtgtgaatataatccagttaatttatccgttctgctttgataggcttttgagtgggttccagtttggccattggaagcattctggttcacgtgtttcagtgaatatatttgtacatttctgttggatatataatctagaactagaataattgggtcatagggcactttattgtcaaatgagagttcttttcggtggaggaacatagtaatttgggcactatgttaccttgtttaccagattacttttaaagcaaagaccaagaactagggcagagttttggaaatggggagaagatagttttgatgctgccagtgcttgggcagagggttgtcaggagggaggaggggtgtgtgtgtggcaaggacccaggccaggtggcactgactcaggctggatcaatcctgtgccacatcttagctcctggacccccactgtgagccactgccctctggggcttttccagcctggctctctcagcatggatggaagtcagggagttcccccggcaagccagggctctcaacagagagcggtgctgaaaacaaacattggcgccaaggagatggtttcctttaagcgcctgctatgcagaactctggagccactgctgggagcacccaaaagaggctctctggtggccctcatggcatcctctggcccactctatccctctctttggagcctagtcatctgtcgggcagtccctgtcagggcgacttccacctttgtaccacagagcccctcctgttctcctttctggggccagtgagagatggagaggccagggagttggaagggaaggcaacagaccgtgtcaccataggacgatgtgactttactctctcccacccagcccagccatcagggcagtttctggccctatagggaaggagcagaatggggtcgtggagcccccacactcttaccccggatcctgaaaggagatagtaggttgtgtgagtacctagagaccttctgaagttagcaatacccatgtggtttctggcaggaagtgagaataccagagagctggaggccacacttccatacgggagaaatcctaagtccacctccgtttaagagccctcctccccctgctgtctccctcccctacttcctggacttggtacttccttgctgcctgtggggaggccacaacagctcttctccgagcccttccctcaccctactccacaatgccttctctcccagcctccctcaagccagagcgaaccagcaatggctgctctgcttcctcctcctgcctcttcctgaccaggcccagcagcacagccttcccattcatgcttgtttgtttgtccaacacccaccgtggtgcagacagctgtcagctgtccctccccaccctggtgtgtggtcgggagatgccaggagggaggagaggtgtgtatggtggggaggcaggtcagctcttctggtgacagctgcccagtcagctgaggaggggtcacagtgccggggcatcgggggcctcctcagaccagggtctgactgcagggctcctcagccagatccagtaacctctgccttccccacctggggctgccgctgccctctctgctgctgagcctggaaatacgctctgattccagccctaggatccctgttccctctccaagcccggccaccaccttcaacttttactaacacaactaaaccccaggtcgctgcttcctcggccagtccacaaaatgatgcacagctcttcctgtggacctactcagccctctcagctctcccaccagagtatcagatggctaatatggataaaagactaaccccttcctagcagtcagtagttccatcagcagatgtgtggtccccttagctggccactggtacagtcggggcatctgtctgctgcttgaaacacaacacagaagccaggtgcagtagtgtgcacctgtggtcccagctactcaggaggctatgatgggaggatcacttgagatcaggagttcaagaccagcctggctgatatagcgagacccccatttcttaaaacccacacacatacacgcacacacacacacagaaagtgtagtccaagaggcatttctgcaccctctgctctcctaaccttctgcccccacagccaaacaggcttccacatcagattccctgggggaatttctttggcaatgagctgagaattaagaaattagaatgccctgcattcatgaccattgtgtttcatcagcacaaagactaatatttgaccactaaaaatcaacatgtagagtctggctgtacttgatacatccagtgaagaaaaagtaaagcatccaaggacttgcccagactgattatagttttgtgaaaaacagatcaatccattagttaaaaactagataagaccagggagataaagaggtgttttaatgctaacattatttgttgaccggttgatttttttaacaaataatgactgttatctagctgggcgcagtggctcatgcttatactcccagccctttgggaggccaaggtgagtggatggcctgagcccaggagtttgagaccagcctgggcaacatggcaaaaccccatctctgcaagaaatacataaggtagctgggcatggtggcgtgcgcctgtggtccctgctacttgggtggcttaggtgggagggtcacctaagcctggggaggttgaggctgcaatgagccatgatcacgccactgtattccagcctgggtgacagagcgagactctgtctcaaaaaaataaaaagaaataataataatgactattttataaataaaaagacaaggctgggcacagtggctcatgcctgtaatgcactttgggaggcagaggtgggaggattgcttaagctcaggaatttgagactagcctgggcaacatggtgaaaccccatctctaccaaaatacaaaaaattagccaggtgtgttggcgcgcacctgtggttccagctactcaggagactgaggtggaaggatcgcttgagccagaggttcagtgagctgagatcgcactactgcactccaacctgggcaatagaacaagaccgcatctcaaaaaaaaaaaaaaaaattaaaagacatgatcccttatgcaaattctgccacaaagaaaaagttccccaaaaaggtttttaaaaatcctgtaaaaccccaccacccagcaacagcattactgaaaattcaaacaccctctttgtcaacatgctgtgtatgtattatattttttattccagacacatgctctttaataggaagaatgctgggggaacttgggcaggcaaggagccaggcagggtgaggagagtatttcagatggataggctgccaggaaggaggagtgccagaggccagaggcgaggaggctctccctgactgtgcccagagttgcagagattaagacctatctttgcaggattatagttcctaataaggaagggaggtttgcagaaggggaactttctgcattccacagcagggttgtttgcttttcctgccatcttttggagtactgccggacttcccccctctctgtttccagtggaaaatgtaaagaagcagcaggtggctgacaggcaagagacaggctgcttcctgatggggcttgcatgggccacgtgggggtcggggtcacagagacagagagagctgggaggcccctaggaaatctagcctagtccccttgatgtataaaaggagaagctggctaggcgcggtggctcatgcctgtaatcccagcactttgggaggccgaggcaggcagatcacgacacgaggtcaggagatcgagaccatcctgacgaacactgtgaaaccccgtctctactaaaaatacaaaaaaaatagctgggtgtggtggtgggcacctgtagtcccagctactcgggaggctgaggcaggagaatggcatgaacccagggggcagagcttgcagtgagcagagatcgcaccactgcactccagcctgggcaacagagcaacactctgtctcaaaaaaaaaaaaaagaaaaaggagaaactgaggcccagagaggggaaaggagcagcagataacagtgcagactcggggacaggtaaatgcccacccttccctcatggggacatgaccgagaatgattctctttgccttcttaaaacataaatcagggtcttgctttaaaaaaaaatcccatccacaaagatctattattcagaaacacaaatatgttgattaggatgagacaattcacattgtaaaagctttcttctctttacaaaaggtttcaccagagggttcctcccatggcaagctttttctcccaatatttcaagtggggtttgttctgtcaaactcaaccaaagccttactcctgaagctgtcagtgcttggcttatgatgatggattcataagcatttgggagaagggacattggtaaagccctaacttgacaggttgatggcaggagggccccagacccatctctctttttttttttttttttgagattgagtttcgcttgttgcccaggttggagtgcaatggtgcgatattggctcactgcaacctccacctccagggttcaagcaattctcctgcctcagcctcccgagtagctgggattacaggtgcttgccaccatgcccagctaatttttgtatttttagtagagacaggacttcaccgtgttggccaggctagcctcaaactcctgacctcaggtgatccatccattttggcctcccaaagtgctgggattacaggcatgagccaccacgcctggcccccagacccatctcatggggctcagctgagatcagggcaggaacagctacacaatttgcaacatgaaaggtggggccacttgttcaaaccttattgagaatcttgagacgacagcagcagagcattaaaccaagcacagggcctgtctaagggtgggactgtgggcaactgtgctggtctaacacccatgaggctgactcacaaggccctcatgaacagtggggtgagttgttgctatgaaggtgaggtgcacagaggtgagaggtaaggtcagtaagccacaaatctgctctattttgttttgaaattctttaccttataaagtttatttggcttaagctgctggtcacaaagtcattcctgcactcacagcttggtaaggcagtggagggaacccagcagaactgcatgagatctccgggcatggaccgcctccttactgtggaccaggcctggtgccagtgctgaacactgcaatttacttcatctttacagaaatgttaggatagtatagcatttaagaggacaggctctagaggcagatacctggcttccaatctcactggctgtgaatctttgggcaggtgacttgagcctgggctgtgcctcaattccctcatctgtaaaacaaagttataagaattacttgcatcatagggcagtgttaagattaagtgagttcacttgttttaggcacttgacccagtgcctggcacatagaaaaacctcaatgaatgtctgctgccatcatgatgatgatgaggatgaagaagtgaccaccctatagttaaatggcagcttctccattttagaggagaaaactgacacagatcagggaattgtccaaggccatacagcaagcggagaggctgcactctgtcctctgccatggcacctcatagggaagttttctagtttggcataaatgcctcaagttccccgaacctacattgctgattcaaagtccatctatccattgggcacacacttcacttgctgagcctctcttatttgccgggccctcttcttggagctgaaggtgtgtggagagaggtgggaaggaggggacagaagggtgcagtggtgatcactaccatgtgcccagtccacagagagggggcaggagcacgggaggaaggggcttggagaaggctctagcctgggctttggggaataatagaaaaccaggacagagggacttatcagccctgccgcgtaccctgcagaagcccgtaatctaaagccaacctgctgcacctcagcctcacaggtaggtggtgtcaagaggcaggtgaccaagaaaagacagggctgtgaaccacaccctcttttctttccacaagtggaagaaaggcaggtgcaaggcccacagagcatgagtttgggggtggggaggctggccgaccctcgcctttgacctcagttaccactcacctggtcgtcgcgccctctcctagccacacctgctgtcctgctcttgtctctccagagtcagtggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaagtaatgagttgggatttcagtctttgcttccctactccctgccctgtgttgggaagcaaagggggattcctttgcctgttggggtgccctccttgccaccccgccttgggtcgttcctagcattccctgaggaagggagggtgggcatggtaagagacccgaatgcatgtgggttggggaggcgacttcctaggccctgccccctggagctagacatgggattcaccttcagaggctcagacacctgacttgaaaagcgacacttgaccacgttacagagcaaggggcagctgttctgtgtgaataatgaccacccttcttattttctgggtacagttgtggccagccacagccctcttcaggggctgcaggggaaggaccctctcaacaagcaagagcagaggacacgggcatcttagaacttctctgtgggtcccgatcatatccccagattattattattattctggcttagtgtttttttatatctcagttatttaataactgcctgcttgaatacagccaggtacgttctaacatctggccaaagggaggctatgatcccagaccactgggcttagccctctcccagctcctcctctgttgaggttccccacctgtgcctgctgcagctgtgaacataggaaagtgaacagtgggaggtcagcatgcatgggctgtggggaaaggtcaggcactcaagccctctgggtttcagtagaagattggagcttggagttgtagaggagaccagagtgggaggttggctgaaggtgggcagtgggtgtgcctagacagaatctcctggaaggaactgtcctgggctctgcatgtgtagggagagctgcccagggaaagggagcagtgggactcaggtgagaacagctggcctattgggcagctcacccactctgcaaataggtgactagatgaggcagggcctgactgtaggggtgccgaggagcttggagctatacttggcaatcccagggagcagttgtagccttgccaagaagggtggtgttgacatgggtggcgtgctagagagaaggggaggggcctggctccagggcgggcaggaggctctgcactcccaggtgactttgcagccttgcggggctgccgatggctcccctgaggaagaatggctgttcggggcaggaaggcacagttagttgctgaaggagcaatattggagtgtctcagatggctctgtcaggctttcctgtgatgcaccccactctcagtcctttttagccagttcagggccaaactcccccagaggccacattctacactccttgacaatgagatctttttagccttttgctgtcacagtctgtatcagaaatgggcatgacccaaggagaactgagatactgtgggaagtctaaattctcttccaatatgagggacccccacacccaaggtgcctcaggagatggaaacctcctcagtaactctggtacaaggatggcttttgtcatccaagctttattcactgaagatttggtaaacaaggtattgtgtgtgtatatatcttattttctcatctgaccttgaattaagtcagtaacaggctgtactggatccctctgtgctcataaaatggattcaccaaagaactgatcttattcaaatagatcaagacactaaattcccataaactcttatacccagcctctcttcaaccagaaatcaccacctatcagcacttaaaaaaaaaattccttcctactataaaaataatgcatgaaaattatagaggatttgaagaatataataaaatttaaatcatctataatccctttatctaaagttcactacattttgctatacttctttccagtcatttttctatgtatgttagcatttggttctttaggctttcctagtcctgttacagttaaggcaatggctctaaaatgtttctagatccccagagctttcagaaagatgaagtgagtttcagcgcagttctaaagtagtcataattcataggttataggcaggacctacttctttgagttgtaatggaaaaacctgatattcaacaacaccgtaagacattaaacatgaaagttcagtgattgtcggagattttatcctaggatttaactctcccctcctccagacagggtggcaggaggattaggctttgtgggccccagccctcatgagaggagcagaatgacgccaccctggaatagggtgccagccaatcccagaaacgtctgccctgcagcacttactcttcctcgatcccaagagcaggccatggagcccagtcacttccttggtgcttgggctttcattaacaccaacccatgctggttctggttagtgtgacccagaccaagtgaggagaaaggtgaagagcacagtgatcctgatcacggtggatggtccgggagcaggggccctgggctctgccctcatgaccagggacaggtggcctcccatttctgaactaaccagtggtctctgaggtctcctcctgctcaaaaatctcctgatctctgcctctgtcagaaaccgcctggactgcacgcagtgccttcagcatccatggctaatgaaagataccaagaacatggaggccaagaaactctccaaggaccggatgaagaagtacatggcaagaaggaaatggcaggtaatgagagggtcactttggactgggatgttgcccctcatatttgtgttgttcaagccactttcattcccagcttgccctggcctcacaccaagaaagtttaaatttatttctgaagtagtctgggaccaatttaggcagctgattaaggtacagtggtttgcttagtcctgagtgcagagtccctttctcaaggagatgggatggattcttagcttagctgtctctctgttcctgctcacctttgccccaggggaccgtaaacccttattcagattaagccaatgacattttgtgtcttcatggcttgggatgagcaacatcactttaaggtccatttgtcaaccctgagaatggggtggtagtatggtggtttcacatttctttatgatgaaggagggcacatgatctaaagagagagacatggtcccaccatctaggaaggttgtatgttaatagccatgtgtccttagcaaatgatgtaaccttgctgtggatttttctcatctataaagcggggataatagtggtaccaacttcacagcattgttgtgataattatgagaattacacgagatcatcctcatgtggcctttagtagtacaatgcctggcacatggtgagtgtccagaagcgatcccagtcgctaataggtatgaaggtaggccatctgtcagggaccatttaaagcactatctatgcactaaatcttttaaccctaggaggcaggtactattattatccccactttacagacaaaattgaggcagagaaaaggttaggaaagccatccaggatcacacagctaataagcagaagggtcaggattcaaacccagagcttgactgcaaaacacatagtcttaaccccaagactgcctctgataaaaggcatgggtggataaaattattatccaaaaccacaggatgtttttcagtttatcaccatcatcacctattttatcatttttattaccacaattagaattacaattcttttttttttttttttgagatggagtctcgctctgttgcccaggctggagtacagtggcacgatctcggctcactgcaagctccacctcccgggtcacaccattctcctgcctcagcctcccaagtagctgggattacaggcgcccaccaccacgcctggctaattttttgtatttttagtggagacagggtttcaccgtgttagccaggatggtctcaatctcctgacctcgtgatccacccgcctcggcctcccaaagtgttggaattacaggcgtgagccaccactcccgacctagaattacaattcttaggctgctggagaagacatggtttcttttttttttttttcctcgagacaaagtctcactccattacccaggctggagtgcagtggcacgatctcggctcactgcagcctctgcttcccaggttcaagcaattgagaggacatggtttccttactcagggactacgtagtgcaatggggaactgaagcaactagacatgaaaggatgtaacacgcaccaagatgtataaactatccggatagttctccatagccatgggtgtgtatggatagaacggacctggtcgcaaccagagttggatgtgattatgaggaaatgctcccaggtgcaggagtttgaattaggtgtggaacctcagtcagaatacagagaagaggactgcacaggtggaggagaaggcacagaggtgggagccggacccattccggctgggcttggctggacaggagcagagtcttttagctggatactcaagggacccaggggcattgagactttgcctgggtggcaaagaaaagggaaatcactgtgttggaggcaactggaacactggtcatttaccacaccaggtgactaaatcacagttgcctcagaaagtagagtgtcactcagaggttgaaagagggagcaaaggcgaatgggggccacaagtgtggagtttaagtgaccaccatcctgagcacatatcagctgtgctcctccaccatggaagtcagttcctggctacacccctcatgggaaggtgggtctccaggcctccctcaagtgcaaggtgagttgaaacatctgtagctgcttaccttttggtgccactaggatctgagtagcaaatattctttttaaaaatgtgggggaggatctacaaagtcaaagtcagctgtattaataatcctgtagccagcaggtctcaaagaaatatttctggaaaggatagggaagctgatgtcagggcggggcagtcctcagagcagtgagtctaagtggatattgcttggctgaggctataggttaaggggcagccttatcacctgggaacatctgcagatgaactaaagccaggaggatgcctaaacccaggggctaggagcagagaagagatgaggaaacaggagaggaggcaaagggaatttttcagttaaatcagtcagggaatcatagtggtgctgatttttttttttttttttaaagagacagggtctcatgctgtcacccaggctggagggcaatggtacaatcatagcttactgcagtctcaacctcgtgggctcaagcaatcttctcgactcggcctcctgagtagctgggactacaggcatatgccaccagaccggctaatatttttttttctcctttggtagaaacagggtctcactatgttgcctagactagtcttgaactcctggcctcaagcgatgctgctgcgttggctgcccgaagtgttgagtgcccagcctatgctgatattttaatcaatttttttttcttcttgtttacggcattattagccatagggttttctggaagggcgggggaagaaaagggtagaattcagagaatgaaccttaattttatattttagtatagatggcgacatttggaaatgatttttccacaaaattgcacacaaaagttgtccacaaaaattccattcaacaagtagtttccctgaagagtagcttccctggtaacagctctaaccatttcatgttacgttgctccctcaggaaaacgttttctgcattttaactgcaatcaccagggccttagctccccttggaatatgagggttccctcttgcagcagccaaggttctgtgcagtggggtggagtgggctgtgggcgggggcagagggagaggggaagatcaggctcaggtggcccagaactctctgcagctgtgccagagaaggcaccttcttgttattctggtgtggttttcataaaaagccctagaaggaatgaagtgacatgggaacaaatccctacaagcaaagctaggctgggtatagatgactaatcatattactcatcttggaatcaagttattccgaaagaaggtatattttaaatttatattaaaagaattttacaaagatatgttggaaaggtgtagcaatgggggcaggtaggttgagcagattaacagggtttccgcatgcacactggaagcaaaagactagacatcagaggcccttaggtagccatctttattttctgggaaccataaagaccccagcagtatggaccaagggcattaggggagaaaacactggactcagtatagcacggagtattcttggccatcccatttggatggtatgcactgctcaggggaaactgtagtcttggggctactggtatatatggggggctttgatgggtaaccagcttgctgtatgtatgtcagggaatgtcttagtattggtgccaaaagaccctaatcctgggaaactccacaagcctgcctgggcaagccaggatggctggccccacaagctctccaaggggcagggaatttgtgctgcatgaaggaggctggtgcagatactgctcaccagcgacacaggaacccagcctgggcaattgccctcaagcaagaaaaagggagaaattacaaaatcaaaacttggcgatcttgatgttccaaaaatttccaaaggtctttggtcagtaaagcaacaaccaattgtcagctcaaaggcataaaactggaagactagaacatactgatatattcatttctagttctgacaaataacttcctcggcaattttttttcacaaatcaattcccaaatatttttctatgttttagaaattatatgctggatatctccatcttttagaaaagttctccctatgtgagacatatttatttgttaatatatttactacttcctctgaaatactataactcttttgtttcctcattctgatagcttcattttagtcattttgttatgaaataaaatctggaagaaaaaagacatcgtctcgccacaccacacaggtgaagacagtcctcatcagtcccaatcctgatgtctggaattggggagcccatgggctcaaggcgggtgttccttgctacacatttatggatataaaccagagtcgttctgtagaggtctggaactgcaggaagattagaatcttctgctcccaggctactgaggcccagagaggggaactgacttgcacaaggtctcccagcaattagggttagagaactaacctgtcccttgttgggaatgaaccctctgggtttagaggctcctagcccaggacaaaccaatctgtgttggataaagggaatggagagcagagaagggccgagtctgagaatcgggttgattaggaagcaggctggtctgacattgactacgtagggagggctgccatggctggtaccacctcttacctgttcctgagggcagggtaacctcccatgggaagagctgggtctctctctctctacactttgtctagcacaacaaacaggttgaaccagtaacatctcccagaagagcatgaaaggttgccacgtggcctgagcctgcagaggcattctccgcagggccacacggtggttctgcgcacagttaagttgttcagttttcatctctcaccatcttcccctcctcatcacctccacctggggctgcgtggattctgttcagcgacccagcctcactgtggtggcagaggccagaaacatacccacaccatacagtgtgatgtgtgtgagaagggatggccaggggacagagcaaggtgaaatgtctgtccaaagtgcatgagagcagtctgcagcaaggatggcaggaggcatgacagtaaggtcatcccgctcactgcagtaggtctcctctttaaccatacacacacgcacacaattttctgtatgtttccttagcacccagaagttattcactttcaaaatgatcagtctttttactgaagcttactggctttccaactagtcctaaattgtgaggctttactgaagtacttgagcatgtgaagtgaactgaggaggaaaatggctttgccggcagagtttgagatgcaacgagtacaagccatttgcctatgaagaggctgtttcctccctctctcagggaggacaagtagccagtctgtggtgacatctgttgtctagatgcacagcttttcgatgcctaaaaaagatgctttgggtgcaggggtggaaagacttggttgtgccttagttttcttatcttagtcattcctgttaaccttagaaaaaaggtgaaaaacttactgaaagataagaaacaataagacacaattgtacattattagggatcctatgcttggtagaattttcgcaatgtaaataaattacatctcaagttctgatccttttcagcagaaattctttcctctcccaagtctagtcactgagaagcaaagtgccgttgccttttatttcttcaatgcttctttttggtgcctgaatgcacaccaaggaagagctcctctccagagcttcactgcatcatagacttgtgcaggggccagccagagtgtttctcaaaatcttttaagtctctgaattataaacagagctaaatgggaccttggagatcatcttgtccagccccctcctagagaaggagactgaagctcagagtggttaagtgacttgcccaaggtcaacaggatgctgtgttattattattatgattatttttgcatcaggacttgtgggatctgtagtaactattctcttggccaattataatcacatcactggcattgttttacgagaaatagccccgctaggcccagtcagcaataagtctttggagctgtctcagcctgcagttgctttatataaaccatcccttttatgggagttgaagcactgtatgaaaagggtttttgtctcatgttgaccttgtttagtcacattaacgcacacatcagttccaggccccattccattctctgaacatcttctgacacactgacagtgctgagcagagcaaggttgggttcgctcctctggcagaacctcggctctcaggaggtccttgttccagggaacagctgcttctctggggctgggctctactccctgcagcccctcgcactacccagctggaaccagggacaacgcctgagtccaaccctcgtgtctattttccagaaaacgggcaatgctgtgagagccattggaagactgtcctctatggcaatgatctcagggctcagtggcaggaaatcctcaacagggtcaccaaccagcccgctcaatgcagaaaaactagaatctgaaggtaaggaggagtttctccagccagctggtgagaaagaaagggctggggaacaaaggggcattttgaggttttggttggttttgttctttttttttttattttaatattccctgcaaggataaattcagaagtaattttgggttgccctgacaattactaagtctaataattattcttaatcgtttaactttaagcttaaccattttcggagggaaagttgttatttgtctaatagaactagatgacctcagctatgctttttcatatattttgtgttaaaattaacaaagattgtattaaaatcttcttttgttcttatggcaaaagtgatattctatattaataggcaaaaataacattaaaattacatgtagttgtgtaagatttataaaatattctattttctaccatctttgtggttttgttttaaataaaaattaactcatatggtccacattctttggcattgttcatgatgctgaatcgtgtcatttgaactgggcagactgggactggcaggtctcctcctggagactaatagggtcagttacttgctcaccatcttagatgctgtcccgtccatctcctcagtgaaaaccccagccttttcctgcttcaggtgcatgcagggccagacccttatctcatttggccagagacaccctctgtccctccctgcctggtgctttttgtatccacaggtgagaatctgagtttagattcccttggtgagcaaaggtagggttattggtgaggccagcaactgcctgctctggagcttcctcacagccagggatagagactgcagcacacaggcctggtccctcctgagccacttctgcccctcctcagatgacccagacatagcctgaagggaagggaggagatacaggtgtccctccaagttacagcttttccctgaaccaatcccacatcctggtccacagtcacacagcatgaaggcagtgtgagcatggagaaagagccactggaagctaaagatgcggctaggacctgactcctcccttgtaaaaagcaggtggaacacctgctgcagaaggaaggcagagggataccaagactaggaaggctgatgaggtcctgccctgctcagataccctcagctgaatcctaaagcagcatgaaatgcagccagaaatcctttttaaagatgatttcctctttcaacatgtcagcataaggggaagggggagtctgatccttcctcagcttgggcacagttccttcttctgccaaaaaccatttggcagcaggccaacctgtccccaggagaaaggcgtgcttatgattcagttctcaaagctgccttctttgctaaatcatagcaacttttttaaaagttagtttctttaagctagaggcgaggcgagaacaacgagtgaagaaatgacctggtcttcttctctgtcttctagaagatgtgtcccaagctttccttgaggctgttgctgaggaaaagcctcatgtaaaaccctatttctctaagaccattcgcgatttagaagttgtggagggaagtgctgctagatttgactgcaagattgaaggtaagttgtagctgtgcttctcttcaccatgaatagggtgtggctggatggtagagtccctaccatgcaccgtgggcaagaagtcagttctgtgcagctggggacaatgaggaactgccaagctttgggggaaactgggtcagcaggagctgctcataaagggctatgccctgcactcccacctcctgaaggtgtgtccttcagtcacttccccagggggcacatttgaaatttcacctacttacatcagccactagacctaagtttagaaatggccttgcatggacttacctggctttggaacatgcttagtgaaatgagctttgcaaactgctgaaaagcatgtgacttgcccatatgaggccctcaaaggaaggctggcacaaaggcataggatgtggaatcggcaggctctgctactcgtccacaggctgtgtgaccttggatggtggtccaactcccctgagttacggtccctctgctgtaagatgatagctaagtcacggagtggctctggggattctgtgaggggacatatgtgagaagggggaaccttttagatcttgtaaagatgtcacagagcaaagggaaaagttgtgggactggcaggtacagagagagtgcatgcattgtgacttcagactgaggccagttgggagccaggcacccgggacaaagcactcagccggcaccatcttccccaggctgcttatctgcctgctgggaataatgcagccacagacctgtcagtggtcagagctcaagggaccttaaggggtcatggcatagcacctgagaaatgagcaaagttgatgacacaaagcgtttccattttcatatagattgcaaccgtctagaaagagaagggacaagataagacaggctctttgcttcaagtctgtgactttcacctgccaaccagggtggtgggttatcacccattttggtctgaccaaataaagcacagaagtttattaggcaactttcccgaggccgcatagcacagtacagcagtcaaaacaaactgtgcctcccactttctttgattctccagcaatgtgactagacaatgccttttgagtaaaataacccaaagttaggaatggaaaaaatagtttttcttctgcatctttatattatcaaagtgccttatcaatgcttcgcctaccatagtcattttcctttcctcactcaattaaaagaaagtggatgtgctgcctttgataatgtgaaaattctcggactggggattctgctgaaggctctggagccactgcttgcaattctcaccattaccattgcatttgggtcttctgaagtttcttttcctttttgaatgttttaaaataacataatgattatcattttgtacttaattttctctttgggattgtttcgtacttaattttctctttggaattgtttcattgatatttatgtaacttttgcctggggctctgatgagaaattaaagcatatggatgctgttttgataaaaacaaaattgaaacttttgcactgagggtgcagggcatgggagtggagggtactttatgaccagctcttcctgacccaattttcctcatggtctgggtgttcctaattacttcgaaaaaacaatttctaaaattattttgaaaaaacaacattgaaaagaacattagaattcttgatttcttatgtataatttttattctggttagggctcatattagcctgtttgcattgctataaaggaatacctgaggctggaaaatttataaagaaaagaagcttatttggcttggtgccagtatctgcatccagtgaggcctcaggatgcttttaatcatagcagaagcaggcatgtcacatggcaagtgagagagcgagagagaaggacgtgccacgttttaacaaccagatccgcatgaaatgacagagcaataactcacccattacctcgggaagggcaccaagacattcatgagggatcggcctccatgacccaaacacctcccaccaggccccacctccaacactggggatcacatttcaacatgagattcaaggggcacaaatatccaaaccgtatcagggctacaatttttttcctataaaaatacttcaccaacatttaagagaaagtcaggtggaatatattgtatatttttaaatgtatgtatatatatgactttaaaagcggggtacatgtatatactatgtacctgcaaacaaaatgcataatgttggtaatgcttctgtacatatatatgtacacatacacattaaatacatataatatatattttatatgcatgtgtattttattttttaatgctgaactttgcagagatatgactaatgcataaaggctcattggtgaggtccatttccaattgtccataggcaaattacctgctttggatcagactaagacaaatattgctttcttcttcttagcaatattatcagctcttttaaattatgttttatatagctgttattagctttattcagttataatttatatactataaaattcacctattttaaatgcacaattcaattatttttaatgaatttataccacaatccaattttagaacattttcatcactccaaaaagatcccttgttcccattttgttttgactcttatttttcatttaaattatttcacttaaactattatacaaaattgaaaatttaggctgggcatagtggctcacgcctgtaatcccaacactttggaaggccaaggcaggcagatcacttgagtccaggagatcaagaccagcctgggcaacatggtgaaaccctatctctacaaaaaatacgaaaattagctgggtgtggtggtgtgtacctgtagtctgagctatgcagtaggctgaggtggaaggatcacttgagcctggacattggaagttgcagtgacccgagatcatgctgctgcactcctgcctaggcaacatagtgagactctgtctcaaaaaaaaaaaaagatagaaaattgtattttcggccgagcacaggtagctcacacctgtaatcccagcactttgggaggccaaggcaggcagattacctgaggtcaggagatacagaccagcctggtcaacatgctgaaaccctgtctctactaaaaatacaaaaattagccgggtgtcgtggcgtgcacctgtaatcccagctactcagaaggctgaggcacaagaatcacttgaaccaaggaggcggaggttacagtgagccaagatcacgctactgcactccagcctgggcgacagagtgagactctgtctcaaaaaaaaaaggaaaaagaaaattgtattttcaatctaagaaggtattcagatctaggtgtagagttggaattggagcagtatttcaggtagtactctatttttaatttttatttttttgccatgttggccaagctggtcttgaactcctgcccaccttggcctcccaaagtgctgggattacaggtatgagccaccatgcctagcctcaggtagtactctatgtctgtttaaagatgggtgggtgtggtggctcacacctgtaatcccagcactttgggaggtcaaggtcagaggatcacttgagcccaggagtttgagaccagcctgggcaacatagggagaccctgtctttacaaaaaaaaaactttttaaaaaattagccaggcatggtggcatgtacctatagctccagctacttgggaggctgagggaggaggatcacttgagcccaggaagttgaggctgcagtgagccatgttcatgccactgcactccagcctaggtgatagaatgagaccctgcccccctaccccccaaaaagtgaaaggtgtgatgtttaactgagcacggtcgctcatgcctatagtctcactactcaggaggctgagaagggaggatcgtttgagcccaggaatttgagcaacagtaagctacgatcatgccactacactccagcctaggcaacagagtgagactcatcactttaaaaaaataaaaaaactattaaataagttttttaataggtgggatgtggtgctagtccaacatgtgtgggaaatggaacaactttaaaatattctatttggggtttcagatattggtatttacaagacatgtccatattctaatgtagatatcaaaacagtcgataaaggccaacatcaaaattttctccttaaccaccttaatcaatagtggtagcttacaagttgcttgcatgagttgataagaaattttgaataacagttcctgcaacttgtgttctctccctgtgatgcaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactcaaaaaaaaaaaaaaaactcaagatagtaaaagcacctagtgtgatagattatcggttaggtcatttgtgggttgattcttcagaaacagcagttgatacctagcagcgttattgatgggcattaatctatgttagttggcaccttaagatactagtgcagctagatttcatttagggaaatcaccagtaacttgactgaccaattgattttagagagaaagtaaccaaaccaaatatttatctgggcaaagtcataaattctccacttgaatgcgctcatgaaaaataaggccaaaacaagagttctgggccacagctcagcccagagggttcctggggatgggaggcctctctctccccaccccctgactctagagaactgggttttctcccagtactccagcaattcatttctgaaagcagttgagccactttattccaaagtacactgcagatgttcaaactctccatttctctttccccttccacctgccagttttgctgactctcaacttgtcatgagtgtaagcattaaggacattatgcttcttcgattctgaagacaggtccctgctcatggatgactctggcttccttaggaaaatatttttcttccaaaatcagtaggaaatctaaacttatcccctctttgcagatgtctagcagcttcagacatttggttaagaacccatgggaaaaaaaaaatccttgctaatgtggtttcctttgtaaaccaggattcttatttgtgctgttatagaatatcagctctgaacgtgtggtaaagatttttgtgtttgaatataggagaaatcagtttgctgaaaagttagtcttaattatctattggccacgatgaaacagatttcaactgataaagagctggagaactccatgtactttggaatctcctccaagatagccagagtttaatacatcttcattctcaacactctccaaagaacttgacctaccttatgggttccatatttttcttcttaaatgtgcatcaatcatgccttgcccccaacctttaaatatattcttagacctggtaaatgcactcagacttgcgtctttaggaatttttaactttctttcactacattggcacttaaattttttctttataaagctttttgaaggtcataaacaaagaccataattgatgatagacctaatacatttcctctgtgtgtgtgtgtaacattccaaatactttttttttcttttccactgtttgtaaggtgcaacaatttaatatttttaagggactttttaagagttccttaagaaccaatttaaaattacttcagtgcaatcctacacagtatcaacattagaattttgatattagtcttatgttatcttccattctatttttatctgctttttgctgctagtttcaaactgccagtatttttccttttgcttttaaaatagttacaatatttttcatgatagccacagtattgccacagtttattataataaagggtttttatttgatttagcgcattcaaagcttttttctatcacttttgtgttcagaatataacctttgtgtgcgtgtatgttgtgtgtgtgcatgtgtggcgtatatgtgtgttacaggttaatgccttcttggaattgtgttaatgttctcttggtttattatgccatcagaatggtaaatgagaacactacaactgtagtcagctcacaatttttaaataaaggataccacagtgcatgctgtttgttc

SEQ ID NO: 36197 - DNA, 26391 bp, Homo sapiens
cggcggccgggagggggctccggggaccatggggctcctgaccattctgaagaagatgaagcagaaagagcgggagctgcgactgctcatgctgtatcctaccggacgccggaaccgcgagggtggcggggtccagccgggcaggcggtgccgggcgccccctgtcgggagcggaacgcggcggccggcgcgtcccaactgcccctggcgtcaccacgcgggccccatcaatcgccccgtcgggccgggaggagccgcaccccaggactggggcaggggccagctccgagggccgcagaagcggtcctgcaggcgcagcggcggggctaggcggcccgagtgtcaggggtggtgggtcccggagataactcggacgccaccacccggcggcctggcccaagcgtggggccgctgccctcccggctctgatctcctcccccgggcccgagggttccaggccccggccccgccctcgagctccgaatcccgggggcgtgcggggtggcgggtggcgcgtgtgggctccgcggatcctttcgagcgtggatccaacagtccgtctctttggtgttacgcggcccgtggttgtccctgcggctgaggatgtgtgtgtgtgggcccgagtgtcccgtgcgccctgtgcgccttctgagtccagttaggcgcccgcacctgttcccccagctctgtgccaggctccgcgggggaatggctggggagataagacgcttacgtgcacatataacttaataatcacatcatgactgttttgttttttgagacagggtcttgctctgttgccctggctggagtgcagtggcacaatcaaggctcaccgcagcctccagcttctaggcttaagtgatcctcctgcctcagcctcccaaaactctgggaatataggcatgagccacggagtccggcccatgtctgttttattttgttttgtttgagacggagtttcgctcttgttgcccaggctggagtgcagtggcacaatctcagctcgctgcaacctccgccccccgagttcaagcaattctcctgcctcagcctcccaagtagctgggattacaggtgcccgccaccacgcccggctatttttttaaatattgttagtagagacggggtttcaccttgttggtcaggctgttctcgaattcctgacctcaagtgatccacccgccttggcctcccaaactgttgggattatgggcgtgagccactgcgccgggccgcatgtctgctttaaagagctctaagaaaagcatacagttcactcatttgataaatattgagtgcctaatatgtgctagacactgtcctagtgcccagggtaataaaactaaaaaatcttaccttcatggaaattctgtaatgcgtgtgtgtgtgtgtggcgggggggttgcccgcgggtagaaagatgataacacaggaagtaagtaaaatatgtaatagaggctgggtgcggtggcacacacctgtaaccctagcactttgggaggctgaggtgggaggttcgcttgagcccaggtgtttgagaccagcctgggcaacatagtgagactctgtctctatttatacatatatatattctccatacatactatatatatatgggccatgctttggaccatgcttctggggaacagggccttatactgctccaggatgaactcccactacgtatataggtatggagaataatgcaatttagggtggtcaaagaaggccactgtatgatggcagggcgcagtggctcatgcctgtaatcccagcactttgaaaggccggggcggatggatcgcctgatgtcaggagttttgagaccagtctggccaacatggtgaaatcccgtctctactgaaaatacaaaaattagctggatgtggtggtggacacctttaatcccagctacctgggaggctgaggcaagagaattgccagaacccgggaggcggagactgcagtgagctgagatcacgccattgcagtccagcctgggtgacaagagcgaaactctgttaaaaaaaaaaaaaatgacaattgagtacatgagggaggcgagggttgaaccatatagcaattcgggggggggggaaactttaaagcaaagggaacagcaagtcagaggccctgggaggactaactggcgtgttcagaggactggtgaggagggcagtatggctggagtggggaggaggagcgttgactgggaaccccctcacctagggccttttggtttttggttttccctttcagtgagaagtgcagtggagagaaggaatcgcagaccagttaggccactgcagtgacgcaggcgagataggatggtggcttggaccaggatggaagtagtgaggtcatggaagtttctggcctgagcaattagaagggtgaggaaccatttgctgagatggagaggactgggggaggagcaggttcagggtggagatgagaaccctgtgtgtgcctgtgtgtgccatgtgagatgcctccgagacagcccagaagtgtcaggcaggcagctggatgtaggcactgaggtccagtgtgtgggaggtgcacatttgggtgttatcaggatagagatggtatttgaagctgtgatcctggatgaggtcacccagggatgagcgtggccagagaagagaacccggttgtaccaggatgaagtcaggtgaggagcagaaccaggtgagggtgtgtcccagtgccaagggcagcgcatgtgctggggaggagggtgagccactccatcaggtgctgagtggggaacagaagatgactgagcgctgtcccagcactagagggccacagggaggtctttggggactgaccttggtaaggacagttttggccacagcagcagcaaaagcctgatgggagtgtgttcttgaaagagcaagaaggcagaaatgggggtgagcacaaacaactattttgagatttcctgtaaaaggaaagatataaatgaataactagatggggcagagagatcaagggctttgtttgctctttttttttttttaatcagacggggtctcgctgagtcgcccaggctggagtacagtggtgtgatctcggctcattgcaacctctgcctgccgggttcaagcaattctcctgtctcagcctcccgagtagctgggactataggggcccgccaccacgcctggctgatttttgtagttttagtagagatggggtttcaccttgttggtcaggctggtttcgaactcctgacctcagatgatccacccaccttggcctcccaaagtgctgggattacaggtgtgagccaccgcgcccggcctatttgctctttttaaggtgggagaaagaacggcaagctcatcagccagtgggaatgatcaagaggggaaggaaacatggatgatggcttgggggcagggggtcatcagcggctaggttccaggggctaaggctgggcctcaggggaaatgccctcctcacccctctcctgggcctaggtcatttgccccagctccgatgagcagggaaaggtggtcgagtccaggacccgcccaccccaccatgcccaactgagctgcagtgttgggaagatagaggagggtggttccttccacaggtaagcacacccattaatttgcactgtgcagtagcaggtctggaatattccagaaacaaatgagggtggctgcctccagatatttgttcttaccttagttcttcaaaaagcttgctccttgtattttgggtctcagctccagacacctcagagaggccttccccggcacctgagctgaaagagcctcctccgatggccctcttggaaagcctctctgttgtgttgatggcgctagccgggatctggcagggccttcttttctcatttgtttgtactttattgactgtcttcccgctagagtgtaagcttcctaagggcagggctttgtcctctagcacccagaagagggtctggcacatagtaggtgttcaacaaattaaggagcctttggtcagtagagatgatatttataatttgatactttcatatttattgtgggccgattatggtcaggcatgtgctcaactcagtttgatacatggtgggaaataatgagtcccctaaggggctctgcaacaatgtcaccacctggcagagaacagggacttctccttaacctgctgcgccccagtggcctggacaatgctggaaagacaaccatcctgaagaagttcaatggggaggacatcgacaccatctccccaacgctgggcttcaacatcaagaccctggagcaccgagggtgagcaggggccccatgggagggccagcccagagcagggcagggaaggtgggagaggggcccagctgaccctcctgtcacccgctccttgcccagattcaagctgaacatctgggatgtgggtggccagaagtccctgcggtcctactggcggaactactttgagagcaccgatggcctcatctgggtagtggacagcgcagaccgccagcgcatgcaggactgccagcgggagctccagagcctgctggtggaggaggtgggcagctcctaccctttgtgtacatgtatggacgtgtggctgccttctcagcagatgcccagaggggcccgtggccccagagggaaaccagaggcaggatcccttccttctctgggcccccaccatgggaggcccatggtgccagaggcaggacacatgctgtggactgagattgagttaacgtccctgtggtgttactacgtcactaccctgagcatcagtttctatgccttgaaatggtgatgatgacacccacatcactgggctttagggaggataacccaaggccagtatgaagcttcgagaggccatggagcctggctcaagagtctgactctttgctgtgtgacctcagctgggggtggtggcacgcacctatagtcctagctactctggaggctcagacaggaggatcagttgagcccaggaggttgaggctgcagtgagctgtgatcgtgccactgcactccagcctcctgggcgacagagcaagaccctgtctcaaaaaaaaaaaaaaaggaaggggccaggtgcggtggctcacgcctgtaatcccagcactttgggaggctgaagcgggcggatcacgaggtcaggagatcgagaccgtcctggctaacatggtgaaaccccgtgtctactaaaaatacaaaaaattagccaggcatggtggcgggcgcctgtagtcccagctactcaggaggctgaggcaggaaaatggcgtgaacctgggaggcggagcttgcagtgagccgagattgtgccactgcactccagcctgggcaacagagtgagactccgtctcaaaaaaaaaaaagaaggacacttgcaaagatagtacagaggtcagaggtcccccatataccctttaccttgcttccccatcttacctaaccgtggcctgtccaaactaataaatcaacactggtgaattactattatcttaattacagattttatttgaatttcacgtttttccactaatatactttttgtgttccaatgtttgattcaggctacaaaattgcatttagttgaaaatgaggacacttgtgagagtgaaaggggggattctgcaggcagagtggggactgtcctgggcacaccgcacacatctcctatgtgggtggagcaggtcagatgagatcagggccgtcaaatgctggtcaaggcaggtcaaggcccaagggttagacccgtccacccacatctctcccaatcacagacacatatgtggaaacaactagaatcagaggtggacagtgaggcctgtcgggagtggaacggttaaagggctgtgtgaacccagaagagggagagttcacatcctctgtgcatgtctggtcatcagattggagcagtctagaaccacggagagctcagggatcatcttatgcaacacccctccctgttcatggaagaggaagctggagcatggggacagcggtgtcccctgggtggtggttggctggaaccagaaccctggcccagggctgctccattcatgtgggccagccttgatggctacgtccacaaactcactcctgggcctctcccaccaccacggggcctcaccttgatcttccaggtcgatccttcaccccagatgctctgggccattagaggaggggtcaggctgtcctctgagtccccaccccacccctctatcttttctcccccagcgcctggccggagcaaccctcctcatctttgctaataagcaggacctgcctggagcactgtcctctaacgccatccgcgaggtgagtccaggccccgggacaggctcgctgagggaaaggggcatacatttatttattttaaaagcatttattaaaaataaccaaaaaggctgggtgcagtggctcacgcctgtaataccagcactttgggaggccaaggcgagtggatcacctgaggtcaggagttcgagaccagcctgaccaacatgatgaaaccccgtctgtactaaaaatacaaaaattagctgggtgcagtggcgtgcgcctgtaagcccagctactcaggaggctgagacaggagaatcgcttgaacccaggacgtggaggttgcagtgagccaagattgcgccattgtactctagcctgtgggaaaagagtgagacttcgtctcaaaaaaaaaaaaaaaaagaaagaagtaaaataataataagaaaagcatttattagcctagccctgctaggtggcaggacctatgcagggcactggggatccagtgattaataaggcatggggtggcccacagcctggggaaggcagagctgcgcatgtgttgttcacaggctaacggtagccagcacaagtcagtgctttcagtatgctctgctccttgcatggattaactcatttcattctcacaaccacctcatgaggtgagaactattattttacagatggtgaagcaggctcacagaggttaggtaacttgtcccaggtcacacagccactaaatagacaggaagcctgtgtctgaccccagagcccacattttaaccatgattctagtgctcaagcaccacagtgagaaagagcagggttaaaatcttggctctgccacttatgagctatgttcccctaggcaggttgcttaacctctctgaactttggtttcctccttggtgaaatggtcgacacaatccctggctcatgagggcttgaggagaatgagtgagagagggtgtgtggggctcctagcacgatgcccggatcctggtggatgctcaggagcccatgctgcatttacatcactaaggggcagcactggcatggaactggacagagagcccaggtgcccctggggtctgacaaactctccctgggaccggcggggcttcctggatgggatgacatggagcagggccttgaggaaggcgtggagttcctctgggctggggagggaaggggctgacggcaggcagggtctgcagtcactggccaccaccatcagcacctttgtcctcccaggtcctggagctggactccatccgcagccaccactggtgcatccagggctgcagcgccgtcaccggggagaacctgctgccgggcatcgactggctcctggatgacatttccagccgcattttcacagctgactgaaccactccagatgccccccacctagcagtccaggtccctcaaccttcaccaaacactacccatggggggttgggagtcagccggccaaactaacactccccctcctccaccccagcctgctgctgctactgctgcccgctgctgctctgtggccacccggctcccatggcgggagggctgtgccctggctgtctctctggctcctgacctggcctttggctaccataccaagaagagagggctgggcggggaggagctgctactgctgctaccgaggctgtgggcctcatccttcactcagttgtgaaataaaccgctccttgccccgattcctggctgagtcatttgttgattcaacagcgttagagaccacctgggaccctcaatctagcaggggacagaaaggaatggatcattggagtcgatggtgaactgtggctatgtcaaagggatgcagaaaaagttatagaagcatgggacacggtgcaactgattccatctgcaggcttcctaaaggaggtcacattaaagctgggagtaaagcgcgagtagttttctaggtagaggaaggggaagacagttcaccaggggaaatccaactctcataggtatgaattagaaaaacagacacagctgcagaccagggctccaactttttgcatggaacatgggctgaaattcagctcccaattctctgttgcagccaggaacccatgtgcagtggacaacctgaacagctgtacaaggccagcacagattcaggcagaggggatcacaggacaggcatgatgagcaagggctccggctgggcgcggtggctcacctgtaatcccagcactttgggaggccaagatgggcggatcatgaagtcaggagatcaagaccatcctggctaacacggtgaaaccccgtctctactaaaaatacaaaaaattatccgggcgtggtggcgggcgcctgtagtcccagctactcgggaggctgaggcaggagaatggcgtgaacccgggaagacggagctggcagtgagccgagattgcgccactgcactccagcctgggtgacagagcgagactctgtctcaaaaaaaaaaagcaatggctcttgggaaatggggaggtgcatagagtcatgtgtaggagagagtgcagccagagggtgggaggggggccacatcaggcaggggtaactgaggccttccctgaaggctacaggaactcagaagcagtgccaggttgggaaaggataggaaatgaggccaccccaggggtccaatccaagtggcaaaactggcagatgttttcatggcacagggtcctagcagctgcttactctgcagggttctgtgtgaaggggtggcctgtccctccacacctgtgggtatatctcgtcaggtgggacgagagactgagaaaagaaataggacacaaagtatagagaaagaaaagtgggcccaggggaccggcgctcagcataccaaggacccacactgggaccggtctcttagtttcttcagtttttattgattattactttcactatctcagcaagaagaatgtggtaggagagcagggtgataatagggagaaggtcagcaaaaaaacgtgagcaaaagaatctgtgtcataattaagttcaaggggaggtactatgcctggatgtgcacgtaggccagatttatgtttctctctgcccaaacatctcagtggaataaagaataacaaggcagcattgctgccaacatgtcttgcctcccaccatagggcggtttttctcctatctcagaattgaacaaatgtacaatctggttttataccgagacattcagttcccaggtgcaggcaggagatagtggccttcctctatctcaagtgcaagaggctttcctcttttactaacccacgtcagcacagaccctttatgggtatcgggctgggggacggtcaggtctttctcatcccacgaggccatatttcagactctcacatggggagaaaccttggacaatatccggctttccaggacagaggtccctgcagctttccacagtgcattgtgcccctggtttattgagactagagaatggcgatgacttttaccaagcatactgcctgtaaacattttgttaacaaggcacgtcctgcacagccctagaccttaaaccttgattccaaggccgggcgtggtggctcacgcctgtaatctcagcactttgggaggccgaggcaggcgaatcatgaggtcaggagattgagaccatcctggctaacacggtgaaaccccgtctctactaaaaatacaaaaaattagccaggtgtggtggtgggcgcctatagtcccagctactcgggaggctgaggcaggagaatggcatgaacccaggaggcggagcttgcagtgagccgagatggcgccactgcactccagcctgggcgacagagcgagactccatctcaaaaaaaaaaaaaaaaaacaccttcattccatacaacacatgtttttgtgagctcaaggttggggcaaaggggttggggcaaagtggctggggcaaagttacagattaacagcatctcagggcaaagcaattgttcagggtacaggtcaagatgaaatttcttctatcttccctttctacatagatacagtaacagtctgatctctcttttccctacactgttctaagtactacccattccattcagcaatacagttagggacagccctatgcagtgccgcctatcaggatcctctcttatatgggacactaaggggtggcactggcgtggcactgtacagagagctcaggtgccccggggaacagataagctctcccaggggccggggaggcttcctggatgggctgacccttgagcagggagggaagggtctgcggtcactggccaccaccagcacctttgttctcccaagccctgcatctggactctctgcagccaccactggtacgtcaagggctgcagccccactgctggggagaacccactgcctggcattgactggctcctggatgacatttcctccagaaggttaagtgcaatctctgcctgccgggttcaagcaactctcctgccccattctcccgagtagctgggattataggcacccgacaccacacctggctaatttttgtatttttagtagagatggggtttcatcatgttggccaggctggtcttgaactcctgatatcaagtaatccgcccgacttggcctcccaaagtgctgggattacaggcatgagccactgcacctggcccccagctaatttttaaatttctcatgaaatcagaggcagcctgttgcccaggctggtcttgaactcctggcctcaagtgatcctcccgccttggcttcccaaagtgctgggattacaggcatgagccccatgccaggctttgcttctttctgaagaccaaggcaccgcacctgtacacctgaattccaggaacaagagtggctattcacaatgcttcctctgcagtaaatactatgtgttgtatgtaagcctaccaacttcatgctgcatttcaacagatttttgcttcaattctaacactgactggagcaaaggtctcaaaacccatgccaggtttgggaacaccagtctccacgtggcccacactgacagtaccaataccaccaattttgtggacgtctggaggggcagaaccaagagcttgtgagttggtggtaggatgtgatctagagcttccgagcagcgtggttccacagcatcgccatctttacaggtgactttccatcccttgagccaaggcatgtgagctcttggctcccgcctgttgtgaccactccaaccagatattggcacaaatactactatgtcagagttgtagccaatttcttaatgtaggtgctgatttccttaatgatttctcccatctctccttttttttttttttttttttttgagacggagtctcactctgtcctctgtctcccaggctggagtgcagtggcacgatctcagctcactgcaacctctgcctcctggtttcaggcaattctctgcctcagcctcccaagtagctgggattacaggcacccgccaccatgcccagctaatttttgtatttttagtagagacggggtttcaccatcttggtcaggctggtcttgaactcctgacttcctaatccacccacctctgcctcccaaactgctgggattacaggcgtgagccaccacgcccggcccccatctctcctctttagggtggctcattgggatccattttgttaacaccaacaattagtttcacacccagcgtgtaagacagaagggtgtgctcacgcgtctgcccattcttggaattaccagcttcaaattcatcaacaccagcagcaacaatcaggacagcacaattagcctgaggtcaggtttttgataaagtctctgcatcctgggccattgaggatggtcacatagtacttgctggtctcaattgccagcagggaggtatcagtggtgataccactctcacgttcaactttcagcttacccaagacccaggtatgcttgaaggagccctttcccatctcagcagcttcctcaaaattgtcgatggttcttttgtggatcccaccacacttgtagatcagatggccagtagtgctggacttgcccaaatcagatgatgatgttgagctgagtcttttccctcccctgctccctttcttttgagatggagtctcactctgttgcccaggctggagtgcagtggtgtgattgcagctcactgcagcctcaacctcctgggctgaagccatcagccagctcagcccctggagtagctggaattacaggcgtgcgccaccacgcccagctaatttttgtatttttagtagaaacggggtttcaccatgttggccaggctggtcttgaactcctgacctcaagtgatccacctgcctccactgcccaaaatgctgggattacaggcgtgaaccaccgcgccaaacccccattttggctttgatttaacggtggttttcacgacacctgtgttctggcagcaaacccatcgcaaaaaagctccactgccctacacagattctattataaacatctccattctacagatgagaaactgaggctgagtagttaagggaaactcctacagctagtaagagtcgtgactcagagcccatgacaccatcctgcttctccaaccttctttgcttcctctactttccagaaaacatgaattagggaatcctgtggagggagacagggaaataatttgacgttgtcctgtacatactggacacaataagagttgggtggatgaacgaaagcagggatttaggaagcggggagaagtcgtttggaagtctgtgacaagggtttacgcttggatagggtgggcttgatcacccggcagaaatgagacgagtgatcccagccttcccaaccaatctttccagtgacctgggtttacgcttcaccacagagaaggaacttttcagacgctcccttggccgcgcacccgggatcggaacagcgctgtcacttgcgacaaaatccctaggccagaggaagaagagcgcaggcctggcgaggcggcggcgggcggaggctgggccggaggggtggggacggcgaggaggtggaggccggcgctccgctccgctccagctcggtttcatgtcccgccaggcgaaggatgacttcctgcggcactacacagtgtcggaccccaggactcaccccaagggctacaccgagtacaaagtaaccgcgcaggtgaggtggggcccagcgcgtactttacccttttaactagaggggcgccgagttttaccttaaggaaaggcggtgcagccactgctccctttttagacgacagaaatgggtttcccctttaaggggaggttgcagtacgaggcttagtttacatctttaaccaccagggggcggggtcctgggtgggcgctgtcttttttaaaagggcgttgacggccgttcccggacaggcaaggcgtgtatgcccacgcccggagtgtagtgtctgggcatcaggctgtgaatttctctaaattaacatgaaaactctggtttaatccaaatattagtactccattctcgtagagtaagttttgtttattggtttgtttgatgttacataaactccctttaacgagtttaaccatttttaatttttcaaaaaataatactgatcagtggttgaaaaaaattgatgcagttcagaaggacttaaggagtaagtcgccatatcaaggtcacagcaggaagatagataggctagagttgatatatgaagcgataacaacatcataagcacaatttatagagagacatggaggaaaccatgacaataattaaaaatgaaacagtaaaacaggacacctgtagaatgataacaagaactggtaacaaggaaggtccccagggagaggaactgtgtcactggggacaggagttaggggaagactttttactgtaaattttttgtacttttagaattttcaaccaggcgactattaagctggtgcattagttaactctaaaagcaaagcaggcacataaggacacttccaaagtgatctaagtgcagaatcttagctatttaaaatatgctttccccaaaccgtttacgtcttttccatgcctaaaaataatgcaaataaggccgggctcagtggctcatgcctgtaaatcccagcactttgggaggctgaggcagcagattgcttgagctcaggagctcaagacgagcctgggcaacatagtgagaccccggatcaatattaaaatacagacacacacacaactttaaaaaaaaaaaaaaaaaaagcaaataaatagattgtccctgggaagatagactggaggtggggctggggtggggaggatgtggcaaggaactgtaaccttttattataagtcttcccagtggtggccgggcgcggtggctcacgcctgtaatcccagcactttgggaggccgaggcgggcggatcacgaggtcaggagatcgagaccatcctggctaccatggtgaaaccccatctctactaaaaatacaaaaacttacgggcgtggcagcgtgcacctgtagtcccaggtactcgggaggctgaggtagaagaatggagtgaacccgggaggtggagcttgcagtgagccgagattgtgccactgcactccagcctgggagacagagcgagactccgtctcaaaaatataaataaataaataaataaataaataaataaaaataagtcttcccagtggcttttttgtgtcgttgttttgttttgtttttgagacagagtctcactgtcgcccagactggagtgaagtgactcgatctcagctcactgcaaacttccgtcgcccgggttcagattctcccacctcaacctcccaggtagctgggactacaggcacgcgtcaccatgcccagctaatattcgtattttttggcagagatggggtttcaccatgttggccagaatggtctcgatctcttgacctcatgatccacccgccttggcctcccaaagtgctgggattacaggtgtgagccaccacacccggcctcccattggctttttaaaccaagcaacatgcattactttgatatatttttatacatattatataatacaatgtattatatataataaatataaaatataaagcacataatatataaatatatgtatgtatatattttttgagacggagtcttgctctgtcgcccaggctggagtacagtggtgtgatctcagctcactgtagcctccacctcctgggttcatgcagttctcctgcttcagcctcctgagtagctgggattataggcgtgtgccaccacacccggctactttttgtgtttttagtagagacgggatttcactgtgttggccaggctggtctcgaactcctgacctcaagttatcctcccacctcggccttcccaagtgctggaattacaggtgtgaaccaccgcgcctggcctatatttttattttattttattttatttgcgacggggtcttgctctgtcacccacgctggtgtgcagtggcatgattcacgtcttactgcagcctcaagttcctgcattcaatccatcctcttgcctcagcctcctgagtagctgggactacaagcatgtaccactacgcctagctcaatttttaaattttttgtagaggctgggcgtggtggcgcacgcctgtaatcccagcactttgggaggccaaggcgggtggatcatgaggtcaagagatcgagaccattctggccaacatggtgaaaccccgtctctactaaaagtacaaaacgtagctgggcatggtggcgctcacctgtagtcccagctactcgggaggctgaggcaggagaattgcttgaacccgggaggcagaggttgcagtgagccgagatcacaccactgcactccagcctggtgacagagtgagactccatctcaaaaaaaaatttttttttttgtagagacagagttttgccatgttgcccaggctggtctcaaactcctggcctcaagcaatcctcccattttggccttccaaagtgttaggattacaggccaccatgacccaccgtacctggcctataattttttttttttttttgagatggagtctcactgtgttgccaggctggagtgcagtggcatgatctcagctcactgcaacctctgcctcctgggttcaagtgattctcctgcctcagcctcctgagtagctgggactacaggcacttgccaccacgcctggctaatttttgtatttttagtagagacaggatttcaccatgttggttggccaggctggtctcgaactcctgacctcaagtgattctcccacctcggcctcccaaagtgctgggattacaggcatgagacaccacacctggccactcaatggcttttaaatagtttcttttaccagaatattttaggcaagtctctgttgtcaaaagcaaagtccagggttttagtcccagccatctttcttacttagtgtgtggtctactatggccacacctctcagagcctccatttcctcatctcttaagtgggcatgtcaattatgtctgcctcagtgggatctaggataagaaatagatgtttttatttatttatttagtgtgtgagagacagggtctcactctctccaggctggagtgcagtggtgcaatctcagctcactgcaacctctgcttaacatgctcaagtgatcctcccacctcagccttctaagtagctgggactacaggtgtgtcacgccaccacacccagctaattttttgtattttttgcagatactgggtgtcactatgttgcccaggctggcctcaaactcctggacttaagtgctctgcccacctgggccccctaaagtgctggcattacaggtgtgagccaccgtgcctggcataggagatgttattaaactgtcaagtaccccaaaccataggacattattttaaaattattatgaacataacgatgaaaactgaatcttgttttcacctcagacccaagtctgcccttccagggacttcaactccagtgatggtttcttctgtgtccagggcgctgaagcgcaggatcttctcccgcagggaaggaggttcctgaggcagaacctcccttctttggaggcttggggttctttggtttcagaagtagatggagggacttggtctgttcaaggaactgggataaaaattgggctgatggccgggtgctcacgcctgtaatcccagcactttgggaggctgaggcgggcggatcacttgaggtcatgagttccagaccagcttggccaacatggggaaaccccatctctactaaaaatacaaacattagcaagcgtggtggtgcatgtctgtagcttcttgggaggctgaggtaggaaaatcgcttgaaccctgaaggcagaggtggcagtgagccgagagtgtaccactgcactccagcctgggcgacagagcgagactccatctcaaaaaaaaaaaagttgggctgaggttggagcagtccaaatgggcctttaggggtcctcctatttgatagatggagaaactgaggtacatagtaggaaaagttgctaaaattacacgcgaaggcttaaagccagggtgccttgatgccagaggccaatggccaaaggctactgccccgtgagggggactaggaggcacctggggcattacagggtgagagggtgtcagatggcagtctctggtctcaaccagctcttgcctttctttctcagttcatctcaaagaaggacccagaggatgtcaaagaggtgaggctcctgggaggaagagggactgttctgcagttccagatctggaaactgtcaaggggcagctggtaactctgcttggacatcggccctccttcctccctgtccctgggcgaggggctgctgcagctgcttcctgatcctcacgccccctgggggcaggctaggcatgggggcggctgcctcccaccattgctggttctgggcaagtctcatgtacctcataggtggtggtctggaagcggtacagcgacttccgcaagctgcatggagacctggcctacacccaccgcaacctcttccgccgcctcgaggagttccctgctttcccccgggcccaggtgtttggtgagtgttagattggggcactcgggccaaagatggagggagcattgggcaaaaggggacctccgccagtgggggctggatagagagggcctgaaaccctgggcagagtcatgtttggaagggcccttagagatgacctcatttgacagatggggaaactgaggctcagagtagcctaacccttactgtgtatttcaccttttaacattcctgttgggccaggcgtgtggctcacgcctgtaatcctagcactttgggaggccaaggcaaaactccatctcaaaggaaaaaaaatcctgtctttatcagctccattttattttcctttttcttttttgttgttgttgacagcctcactttgtcacccaggctggagtacagtggcgctgtcttggctcactgcaacctccaccttccaggttcaagggattctcttgcatcagtctccccagtagctgggataacaggtgtgcaccaccacgcctggctaatttttgtatttttagtagagacagagtttcatcatattggccaggctggtcttgaactcctgacctcagctgacctgcccgccttggcttcccaaagtgctgggattacaggcgtgagacactgcacccggcccatctcaatacttagtatattgattacatgttgcaatgagaatatttgggatatattgggttaaataaaatattaaaattaacttgtggctaggtgtgatggctcacacctgtaatcccagcactttgggaggccgaggcaagcgaatcacgagatcaggagtttgagaccagcctggccaacgtggtgaaaccccgtccctactaaaaatacaaataattagctgagtgtagtggcaagtgcttgtaatctcagctactcaggaagctgaggaaggagaatcgcttgaacctgggaggcagaggttgcagtgagccaagagtgtgccattgcactccagcccaggcgacagagtgagactccgtctcaaaaaaaaaaaaaaaaaaaaaattgtttcttttttcctattatttaatctagctgctagaaaatttaaaattgcatatgtagctcatatctgtattagacagtgctgaccagttgcttgggtctgcatactcatgtgagatgttcttttttgttattggtttttgtttttgttttttgagacagagtctcactctgtcacccaggctggagtccagtggcatgatatcagctcactgcaaactctgcctcccaggtttgagcgattctcctgcctcagcctcccaaatagccaagtagccacccaagtagtgtgcgccaccacacctaatttttttttatttttagtagagacagggtttcaccatgttggccaggctggtctcgaactcctaacctcaagtgatccacctgcctcggcctcctaaaacgctgggattataggtgtgagccaccgcacctggccgagatgttcttttgaagcaaggtaaaggattgctgctgtcaggttatgccaggccagtggggaagtaccacagactggccgcacagtaactggaccagagttagcctgctctgcaaaatacctaggacagagcagtgaaactgtggctcgcacctgtaatctcagtgctttgggaagccaaggcaaggtaatcacttgagctcaggagttcaagaccagcctgggcaacatggtaaaaccccatctctacaaaaaatacaaaaattagccaggcatgattgtgtgcacctatagtcccagctacttgggaggctgaggcgggagggcggcttgatcccaggaggcagaggttgcagtgagctgagatcgtgccactgcacaccagcctgggtaacacagccagtccttttctcaaaaaataaacgggggctccttgctttgtgaccttgggcaagtcactttccctctctgagccttacttttctcattagatcaaagccatcagaaatgcttttgtttcttgttaactgcctagctccccctgggtaggatatgatattcacaagggcagagactggttcctcccctgttcaccttctgagtctagcatatagtaggtgctcagtaaacatctggcaaatgaatgaatagggaaattgatccctcctggaagcccctacctcaccccaggaggaaccagggcagattgctgggagaatgggtaggagggcagtgagttgctcagagcatctcaggcaggaccaggaaaagtggccttggggcagaagcccctgtgggtcaccgccactctcccctgttccttgtcctgggggccgtaggccggtttgaagcctcagtgatcgaggagcggcgaaagggggcagaggacctgcttcgcttcactgtgcacatacctgcgctcaacaacagcccccagctcaaggagttcttccgggtatgtgcaccttccaccttcccagaacttgggccacttacccacccaccagattgcaccccatgactccccatgtctgatctttctgtcctgcagggtggggaggtgacccgacccttggaggtgtccagggacctacacatcctgccaccccctctgatccccaccccgccccctgatgacccccggctatcccaactgctccctgcagaaaggaggggcctcgaggaattggaggtgccaggtacatcggggtgggaggagggaaccagggctggagggtgcagagtggggagggcggccacactccctcctcagtgatcttactgagaaatgtgtgtgtgtcccaggtctatcacttaactggctgaggaactttgggcaggtccttttccttctctgtgctacagtttcttgatctgtaaaatgagcacaaaccctaataacaggcttgtctatgcccatggttgctgcaagggtttaaggagagagtaattctattttgaaagctgagaaataaacgcaggtattcatgaccccacttatctcttcctcagtggaccccccaccatccagccctgcccaggaggccctggatctcctctttaactgtgagagcaccgaggaggcatctggttcccctgcccgaggccccctcaccgaggctgagcttgccctcttcgaccccttctccaaggaaggtaatgagctgggacagccgggaaggagccagggcaggacgtccttgggacagggaggagggcagagccccactagcctgctcagtgcctgcgcagatcagggagagacgtctcctcagcagtgctgccctgtgggccaatagcagcttcaatgagaattagaagccctgtgccagggcacgtggtgtggtgtgctggatgcacctgtgcaacaaatagccacgaggaaggaaaggaggcacttcccatgttggggccatctcactgagaaggctttggaaagagccgggtcacactgctctgggacattttagttccttccctgcaagctcttggtgggatttcctgactggccagggtctggctgcagatcctgaaggcaagaggcctgctggtcaatgggagtgagttctcagctcaaagggcagctgcaaagggaaatccctctgggggcctggagccactggcatttggggatgctggaggtagaagggcccccccaatggaggtcagggtcctgggcaccttcttgctgtgagatcctgggactcgacagtcccaagctctgagacactggagtttttcattctaaaatttgccaacgcctggcacattggctcacacctgtaatctcgacactttgggaggctgaggcaggaagattgcttgagcccaggaattcaagaccagcctgggcaatatagcaagagtccatgtctgttattctttttctttttttgagacagagtctcactttgtcgcccagtctggagtacagtggcgcaatctctgctcactgcaacctcccaggtccaagcgattctcctgcctcagcctcctgagtagctgcgactacaggcgcgcaccacggtgcctgctaattttgtatttttagtcgagatgggatttttccatgttggtcaggctggtctcaaactcccgacctcaggtggtgcgcccgcctcagcctctgaaagtgctgggattacggatgtgagccaccgcgcttggcccgtttttttttttgagatcgagtcttgctctggattgccgaggctggagtgcagtggcgcgatctcagctcactcccacctccgcctcccggattcaagcgattctcctgcctcagcctcctgagtggctgggactacaggcgcgcgccaccacgcctggctaatttttgtattttgagtagagacagggtcgcaccattttggtcaggctggtctcaaactcctgacactcaagtgatccacctgcctccgcctcccagagtgctgagattacgggcgtgagccaaaatgccctgcctctttcacttttcttgttctgcctcctcccgttcctgctcctgcctctccagggttggggagtgggaagaaggaatgggagggaaaggcaatgttggtgtcacagggctgttatgcctggcctctgggtggcaggcatccaagtgctctgtccttgtgccagctgagtccctgctgggcagctagctgcctgggcaggagcttttctattttttttcctctcctttttaatttttttatttttttttatttattttttgagacagagtctggctctgtcaccaggctagagggcagtggtgcgatcacggctcactgcagcctccaactcctaggcttaagcgatcctcccacctcagcctcccaaatagctgggacaggaccacaggcatgcaccatcatgcccagctaagtttttgattttttgtagagatgagatctcactatgttgcccaggctggtctcaagctcctggactcaagtagtcctcccacctcagcctcccaaagtgctggatcataggcatgagtgactgtgtccagccaggatcttttcaagacccttcacagacagctccaatgagacattcactcagcccatgggaaaagtccccaaagcctggaactgcagtgtgctcagacactgccttatttccctaccctgccatggtgggcacctccaacaagcctctcaccaccagaattctcgaggcaaggagtgggcacctgtgtctcccttcttcacagcaaactccttaactcgagtgtgcaggtgtcccaggtactcttctgctctctgctccctgagcaatacatggagggctgtaggcccagccaggaggtgccttctccctcctgcaggaggcccggacttctcagggctctcatggaactcacagggatggggttagagaggcacccactttttccctctccaggatgatagggtatcatgatgcttcctgcccccgcaccttcccctcagaggccttttcaccaaaggtgcaccagatttccagtcgcctcgtgtgtaagctgcaggtaggatgtccgacccccttttagccagtccagggggatataatgagcctttacctgggaaatgtgaggacacctgtcactcactgtctttacatttgggggcctcagctgaaactgcaaggcttcagaaaacccctgagattctctaagtctcctattctaagattattccaagtcttggagcatttctaccctcagcctggtggtggtggcctagcatccttcagggaaactttctggaggggatttttggatttctaggtcaactggagtcaagagggaaataggaccagtgacccagagcttacaaactagagtgtgtacctaaagacataattaggaaggtaaggctgtttttacagaagcacatgaaccctatcgatcaaatagctcatggctagtttttgatccacagacgacttctggattgctctggcattggtcccctctactggggacaggctgataccctgatggacaaaagaagtcttggggttgggcagagggcctgggaaaggaagggccagtctggtccgagtcctccctttctaactgcagaaggcgcagcccccagccccacccatgtggctgagctggcaacgatggaggtggagtctgcaaggctggaccaggaaccctgggagccaggagggcaggaggaggaagaggatggggaaggagggcccacccctgcctacctaagccaggccacagagctcatcacccaggccctgcgggatgagaaggcaggcgcttacgctgctgcactccagggctatcgagacggcgtgcacgtcttgcttcagggagtccccagtgagtagggactgagggtggagggtcaggcctgggtcccaggtggggcagtgatgaagggagcaaaaaaacaagcaaatcacggatcaggagcccttttactcctcactgaccagctgtgtaacctgggcagatttttgtttctgtttttttgttgttgttgtttttaacctcttgtggcctcagttttcttcttcctctttttttttttttttttttgagacagagtcttgctcttgttgcaggctggagtgcacaatctcggctcactgcaacctccgccccccaggttcaagtgattctactgcctcagcctcccgactagctgggattacaggcgcccaccaccatgcctggctaatttttgaatttttattttttatttatttttatttatttatttttattttttgagacagagtctcgctctgtcgcccaggctggagtgcagtggcacaatcttggctcactgcaacctccacctcccaggttcaagccattctcctgcctcagcctcctgagtagctgggattacaggcacgtgccaccacgcccagcgaatttttgtagttttagtagagatgggctttcaccatgttggtcaggctggtctcgaacccctgacctcgtgatccacccacctcggcctcccaaagtgctgggattacaggcgtgagccaccgcgcccagcatggcctcagttttcttatttgtagactgaggagaatggatgctgggccccagagaggagggaaaagcacatggtgatgctctgcgaattgtaaaggacccgaccaggggttctgaccaggccagtggtgcccaggtgcctcagctgagcattctctctccacaggtgacccgttgcctgcccgccaggaaggtgtgaagaagaaggcagctgagtacctgaagcgggcagaggagatcctgcgcctgcacctgtctcaactcccaccctaacagggagtgggccattccctgggactctcgctcctgcactgccagccccttctcctctccccagggcctggccctacctcctggtcttgtaattacaggagccatttctgtaggtaactggaccaagaatgagaaaaataatgaattcttagctccctgattacacctgccaccttggaatcaaggactcacacttctgaccctgcctgtctttttggggtttttttgagttggagtctcgctgtgtcgcccagactggagtgcagtggtgggatcgcggctcactgcaacctccacctcccaggttcaagcagttctcctgtctcagcctccccagtagctgagattgcaggcacatgccaccacgcccagctaatattttgtattttcagtagggacggggttacaccatgttggccaggctggtctcgaactcctgacctcaagtgatccacccgcctcagtctcccaaagtgctgagattacaggcatgagtcactacgcccggcccatgtctgtctgtcttgatgtgtgagcagcagctgtggtcattaaaccattagtttacccctctagaactggggtctgcaaactcccacctgcagccaaatctggcccacctcctttttaatgtaagggctgtgagagtggtttttactttttttaatgattaaaaaaatcaaaataatattctgtgacaatgacaggtgaaatttatatgtgacaagtgaaaattatatgaaatttaagagtccataaataaaatttgttggaacac
